United States Patent 6,812,339 (POLYMORPHISMS IN KNOWN GENES ASSOCIATED WITH HUMAN DISEASE, METHODS OF DETECTION AND USES THEREOF) - sequence listing, part 11

SEQ ID NO: 12003 - DNA, 48119 bp, Human
tatatattaatttcatttcagaaagtaaaggatttggggtctgatcagtttgagaatcaattttttgtgtgtgcgtggaatggagagttagtagttatttttgagagagaacagtatgggaattattagattagtagaaataaactaaactgaaaatcaatgtgcctgaggttcattcttaaatcttactaagtggcaatatgacattcagcaagtgatttaactctctgaatctccatttcccaattttaaaatgaatccattagactaagaggtccacaagatctttttctattattcaatcattgaataaagactgttttaaactttctttacaattaagtgtgttgctttgattacattcatcaaagaaatttccacctaaactggctcttcaatattgatgacctaatacaaatttaatgttttaacaatcagtaacacaccttcctagagattcaggaagggaagcttaatctgtcagggtatctttaaataaatagtgtgttagcttaattatacaatgtcagctttcaattctaagaaggtatataaaacctaaaagcaaggtgttccccaaccccccgccaccaaccccgccccaggctttggaaatttgtgcccccattgaagagtattttcacctctgaactttcaaggacaactccttttgcctcattgaaactggctttcaagcttggcaaccaagataagaatattaagtacacttattttaacactcaaggacactttctgaataaaccagaatctagggagatataagtgaataatttggacctgctctctttgaatgtttataatctggtggaaaaaaaatggacatatgaatattgatttgtgaccagtgcaaagggggcaaaaattcatatcccaaagaaaacggggacacatcaggtctgtcttgttcatcactgtgtccacagggcctgacacctagtaggctcagtgggagaaaggagccccaattaccaacaaaagccaggaaagaacgggaggctcttacggaaaagggtgatacttaaactgagcaaggaggcacctggaaatagtgccacctaataatttttggcgatcagactgacacactagaacggttcataagaccagccttctcccattggctagcttccttcctcacccttctcaccctgggcaagccgcttcctctctctgggcctcttgcttttcctctgtaacataaaaggggttgagcaatatcatctctgagagcgccatgtgtgtgcgtgccagagggaaaacccccacaacgctaatacatcaaaactgcaggtttgcacaaaaactgaattctgctgaatgcaaacaggcaaacagcatttaccaggaaacaaaacaaaatcaagcacataaaaaagtaggaagagttggaaaacggaaggaagataagttctcaaacagctggaatagttgatgttagctagcgaagtttttcagaggaaaaaacaagaagttggttatgaggcaagtggacctgagaaaaaagactaaaggggaagaatagcaagtaaaacagaactccacttgctagatctctccctctgtcgcgctctttcacctgacccactcccttattccccccacaccctttccttctctccctacgttaccgcacaggaacgaagtctgggtcatgtgcggaccgcttgtggctcttaaatcctctttttgtcaccctggccgtgcaaaattttgaaacgtccctcggcaaaaaaaataaaaataaaaaaaaaaaatctgtccctggcctcttccctagttctgggtccagttgcagccaagtgaggggcagcgcgcgctcccaagtccccgtttcagagacgcgcacgcgcctggcgcccaacccccaatcccctgctgctcagtgaccccgcccacgggtttccgggccggcgtagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggtaagccgccggctcggcagtcctccgggtcgtcctttctgcccttgagcccctaacgcagcgccacgccaactaccgcttccccccaggcagacgcttgtgggtggccagagcatcttgactggattcggggacccttggggaccttcttccccgccaggctcgcgaagttaaagttcatctgctgagaacttctaactccacactttcttggttatcttggggactcaacactttgatcaagaacttttttattcctcccgcttaattttgtttgctttgagagagacttgggaactgcaatcgtttggttctccagtccgatctggtagcgttatttttaaaatttatttttattttttattactattttactagtgaagatagatgagctcagagactctcgaggatatagcatgaagttttctctttttgttagatggtgggaaagggactttctgcccagcgattttggtttgagcgggtgttgatgagtactagaaaacggctagtaccactctgcattgtttcatgcattgcaaggaggtaaaaattttttaaaaaattaataacaaagaaaacttaactctgaacctagtaattagaaatgcccagagtctgcacaatgtttggctcatggaaggctctcaataaatacctagtgtttgaacatactggagatattccatatgccttcagataacatggttacccctagaacaaagaacctagtgaagggggtggggtggaaaaaagacaatcactagttagaagagtcacactgtggtctacccaaaccctcttacagcctgtgacttctgcagagtcagtaaaaaatcagctataattttcttgtcaacagaacaaagattaagtcatttgttactaaagaaatacctttttaactgactgtatagcatttcataatcctgaacattgtaacttttttttttttttttttgagaatggagtcttgctctgtcacccaggctgtagttcagtggcgggatctcggctcactgcaacctccgcctcccgggtttaagcgattctcctgcctcaatctcccgagtagctaggattacgggcacatgccaccacgcccggctaatattttgtatttttagtagagacgggtttcactgtgttagccaggatggtctccatctcctgacctcgtgatccgcccgcctcggcctcccaaagtactgagattacaggcgggagtcaccacgcctggccttttttttttttttttttaaatttgagtttgaaggttggggcagaaagagatcaggatttgcactgccctgtcacatgcaatctcccatgtcagagcattaatctcaaacatggaaaaactttaaaatacacaactctccagatggacacagctgaatcattttcaggaaggctctgcctataaaattacctttggccttaattcagtaattaaaggcacccacaggtctgagccctcatctatgaaggttaaacgtatcattcctatcagcactaattggttttataggatacagacctctagtttgctgaataaactttggaaggattcagattatgaggttctaaactgtagagcctttgaggagaaaggtaccccatttcttctccgaatagatcattttgtgtcttctcctgggcttagcacattgtcttccttaggatctgatagtctgtttatttatctttttgttgtcataccttttattcttgcatttcccacttttgactagcattttgccttttctccgtttctggaagcctgtaattttcaacattccccatttctccttttgttcagtggaaaaatttcttcagtgttgggatgctctggaaaggtactgtagttttgggggtctccctgcctgctgggctgcatagcatatctctcttttttgagacaaggtctcactgtgttgcccaggttggaatgcagttgtgcaatcatagctcactgcagcctccaactcctgggctcaagcaatccttccacctcagcttcagccgctcaaatagctgggactacaggcaatgcaccaccataaccagcgaatttttaaaaattatttttgtagagacagggtctcactatgttgcccaaactagtcttgaagttctgacctcagccccgcaaagtgctaggattacaggcgtgagccactgcttctgcttgcattatctcaaatttttagagcctaacttcacagtcttgcctcggagcaggaactgtttgaggcaacaagatggagcctctggtttcttcactaggcagactgtgctcaaactgggtagcatgaaaggaaagcagcacaattataattgaaattgggggattctttcccctattgaaatccaaataattttcctttattgtgctttttttttttttctttaggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggttagttttgttggaagttggatttacattttcaatgatttgatatctgaaaactcttctgattagtagaccctcagaattttaattttagattaagaagttgaccggaattgacaccactcttcccaagagtagtagtagttggtataattttgccactttatttaaaattatgattttagtaggtttacaaaataccagtgctacatttgaatatgtataaattatgtttaaaatttacattttggtaagtatgactaaattcttaatttattttcattattactaccactttatttctaaatgttgccatagtcatttggctttgttctaaatctgtaggaaagatacagagattacacattttgttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagcccatttcatttgttcttcacaagctggaacttttcttgtaagctaaatattaaatggttcaagtaaattggatacataagcctgaaactaggcgtttctcattatacatagagtataaattaagacagactttttcatggtgaaaggtttacagcctttaaaacatctgggaagaagtgggaaagtagggaataactctgttaaatatgataaaagacaaagcaccaacaaaggcctagttctaaacttgttataatttctcatgggagttgtggtttgtcacaaggttatggcggtccaagcaagtttacaatattttttagaataataactcccagaaatatttttaaaataaggacctttctttaatatggaaaaaaaaaagatgaaatagagaggaagaggttgcctttcctcaactggatttgctggtgtgatatgcagctggtggaaaccagtttgtccatgctagctgttgatggccaccagtccactgaattagtggaaacccatgcttaaccagttgttaactatttttagtatcatttccagatgctacgcatttttttgtaaaaaacatacttacaatagtatctatataaatttttaaaattgtaatgtatatgtggtatatttaacctgaaaataatctttggtgtatacgttgatgagcctaggcctttgcagacctcttacagttactctgtcacagcccttcaaaggttctttgacttcagattaagaatcaattgcatgtggaatgcatgtgcaaaggaagagatattcaaggcaattgttaccatgtaccataaaccttgtacataattttttgtcattttcttttcctctgtctctatcccttcttctttgacacacaatagacacctagtcaatttattacaaaaaaaatgaatgaatgaagtggaattcagttgggaaataggttaaataaattatttaggagatgaggaataggtaaaaagagacaagtacatagtttattcttttgacttagaaaacttttgattcttaaattctgcagaattggagaaactggtggggaaacttctaaaatcattatttaattaccagagatgtaatagatatagacaaaagcagttttcttcttttattattttttcatcagttagttcttagcttaaatagtagtccaaagctggtagggacagagggaattagctggtggctgaatgaggaattgtatcactttttgtgaatcacggtgtaagcacatttggtgttttgccattgcctaagaacattagtcacattaggtcaatagaaaatcactttttaaagccaaataaagttatatgtgttcccaaccatgagttggaaagaattaatatatatgctgttggagggtagaaccctgcctaatcatatggttctggatggcattgatcgaatccttattctttcattaggaataacaatagaaaaaatactcctgccctactgatttcaggatatgtctattttaaagtgcccatttgacaaaaccattatcagggccatgttttctttttctgcagaaaaatcaaccactctggtcagtagttaggtcttatgacaagcaccataatttccttaggcagagtagaatataataggatacttctttttgaaacttaatataatcaggtagttccagataaacatagcttgcaaagtgataaaataccatgttattttagtaaatccaattgcaagagtgatgggaaacagagtttaaaaacttaagaaagatattaagatggagttgactttgaataataaagtcatccactgttgatgggtgacatttattaatacagaaagtttacagattttaccataagcatcagggtatttcctgcagctggggaaaccgtgcttgaaaggatgcgtaactcaaggaaaacacaagcccatgtaataagtattgcatgtgagaattgttcctatagaattagaaagcatcttttacattaaaatttatttttgtaaaaagagaaaacatcaaaacttgagtagtatttgctattcaaagagtcttacataaacgaaaacatactcaacctactgccattacagaaatatttgacaaattcttgccatgcttacctgccatcgttgttgttatcctacaaatcaattggattttcacgcctctccactgactggaaccctacaacttgcttccttttatcctctttatatatgcttcagatatgcttgaagtagattgtttcttattgttcttgctgctcgagtttgttgagtagttggtacatgcagagtatttgtatgttatgacatatataggttttgtccatggttcctggctcataactcactcccaagacccttgttacagaaaccagaatctctctctctgatcttctcctaccctcctttcatctgcccactgcagaactctaatctgattatggtttctaagaccctcataccagagagtattctgccccataccatagcagaaggaacactgcacagagacaccaagaagaatctgaacagacaggccttgttaggtttagatcatgtccttataacctaattatattttaacatggttatccatgctttaatcatgtgtattcaatgaacgctccataaaagcccaagaagaacagatttgagggaattctgaagcgctaaacacgtagggtctgacaggaaggtgaagaagaactcatcatgctggaagggtggtccaccctaactccgcagggacagaagctcctgtgtctgggacccttccagaacttgctctatgtatctcttcaagtgcctgtgtatttatatcctttcaaatatcctttgtaataaatcataaacatgtttccctgagtttttatgccactctgtcaaattaattgaacccaaagagggggttatgggaaccccaatttgaagccagtccatcagaagttctggaggcctggacttgagactggtgtctaaagtgggcaggcagtcttggggactaagccctcaacctacgggatctgaaactgtctcctggtaggtagcattggagttgtactggagggcactgagctggtgtctgctgcagaattgattgcttgcttgctggtggggagaacttcctacatattttggggtcaccgaagtcttttgtattgattgttgttgctgactgagaataggaaaaagcacgttgagtagtttttccacaccacagcattcttttaggctcctgcttttaccttctgcttccctcagcatcctgcatctcaccaggagagacacagcttctttgccattctcggcattccacttcggaatcaatcagaatagctcctattgctagaaacttgctttattaagttctgtttattcagggcttatctgaaagagaaacattttttatgatttgagatttctaagccattttaaaacttggttttaacagcttgagaaattgggggtatagtagggatggagatacatatatttggatgtgacttcaagctagataaaagtttggaaggaataaaagtttgacatctaaagtttttgcatagtttgagttgagcaggaggtactaggtatgtttttaaaatatttttttcagccaggcacggtgactcatacctgtaatcccagcactttgggaggccgagacaggcgatcacctgaggtcaggcgttcgagaccagtctggccaacatgaagaaaccccgtctctactaaaaatacaaaaattagctgggtgcggtgacacatgcctgtaatcccagctattcaggaggctgaggcaggagaattgcttgaacccaggaggcagaggttgcagtgagccgagatcacaccattgcactccagcctgggtgtctcaaaataataataataataaaaaaatgaaagattttttcttactcagcatcctccaggcattttattatctgagcactttatgggagttgcatattacatttagggcccactcaggtgggtgggtatctaagcatttgaaataaccttatgtaaactaataaggagtaatcaggcctgtggcaagatggaaacagtcttagaggcattcaaattcaaatttcctttaaaacactgggctggccaaaacaaaagacaatactatctacaggccagtttctaagattatcagattttagtagcatttaccatttcattgtacttggcacactttagcaaatttgcacttcttaaaagtacctgcaggcaatctcctatataaaaacacaatgcaggctagcttggctcctgcctttaattccagcactttgagaagttggagactagcgtggccaacgtggtgaaacctcatctccactaaaaatacaaaaattagccaggcatagcggcgcacgcctgtagtcccagttacttgggaggccgaggcagtagaatcacttgaacgctggagacagagcatggagtgagctgagattgcaccactgcactccatcctgggtgacagcgtgagactctgtctccaaacaaaacaaaacacacacacacacaatgtaacaacacgaaacagaatactgtgaaaatgcttaattatgtctgactttacatgatggctggatatgtgattattttttcttctttatgctcttatgtactttgttcatttttaatgatgatcatgtataaagctcctctgtgtagcattctctccaccaaattgcccagagacaggaagtcctgtaaaacaaactaagctccaaaaaatgacctcctgttgaataggcttttttttttttttttttttttttgaaatggagtctagctctgtctcccaggccctcgctccttccacctcctgggtttaagagattgtccttcctcagcctccagagtagattggattacaggtgcccgccatcacgcccagctaatttttgtatttttagtagagatggggtttcaccatgttgaccagactggtcttgaactcctgaccccaagtgatccgcccgcctggacctccccaagtgctgggattacaggtgtgagccaccacgcccagcctgaataggctttctaaccttctactgtttctcattttactttctctgaggcagtaaaagaaactgactctaaaagggagcagtagagaaggaactcagattttattttgaagattaagctactcaagggctgaggaaatatgtagaggggaagtagactcattatggctggaaattttatttggtgatagtgaagcaaatcttagggctttctaattgagctcttgtttgaaaggctccaatcttaatagaactataagctaaaaaaaatgaccatcagtgtttctaaagcaagttgctactcaaaacaagaacactttgggaggctggggctggtggatcacctgaggtcagaagatggagtccagcctcaacatggtgaaacccctctatactaaaaatacaaaaagtagccgggtgtggtggtgcacgcctatagtctcagccacctgggaggctggggcagaagaatcgcttgaacccgggaggtggaggttgcagtgagctgacattgtgccactgcatttcagcctgggtgacagagtgagactctgtctcaaaaacaaaacaaacagaaacaagaactctatgttgagaaatccatactagagggtttaatttctcactttgtgtgctagtgattaataaatttcaagcttatcacacagccagaaatgtcacctgtgtttctacaataaaagatttgggaatattgtgacattttttcactgagccttctgggttcattattaagatataacaattttagaagacttattgagataggtatactttttaaaatttggattcaatatatcaagctcagcattttgtcttttttttgttttgttttaaacaactttgggtttacttgtaagagtatttcagtggaggaaaagtatcagaagtttagcactgagtgcctgcctaactattttatgtcttctttcatgatgatgcttaatctcaacataatgactcagtttaccattgtaaactctttgtaggatgtcactgattttatcagtcatttgttcatgcagctgggaactgtggggatatatgatttgccacatctgaggaacaaactgggtgagctccattgaaaaatttctaactttcttattaaaagcaagcttcctcacttcctgatggcttatgcaaattaatgcctatttattcatcagagggtgactggagagattatggttttcttatgaatttcttgcttgagcctgcttgtctgctgtttctaagttgtctgcactattttatgtgagtaattttctactttattatgttctgttttcacatgtcaaatcagctctcccaagaatgctacttgtaacctaagtagacgtgaaccgaaaagggtaaagacccagctaaaaaaaaggttgactcaagttcagttcacattcgtaaagtagttaggctgccttaggttgcttattcttttcttgaaaagaatccctcaagagagaaacatgtgaggccacagcagcttagatctgtcttccacagagaaggtggcttttacagagaaattgacatactcatcacttatctgacatgacccagctttgtaaaactggcttctattaaaatagtcttaatagactattcactgaggaggagagaatcttattcactctttacattctcttcacattttcagaatagatgtttaaatcattgctcacactggatccataaatgtctaaaatgttgatgaagaaataggtgattagagagtaaaattaatagagacttacccttccttgcattttaacataatattctttccccttttccttcctctgttacttggctcttaaataccagaagtgagatatgaaaaagggaactggggacaagtattgaaagcaccataggtttatcttatattagcattttccaaactttataatgaaccagcagtgacccacacatctgccaggtaggaattgctcatcagttgtgtcgcgttatcttgttaagcttcagcaatgttccatacagccactaataacagatcaaagtgagcattagggttgaaattagtaagctgtttcttctcagttctttctggtagttgaataaatatagaatgtattaaatagttttctttatttcagaacttctcagagtctgtaatatattgtatggtggtagcttaggaggaagatgcaataggaaacttttcccagataggttcactattttttttttccacgaaaaataagctgttctcaaaatacagtttacaaaattttatccttaactcttcactctttctcctagttagggagaccgctccaccagtagaaaagataaaccctggtaatttgttgtgtaaatgggataaatagcctagtacctagtcatgtggattcaggcagcactgagcctaaattaaagtttgcaaggtatacatgttaatgtatctaagttactatatttagcctgtttcttaagtatgtttcagagtcatattcgtttttttcagtggcagttaccttcagatgcatgtgcttctaaagcatgttggttgcatgtgcagtacatgttgcttaagcatttagcttcagaatggcatctttcctgtgaatgtcttaacatttacaaaaaagtaccaggatctcaaatatcagtgctggtatttttttttttttttttacttaaagaaattgatatgattaaatattaagagacaatatgatccttgttggcttgtaaccctagtttttattgtcttgtagttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgatttttttctaagattgtcaggatttgaagtgtatgttttgttttattcacagcgtaaattttattcacagtttaactgtctgcctgagtgtctttcctttctctaattaccttgaggaacccaagagcctgttgtaaggagaaaataaggcccttggatctcttgagattcacagatataagttattgaagggaagatggtcctatggaggacatatttaaagaagggaaaaaagaggctttctcagatatgtcagactgctatagtatacttctacagattatagacctccagtacctctggccagaaagatggtatcgtaaacaccctattttttttcttttcttttttcattaggtacaagctttgtgctaagaagttgacatactataagctacaaaagttctgtaaagtagatataactagtttcattttatagatagagaaaattaatctcttacagtgctaagctcacagagtttctaactgtaaaatgctagaacttgtctttcaagcctaaagacttccttggggctaaatagtgaaaaaagccatttcacaaataagtaaatggtatttagaggcatatttggatttcctggtaaattccagtctgtgagcatcatgaatattagtttaatgttgcatgggctcatgttgaagttttaagagaagaactgccttgaagcttaggtttccttagctattaggctactgactttcttgcctaaaccagggttttttcattgaagaccaaaacttaccttctccttcagtttgtagtttggaaattggtagaagagctttgtaaacttcaaattaagtacaaactaagtgtcatagtcaaatttactaatcttaattacagtattgttcaactgattgctatcttctagctctttcctgccgaataatggtcttgtttcctgctctgttggtttagagctgacttctttcagctttggtaagcctgaaattatggggttatgtttaattcatattgtctgggtggactttcctctcttgcatttctgcttgaatagaagaatttttctctagagagtagtttgtcatccttactctgttgattcagatgactctttgtatgatctgagaggtatactgttctgctattctgagaagaagtatttcagaaagatgaattaagagtacagtggactgctcccacctggaaacttttatctatctcacctctggacctgataaattctttatcactcaggaccttgatgacgctgctctctgaaaccctccccagctctctctattaccgtgagaaacatcagaactttggttcccattgcatatcgcaggtacctctgctttcatgccatgctgtaatggagtgattgggtagcatgttttcatctctttccagattgaaaatctgtatttctccctgtatatcttcaacacctaatgcacatagaactttgtaggtacctggaaaatgcaccacagttttcttttctttttgcagacttttcacaagtattaccaacttacaaagaattaattttgtaggattctagaaagacaaatcaggaatggtgccatatacatcttttttgattccctgctctaaagaatattatcaggttaccttcctgcagagttttaaaagaattgcatatttcaagctgactttcaggatgtaaatataaccaaagcaactgatatgtaaaaaatatattcaatggcattcctagattttcttctagggtgttttattgttttgggttttacatttaagtctttaatccatcttgagttaatttttgtataggtataagaaaggggtccagttttaattttctgcgtatggctagccagttctcccagcaccatttattaaatagggaatcctttccctattgtttgtttttgtacggtttgtcaaagattagatggttgtagatgtgtggtcttatttctgagatcttcattctcttccactggtctatgtgtctgtttttgtaccatgcttttttggttactgtagccttgtagtatagtatgaaagatagcatgatgcctccaggtttgttctttttgcttaggattgtcttggctatacgagcttttttttggttctatatgaattttaaaatagtttcttctaattgtgtgaagaatgttaatggtagtttaatgggaatagcattgaatctgtgaattgctttgggcagtatggccattttcatgatattgattcttcctatccatgagcatgtaacgtttttcccttcgtttgtgtcctctctcatttccttgagtagtggtttgtagttctccttgaagagatccttcacttcttctgtattcctagatattttattctctctgtagctattgggaatgggagttcattcatgattttgctctctgcttgccttttgttggtgtatagggatcctggtgacttctgcacattgattttgtatcctgagactttaccgaagttgcttatcagcttaagaagcttttgggctgagatgatggggttttctagatataggatcatgttatcttcaaacaaagacaatttgacttcctctcttcctatttgagtacgctttatttctttctcttgcctgattgccctggccagaactcccaatactatattgaataagaatggtgagagagggcatccttgtcttgtgccagttttcacggggaatgcttccagcttttgcccattcagtatgatattatctgtgggtttctcataaaaagctcttattatttgagatacgttccttcaatacctagtttattgagagtttttaacctgaagcgatgttgaattgtatcgaaggccttttctgtgtctattgagataatcatgtggtttttgtctttagttctgtttatgtgatgaatgacgtttattgatttgcatatgttgaaccggccttgcatcctggggatgaagccaacttgactgtggtagataagcttttggatgtgctgctggatttggtttatcagtatttcattgagattttttgcgtcgaagttcatcagggatattggactgaagttttctttttgttgccgtatctctgccaggttttggtatcaggatgatgctggcctcataaaatgagttagggaggagtccctccttttcaattgtttggaatagtttcagaagaaagggtatcagctcctctttgtacctctggtagaattcaactgtaaatccatctggtcctggactttttttcattagtaggctatttattactgcctcactttcataacttgttattgatctattcagggatccaacttcttcctgattcagtcttgggagtgtgtatgcatccaggaatttatccatttcttctagattttctagtttctttgcatagaggtgtttgtagtattcgctgatggttgtttgtacttctgtgagatcagtggtggtatcctgtttatcattttttattgtgtctgtttgattcttctcttatttttgacaaagctgacaaaaagaagcaatagggaaaggactctctattcaattaatcctactgtatatctggctagccatatgcagaaaattgaaactgttcctgtttcttaatccatatacgaaaatcaacttacgatggattaaagacttaaatgtaaaacccaaaattataaaaccctggaatagaatataggcaatatcattctggacataggaatgggcaaagattttatgagaaagacaccaaaagcaattacaacaaaagcaaaaattggcaaatgagatctaattaaactaaagagctctgcacagcaaaagaaactactgtcagagtgaacaggcaaccaacagaatgggagaaaattttttcaatctatccatatgacaaaggtctaacatccagaatctacaaggaacttaacaaatttacaagaaaaaaggagccccattaaaaagttggcaaagaacatgaacagacacttcccagaagatattcatgtggccaataaacatgaagaaaagctcaacatcactgaccattagagacgtgcatatcaaaatcacaatgagataccatctcatgtcacaatggtgattattaaaaagtcaaacaacatactagtgaggttgtagagaaataagaacgcttttacactgttggtgggaatgtcaactaattcaaccactgtggaagacagtgtggtgattcctcaaggatttagaaccagaaatatcattactgcatatagacccaaaggaatagaaatcattctattacaaagatacatgcacatgtatgtttattacagcactattcacaatagcaaagacatggaatcaacccaaatgctcatcagtgatagactggaaaaagagaatgtggaacataaacaccatggaatactatgcagcaataaaaaggaatgagatcctgtccttttcagggacatggatggagttggaagctgttatcctcagcaaactaatgcaggaacagaaaaccaaccaccacatgttctcacttataagtgggagctgaacaatagaacacatgggcacagggaggggaataacacacactggggccagtcagggggtggggggtcaagctgagggagagcattagaaaaaatagctaatgcattctgggcttaacccatttatgcctagtgttccatttctggaatgctaagcatgtggaagttctttatatcctgctcaaggtcattgccaaggtctgatttttcacattcaacaaattgcaacctctggcataaatgggttaatacctaggtgatgagttgataggtgcaggaaaccaccatggcacatgtttatctatgtaagaaacctgcacatcctacacatgtaccctggaacttaaaaaatttaaaatatatatgtatatatatttaatatggaattttaaaaattactaatgagttcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgttatgtaatatgtcatgtggtattgttttattgatgtgttctttgaagtgttacctttgtgtccttagaggctatggtgggccctcaggccatatatgttggatgatttagtggaaaagagattagacttttatattttattctatttatttatttatgttttaatcttgtgtaagcctatagaggccaagatagggctcagagttaaaaacagtgatgttctaactttcaaaactactaaaaacaaaattagctatcaagggaaatcctgagtgttctgactgcaggggttccccaaagcctggaggaccgaagctttgaaatgctgcatggtgtgcctcacctctgttgagtatagtgaggaacatgagctgaggagtggattagatgaactcttaagatttttttccaactttacggtttgagtttatgagtaagtaagtgaggaatgagcccagggactttgactactttgctgtgcagtaaattgctgttttcttagctaattctggagtgtgtattttggttttaatgtaatgtcctttcagcactggaaataaacagatttatgaccctccattttcacatgtaaacttccagttccttcagtaaaatgctggaagttgcttggctgtaaccactgtaactatttcctggcagttttgcattttattacaattcgactttttaaatgcatggttcagtccagttaataggcagaaaactatagctattccttggaactgacatagggaagttggtttctttctgaggaaagatgtgacactctgatggatttggcaaaataccaattcagtaaaatttgcctggttcctttctgacagcaaatggaggtaattgtacgtatatagatttctacagtaaacaaagggcaaaaatggaaacattttttgttttttaatgttgctggaatataatatttccatatttggttaatcatcaaatcattcaactccatgcaaagtactcttttcaaaattacaaatcatcttgatggattagacttggatgtctaaattttttattatgtattctaaattatctataggtacattttgaaaattatatatacatgtatcactgtactacatttgttataaaatgtgaaatattaagcgattaaatactttattaatgtcataaaattgtgccctacccaaaatatattttaagaagatatcatttgaaaataatgtaaaatattcttcattattatgattttgttgccaaaagtaatgttagagtccctgttactgataattttcatgactgtaaattttcaacatttggaaacaaaattttctgatgtgttttaaaatcttaaagaatttcagtagattttgacacatttttgttaaaagtatgaaagtgtcacagctttagaaggatttagaataattatcaattggtattagggatgacaattttaatagacaaattttaactgaaacatttgctttattgatgtctaggactaaaaaaaatattatagtgatggaaccatttcaaaacatctgtttttaaaaacttctgtcaacatgtttgacagaagtcagaatagggtaattataaaaaaactgccattttcttatgtttgcatcattagtatttgcaaatccttgtttctttgcaagtatattttaaactacttgttcattttatgagtgttagcctgattaattcagataagatgctcaagtcagtttaagcaggcagatgtgaaaaagggaatatgctgtgccttaactatcttatagggacttactagcacactgtacataacagatgaacatctgatattagatctgatgggcacaccaatgttgtttcatatattaaataatagtggaagttttcaatttaattagtttatttatttatttatttatttttgagccggtgtttccctctttttgccaaggctggggtgcaatggcacatggttgcagctcactgcaatctccacctcccaggttcaaaggattcttctgcctcatcctcccaagtagctgggattacaggcgtgtgccactatgccaggctaatttttgtattattagtagagacaaggtttcaccatgttggtgaggctgctctcaaaatcccgacttcaggtgatccacccgcctcagcctcctaaagtgttgggattacaggcatgagccactgcgcctggccaattgtatttttatgttagaaatatatatgggagttacaatactttgtttccaatgttccgctggaaaccactggttgaaaggataggtcccagtgtcagctgcccagttggcagttttggatagaatataagttctatgaaggcatggatgaagtatccttcatggtaatgatggtaatgttagtatagtcacttgtttaatgttgtataactttttaactcttccaacttcaatttcatctatatctttcatagcagtccagtaaagtagtatcaattatagatatcattcctactttcagataaagtaactgaggctcactagttttgacttgctcaaggttacgtaaatgataagtgacagactggatttaaagggcggagtccactttactaaactgcctctgtcttctagccaagtttgttatgtaaagtaagtattcagacattggctaagtatattattaatcaagaaaacagtagaacaggtttaaggaatttttttttccctctcctcagtgtcaaaaagcagtcaagtaaaagatccaagataaataacttcagttcccaaaaataacttcaattccaaaatttccctatgactaggtatatctaattggatagctgataaaatgagtgggaaattgaagaagggatattttgagaatgtgtggcaacttaatggtaatattgaagaagcaaatggatagttattgaatcataatagttttttaaacttaaatactagggcttgatcttcatattttaggaaattatctatttgttgcagtagaaattagcataaatgaatggaaacttaaattatctcatctgtgcaaggcagtcttcagagactgatgtttatataagtgaaaactcagaaaaattttttggctgcatttcaagctggatagcggggtcaaaacttcaacttcttaattggtgatacaacgtcagaaatcacaaaagaagtatttcacaggaaaaaatgacataccccgaaaacattcaaatcaagaaaatcacaggggtacagtggatggtcccccttaaggtactgcgtacttggcttccccgctggtaaatgcctctcttttactaagttgttgtcgtgcagagtggcattgcagctctgtacttttacagaataatttcaggttctaaaattgatacattatttcagattgtaagaatagtataaaataaaattttaaaagggaaaataattccatcaatttaatggaatgtgtagggtttaagttataacaacaaaaacaaagttgtagttttttaggattactcatataaatagtgtgtctattaagaattactggctttatgaatattaaataagaaggctggccgtggtggatcatgcctgtaatcccagcactttgggaggccgaggcagacggatcacctgaggtcaggagttcaagaccagcctggccaacatggcgaaaccctgtctctactaaaaatacaaaaattagccgggcgtggtgacgcatgcctgtaatcccagctactcaggcggctgaggcaggagaattgcttgaacccggaagacggaggttgcagtgagctgagatcgcgccactgcactccagcctgggtgacagaacaagactccatcttgaaaaaaaaaaaaaattaagacaaccacagatataaggatttgcaattagaaagcttgaagggaaatttttggaacttctaggtcaacctaaaattacaaatagggaagcagctttggagaggaacatttgcacttctgaagtaatactgtgatttggactgtcagacattgtgatatattggcatcaccacacctctgttaattataaacttacctattctcagtgccttgttaactgttgaaataggacttgacatttgttgttcttcctcttctgttattcatttattcactcatttagtagttaattacttcctagtgccagatagttttctaggtactgaataaacaaaaatcctattgtcatagttatgtttttgtggaaagaacaacctgatagactatcgtgaaaaataaatgagttagtatacataaaacacagcccatgagatatagtctgtaattatcatccctgcttcatttatttatttatttatttatttatttatttatttagagaatggatctgattctgtcatccaggccggagttcagtggctggatcattgctcactgtaacctcaaaacacctggcctcaagtgattcccccaacctcggcgttccaaagtgctgggattaaaggcatgagccactgtacctggccattgctcctgttttaaagatgaggaaactgaaagtacagagaggaacgtgacttgctcaggatcacacagccaatcagtggcagagcagtctaggcagtctaggcctgaaggcattattctttctttctgttctgcgtcaaaaaccctaggcaggcatggtaaaaagactgaaagagccaaggcaacataggtacctgaagaatgggagaacacctatgaggactgctagaaattttaggcagccctttaaaggccttgggcaacaatttgaacgtgactcatgagtcagttaattctctgcacctttttttttttagagaatacaatggataaagcaatgacctttgtaacatgtaaacctgtatttgaatcctttcctctccatttaattttgcagagtcaccttttcttcattagaaagaaattttatcccaaagagattatcgtgaggctcaaataatataggtggaagccctttgggtttaaaaaaaagccttttctgtcatttctgggtatctcccgtcagtgattttagtaattgtttacctctctggctcttcgtgagaagacaaattgtaggaagaagtggaggatggcattgggtaggatgcttagttctagttccaccacttccttaggtcttttttttgtcccccaagactatatcatttctgtgttctcttgaacctgtaagatttatgagtaatctgtacaatatttataaagtatgaaatctctgccattgtggcacaaaagtagccatagacaatgtataaatgaatgggcatgctgttctccagtaaaactatatttatagaaataggcagtcttctccaattttagtttgctcacccctttcctatagaactcaggtttatcatatacaatgttacacattattcctttgaataaattgtttacctaatactttttaaatttgggcattttctaggacattctattgtttttatttttaacttgtgttatactgcagtgaatgtcttcctgtgtgtagcattttgtttgtgtatgtgtgtcaatatctataaagtagctcttaagaactctggaaacattgtcagactgcttcctcaaacagcagaggtgggagggagcatcggcctaaccctacctggcctgccttaccagcatgcaaccaaggagaagagaataggatcaagagccagtgccagagagaagtacataatacaactttatggagtttaggttgcatcctataaagttaccatgttacactgtttcgatctaccaaagtagaagttttacatagtttagtatgaagttaattttattaaccttttcacacaacacaccctctcatattgctgcccaacaatgtcctgggtctttgtttccatggtcatcatattgagtagggttttagcagggacttgagtagttgggaactgaactcatgctagtgaagccattcttcactagaagcagacatatgggatccagaatatcatgaacaaccagctgggtacagtggctcacacctgtaatcccagcactttgggaggctgaaggaagcagatcacctcaggtcaggagtttgagaccagcctggccaacatggtgaaaccctatctctactaaaaatacaaaaattagccaggcctggtagcacatgcctgtagtcgcagctacttgggaggctgaggcaggagaatcgcttgaacctgggaggcggaggttgcagtgagccgacatctcgccagtgtactccagcctgggcaacagagtgagactctgtctgaaaaaaagagaatatcatgaatatcaccaaagataaaagcaagatgcggatatgagtagcccagagtaacttttcctgtgctatataacacagtgagtggtgattcccacaattcaagtccagtttttctggattctaaagccatacatttttaactctccccctaaatatgatttgaattcagagagtcagatgcaataaggtaattttaactttaagtgtagtttagcccacacatttctctaaactgggggttggcaaactacaaacctctttttgtaagtaaagttttattggaacacagcctagctcattcatttatgtattccctttgcaccttttaggttgagtagttgtgactgaggtcttccagccttcaagcctaaaatatttactatctagtccttcaaaaagaagtttgccaacctctgcaaacaagtgaaataatgtgtattagagtagagcaggagtccacaaactacaacctctggagccaaaaccaccctactgtctgtttttgtaaacagaaattttatagaaacatagttgacccctgtgccaatttgtttgagtcttgcttttgatggcttttgtgctacaagggcagagttgaacagttgcaagagaactaagtggcctgcaaagcctagtggtctttgctgtctggccattataggaagtgtttaccaaaccctgcatttgatcatggaatcccagaatgtttatacctttgaggatttttttttctactttccatattttacaggcaacagaactaaagcctcgtaaaatcttgcccaaggttctacaaatagtcttttctattaaattaagtcagagcctgaaattgtctgtgcccaagtctctcctcagaaatttagcacagcattttccctttctgtctcccacatgctacacagtcatcctggatcatgtgccccgcctccatgaggagatgttctaacatgagggtgactaggctctggagccagagcatcttagttcaaatcctggatctgttaaaaataatagttatttttcagttctaacactgaaataagacaaaaggccatattactgaaataaagtgtaaagaatatatttaatactcaggttactttagccccctcatgatcagaatatgctaataaattgagagattgacagaaaaaaaggattctgtttcactgtggctcacacctgtaatcccatcactttgggaggccgaggtgggtggatcacttgtctggagttcaagaccagcctggccaacatggcaaaaccccgtctctactaaacaatacaaaaattagccaggcgtggtggtaagcacctttaatcccagctactcgggaggttgaggcaagagaatcgcttgaacctgggaggtgcaagttgcagtgagccaagatcacaccactgcactccagcctgggcaacacagcaagactccatccctggaaaaaaaaagttcatcatttgttcttgtagtttcctagtgtggcccttgtctcagtggaaaattgtagtgtgatagactgaggagaattctgtttctgccacttcgcctgttgccttggtaggagctccttatctctgagctgagctccttttgtccttggtaaaatgtggttattatcatctgcatcctcatagtcttcttgtaaggactgtgaagtcacttttgaaaaatgccttgaatatgccagatggtctgttttctttcttttttgttttgttttgttttgttttcccttggccttcattcctggaagtgttttgttatatacattttgtttggtggccaacagtgctaaccacagaaaagtttgtatgtcttctttttctagaataattcttacagtgtaacctctcagggtgaagtttttgttttgaaaggggcacatttactgtgaatgagagccatggaaatggacctgaaatttgaagacagattttacttggttttcttttctcttatttgtttgcagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtgagttgctacaaatgagacatacgtttagttttgttttatagtatatatgaatatgtgtgtacatttttggaattttagtttgattatacaaaatatctttggcttagaaatattaggcatgctatgtaaaaccttactggaaaaataaattgaccaacattattgagagtattttttcaaagtgttccaaaagtaatggaccaatgattactttaaatgaaatcatgtaatggaccacagaattgcaaattactaataaagaaaagccattttgcttattgccatgtaataacatgttgcatgatacaagtagatacgtatgtttatgctgcaacaagtataggtgatactaattgggcaacttttaaacaagaccataaataactgaaatcaaagttcttagtatttatgcagcctgttggtttgcgagggctgccataacaaagtaccacagactgggtggcttaaggaaggttgttttttcacagttttggaggctagaagtccaagattgaggtgttgtcaggtttggtttcttccaaggccacactccttggcttgcagatgtctgcttgcttactgggctcctaaacagtcttttctgattgtcctaatgtcctcttcttataagggcatcagtcatattggattggggcccacccatatgacctaattttaccttaatgacctctttaaagctctgtctccaaatacagtcatatggctgtgatacagggggttagaatttcaacgtatgaattttgagggggacacaattcagactataaactgcagttaatgtttactgttaaattaaatctataactgactaaaccacacaaacaggagatttcaaattagactttattagttttggaaggaagagatgaaatgttgttactttttctgttttatgtagttgtaaaagccactaaaaatgtacatgtacaaatcatcccaagccaggcaacattagtaatgaatgactgcagcacagaggtaagagagatgatttaaaggaggatgaattgtctgcaaaggtgctgggcaagatctagactaattcatccccttcattttaagtttaggttttaaatagctttgtttggcttgatcctagagctacacatttacttttaacttgtttactttgtaccctatcatttaggatatgctatgtactattgtactctatttgatatttcaaacattctctcatttagtgaagaagctcccaaccggagtgctcagaacctacattgcctcacctgtgaagtgagcatgtgggactgaattgcctttgaggtctctttcagctcttaatgatctgttatcccatagtaagatacattatttttaatctcgttggatcttaaacaccaaaaataatagtatttaagacgtaggatgctatcttgtcattattttaatgcacatgtcaacacacgaggttttgctagatgttatgataaagcaagcgaaacagagcaggctactgctcctcaaatatctacagtcaatgaaatattgactggcgttgtgggaaaatatctcaaaagtattttatttacaatttaaaatatattcttttgcctaaagaaacaatgaaacaactataacttgtttttgttattgtgttagtgtagtcatacatatgatacagttttataatctgcttgataagggtacgtctctgggtttttcacactttgcaacaagtgggaaagaacttcgacaaaaacattaaaacattatcaacctggttgcacgtttttctgattattttcagtgctcttaggtttttagaccatatcaaaattctctctctacacacatgatttataagggaaagaaaagtttgcagtatgcctaaaatgttcctcaggttaattatatcttgttttgcatagttgaatgtttatggaagtcttagatagtgagtcactctgaaaccacagactcttttttaatagtaataatatggtgagttctataattcctagcatctagcacacaggtatgataaatgttttaattaagtgaataatcagcttcctgaatttttctactttgtaaatatgctctttgtgtgttgaatctatttacatatatatccaagcatttggcacaaggtaaaccaatgtggctcagattttaatgttattgtgaatcacttggggatcttgtttaaaaaaaaaaaaaaaaaggagattctgattcaggtgatctgggctgagtacttacagtatgcatttctaataaacttctgggtgttgctactgatattggttcaagaactaaattctgagtaacaagtataaaccgaatgtccataaagtataatttcttttagtatcatatggttataatgcttgcattttgtatatatgttgcatacaggttttgcttttctcttttttcttattaaaaaggttataaaggtacactgtagaaactgtagggagtaggggaaagcttggcatctcatgccaccattcagaggtaaccatgtttggcattttaaaaatgcatttatagtgtgtgtgtgtgtgtgtgtgtgtgtgtgtgtgtgcgcgcatacatatatatgtatgtattatacatatacgttaatatacatataatatacatatattactgtgcaaaagttgataaattgattatgattatgtataaactttgatatcttctcatatttaatataatatagttgtgagcactcttccatatcattaaataactttctagacattttaaatgaatatatagaaaatgaaacatcattaatcagtcccttatcttagaatatttatttcggttatttacaatctattagtagtttaaaagtacttcatggaaaatccttatacatgcatcttagttaacttgaacttttatttttagagaagacatgccaggctgttctaggctattgatacatattgccaattaccttcctgaaagattgtaccactttccacttaggcacagagtgtgaatgcctgttttaattactctatttacatcagtaaagactatatctgaaattatctcatttttggggacaggtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggtaatcaagcacacattttatcattaataaaaatatgaatgctgaataccatcctccctcctaagcagtcctaccagtgttgctcgccattttattggtcatcccagttgtaactttttatgtgatctgttaacgatctttatctcctattgatacatattctgtcactctccaagtcctatttatgagtttttctttcacatgtctgttgtttccattgccccctttccattttctacactctggcatgcagctttgtcctgtttcccccatgctatggattagcctcctgccggtaaccacctgaggggttcttcctgcctgctgcataaagaaaaaccatggcaatatagtagagaaagagcttaagagacactaggctggccatgccacgtgggggatggagttcatattcaaattatcttgtccaaagctcataggtaggggtttttcaaaggcagcttgggggaaggggtgggggtggccaggtaacagatgcttgctgctgattggttggggtgggtgaaatcacagggagttgaagctgtcctcctgtgggctgaattgcttctaggtggggccataggagtggggttgctgggtccaggtagaaccacgggtgtcagacatgcaaaaataaaataaaataaaataagataaggtaagataaaataaaataaaataaaataataaataaaataaatataaaatttccctgaaaagatatttcaaaaagccagtcttagattctacaataatgatgttatttgctggagtaattgatggagttgcatgtcttataacctctggaataacggctgacaatctctcaagtctgcgccttagctggactcaggttcctcttctccccacagcctgactgcctccattagcttcacaaaagtggttgggtttcagggcaaggcccattgtcatttaaactgtagccgaaatgacttccaaagttagcttggcccaatagcccaggaatatttaagtggaaggcaagatgggggatgggttagcttagctctctttcactctcatagttttctcactggtataatttttgcaaaggcggtttcatgcctgccatctctttcgtcgctacctctcccagttcccattcttagctgttttatgaaatgcttctagtttcatcctcttataccaagttctgggagactgatttgagtaataataaaactccagtttcccatacagccggctctgcgtgaattaaactcattttctattgcaatttccctgtcttgataatcagttctgtgtaggccgtgaggaaggagaacccgttgggtgattacgagactgtgttactgcccactacctaatggatacatttagcctggtatccaaacccatctaattatgaccataactatatttatcaccttgctctgctttcaaacgatatgacacacaatgaatgaaaactttcatttttcatcttcatttgtgctgttccctttgcctcaaatagccctcaacttgcctacagtaactgtaaaatttgccacctaaaaaaaaatctcaaaatcctctctatgctttgatgtccagcaaaaaaaaaaaaaaaaaaaaaaaagttatcagtatagctctattactctcaaccagaggtggcatttttcatctttacccataagccccatggtatatttcttagtttgggaaattatatcataatactttgaatctgtctagtcagaaatttagataatttaaaaaaaaattatttttctgaaagtatagctggatctagcttaggatctacatctatctaatatagttccttaacatttgttaaatggccacggataagtcctgtaatgccatactttgctttaggatcatgtgactaaggggtaaggaattggaaagcaatggggagctagcagaatttgaaaaattatataggtaggttatttttccttaatacattgaaatagcctcaaattctcagagaatacaatgtttaatcctctaatatctgtagagttcatggctcaaatttgtattatttgaataaactactaatagattaataattactcaactaaaacactttgaaatgtgagagttcccttatctccctcgcaggcatatgacagaggtgtggcttctcacacctttggttgcccttgccctaccacccaaacccctagggggagcatgcagaggggcaggtgcagaggccatggggggtgcttttgggctctggccccacagcagtgtctaggagtggatgttggagactcctgaagcccaagtgggcatgtgttacagtgtgctctttcagcttagccgtctgcagatggcttgtgttaatcaggtcattagaccccatgccttattgcaagggcaggggtccaatgtgacagcctaagttcttgctcagtgtaccagaagaattggatcacacgtgggctggaaggatgagcacaaggttttattgagtggtggaggtggctctccgcgagacgactctcagccagagaaggaggatggaggggaaaggtgttcttcccctggagtccacttgttcctgttctcctctgggttcaaatacctcttccctccttttctgctgtgctgtcccaccactctccacagctctgtgccgctctgttcctctgctcctctggatgttcagctccttgtatctgtgcctgctaagattttgggtttatatgggggaaggatggggggcatggcgggccaaaaggcaccttttttggtgtgaaaacagaaatgcctgtcttctcttagggccttaggtcttcaggcttgagggtggggcctttgctgagggaccaccctcttctacccagtatttccctgtctcctgtccatatcaacattactaactttttcatctgcagactaataatgctaaggtgtggcatttttcaactgtgagactatgtgaaggtttttcctgtccaactgatggcatcctcccataattctacccctttcttaaaagaatcttttgcagtatttctccaagtttattctagagaatttcttgtctgtgaaatgctctagttaatcaaaattggaaaacggagcatatcatatccccttctcaaattcaccaaagtgaagtcctaatgtgtcttaatgtatctgcatgagacaggaagctgagatctattcaacaacaaaaatccaaacaagcatcaagaggaggagtgttagcacttgagcctagggagactgtggctcctgcctgaaagatgggagcctcagtcacagctgctttaccaagtgtcatatgctatgtttctgaggactcctgctaaagctcccttctccctccagccaaccacttttgttttagacaagggctgggtttatgaaggactgttttcatgactaaagctttatagaaggtttaagataaggagatggaattgagtgaagtaggaaatatgaaagcagatattataatctggcttcctgatttttcactagcatttttgtttataaattagttctgttctaagaatccaatgacgtaatagaaactctcaaagattcttaacttgagatatagggagtctttgaaactgctgaaattacagacagcatttattgtttatgagcatttctgaatctagagctttcactagatttgtaaagaatgtgggccaaaagattaagagccaatcctgtatcttgtactcaaaatgtttgtaattctcacctttttatcccccagactcctcttgctctctcttcattttcacagtgttactggaaaggggtcctgatccagaccccaagagagggctcttggatcttgtgcaagaaagaatttagggcgagtcctcaatgcaaagtgaaagcaagtttattaagaaagtaaaggaataaaagaatggctactccatagacagagcagccctgagggcagctggttgtccatttttatggttatttcttgattgtatgctaaacaagggatggattattcatgcctcccctttttagaccatagagggtaacttcctgacattgtcatggcattcttttttttttttgacagagtctcactgtgttgtccaggctggagtgcggtaaagcaatcttggctcactgcaacctctgcctcctgggtttaaatgattctcctgcctcagcctcccaagtagctgggattacaggcatgacccaccatgcccagccaatttttgtatttttagttgaaacagggttttgccatgttggccaggctggtcttgaactcctgacttcaggtgatctgcctaccttggcctcccaaagtgctgcaattacagatgtgagccaccaaacctggcctgtcatggcattcttaaactgtcatggtgctggtgggagtgtagcagtgaggaagaccagaggtcactctcatcgccatcttggttttggtgggttttagctggcttctttactgcagcctgtctgttctatcagcaaggtctttatgacctgaatcttgtgctgacctcctatctcattctatgacttagaatgccttaactgtctgggaatgcagcccagtaggtctcagcctcatcttacccagctcctattcaagatggagttgctctgggtcaaacacctttgacaacatcattaagcctcagttctcacactgtttttgttttgtttgtgtgtgcaatgatgggcaaatctctgccttataggatggtagaaaaaaggaacttaatattgtaatgactgttttgtgccagataattgctttaaactgtatcagcatcttatttagtcctgttaatgatatgaatgttatcttcataacagctgccattttattaaggacttatcagagaaaaacactgttctaagcacttgttacccattattacattgaattttcataacaaccctttgaggtaagcatgattatacccactttaatagaagtgaactgtagttttgtaatgttaggttccttgccaaatgttacacagatagtaagtgataaaatcatatgccctgaaattacattatgctgccaaacttaaatttcttttttatcctttatattagtatattcttaggtttaaacaagacaactagttaacacatactagattttgtccacagttcctggctcataactcccatagcccttgtcactatcttttaacgttggggcacattaggcctcagaagtaggcctcagaaaacagagtctctctctctctctctctctgatcttcttccgccctcctctcacctgcccagggcagcactctaatcttctcctgcctttctgatcttgggtcataagaccttcatttccaaagatgtcctgtgtcataccctaaaggaaggaacactgaacagagagaggctcagaagaatctggacaggccttgctgtgtttacatcattccctttatgtccagtcacatctctacatggttgtcagttgtgcctatttgatgaagtccccatataaggctcacaaggacagggtgcagagagcttccagatagctgaacaagtggaagttcctggagggtggcgtgttcagggagggcatggaagctgtgtgccccttcccccataccttgccctactcatttcttcatctgtttcatttgtagtatcttttataataaaccactaaacattagttagtatttctctgagttctgtgagtcactctagcaaattaattgaacccaaggagggtgtcataggatccccacattatagctggttggccagaagcacaggtaaacaacctagggctttcaattggcatgagaagtagggggcagttttgtgggacggagccctcagcctgtgagatctgatgccatctctaagtacacagtgtcaaaactggattggaggacacccagctagtattcactgtgaaattggttgcttgcttgatttgtggggaaaaacccacatgcatttgatcacagaagtcttttgtgttgacagttgatagtgttcagtgagagaattaaaaaaaaattgagtttcttcttcaacatactctctcaatgtgaaaccacagaaactatttccattcaaagatggaaatggtttgtttgcatcttagtttttatttatacatcttagaagaaatgtccaagctttgttttttctctcaccctatatataaaattacctatgaggcacagatttttatgatccttgattatatagactttgtccaaattgtgtgttttatagcattactgtaacttgttatagtaatctttgtgtatattatgtctcttaacattgtcttccatattgttaatgaccatctcatatttatctctgtatcatgtatatcttcaaccaatgtgactggcttaggagaaaaaattagtgaacaattaactagtgtttgtgtaatctatacaattgtcaaggttacaattgctatttttgaagaaatcgttgttgtttttctctttgtttcatctcagttccattttgtcatgtattcttttttttttttttttttttttttgaggcggagtcttgctctgtcacccgggctggagtgcagtggtgcaatctcggctcactgcaagctccacctcctgggttcatgccattctcctgcctcagcctcccgagtagctgggactacaggcacccgccaccacgcccagctaatttttttttgtatttttagtagggacggggtttcactgtgttagccaggatggtctcaatctcctgacctcgtgatccgcccgcctcggcctcccaatgctgggattacaggcgtgagccaccgcgcctggccccttgtcatgtattcttaacctgtgttatatctaagagaagctgtgagagacgggaccatttgtggataggtgcagagggcatgaagtagcccagaaagaatctttgccattgactaaattttagcctagtaaaaaacatctggtaaccactgaaaaactagaacagtgtgatatgacaatgcccagttgaataagaaattcaaatagtttatagtaacaaaaaataatttttaccacattgtgactagtgccctaaaaacaaatttgaaggagcagagagagagaggaagtgagttttcgctgggggctggtgagtggaggctactttatgagcagttttgaaaattacaagttagggaaaaactcttaggggagttttaagtggtgagcaacaggcacttgaggttacaggagcagcagcataaagatatagaacagagaggccatttggcagtcttggggaaactccaagaagtcgaatgtgtctaaagctgtggttctctctctgtgtgtgtgtgtgtgtgtgtgtgtgcgcgcgtgtgtttgtgtgtgtgtgcatgtgtatgtatgtgtgaaatcgctaatacagagaagctgttagaacaattttctcacttcccaaaaatgtccgttcattcatgggcctaggcaactctcctttgtgtgtcttacagcccaacactgtcatataaggtgtggttctataatgaaacagttttatctgttgtttacggagctagtcagcctgtgttatgcttgttactggttgagggtgtccaggttcttggcttcttgaacaaagaattggacaaaactcacaaatgaggcaaggaaagaatgaagcaacaaaagcggagatttattgaaaatgaaagcacactccacaggatgggagtgggcctaagtaaatgattcaaggccctggttacagaattttctggggtttcaataccgtctagaggtttcccattggttacctggtgtatgccttatgtaaatgaagagggtggagttaagttacaaagtcatttactcagtataggccttgtgttaatggagagggtgttactcctgggggttgtggcccatgtaaacggagaggatgaagtgaagtgacaaagcccttcgcattcctgccattgctgaagtgtttccactttatttagttctaggaagtcagtgtgaattggccttatgttccctgcctccagaacctgttctcctgcctcacatagacccttttttccctttgccaacttcacttcttttacagccacctcactaccaatgtgtctgtctcctaagtcaaacatcagtgattcctctgttttctctaaacccttcttatgtcttctacttctcatctctttcttggtcaaaaatctttcaaaaatgagtaagaatgcagctattcaggcaaactaaaaataacatcacagtgatatacaaaaccagtgtcatttcacaaaggaaaattatcaatactagatcctgaaaaagaaacagcgaatgaaagccatttacacaactccattgtgtaattgacacattgaatcactcataaaacaggtgctctgggtctgaatctagatcctagctagtctggtagctgaaatcatagaattatagtagagtttaggaaatcatcctcaaaggaaagattatatgttgatatcaaatgtatatttcctttctaggcccaaacctgcaccactgactgctgaaatacagcaaaagattttgcatttgccaacatcttgggactggagaaatgttcatggtatcaattttgtcagtcctgttcgaaaccaaggtaaaaaaataagcctaagttttttgttaatttgttcggaactatttattgaacagttgctctgtgtgatggatttcggggatacctagatggaatgggcatgatcccctttttacagaaatagaaaataggtggcctatgaattattctttccttttatatccatgacaaactttggtaaaaaattttcttttctactgagcttagcatttattcagtactcttctcaatatattttccaggtagctagtgacaatcagagtgatatgtaagacaaactcatttgtcctcctagtaggaaagattctagtagaagcaaagaattgtgtaccattctgcaagtggtttgttggaatctttctttgatacctgttcctgtattcccccacccccattaatttagtcattaattactacatgaacccgtaaaataaatccttaaattattttcctggtagattttttgagctgtgtaaggacctttcaattcactttacattagaatacgatatgtgatggtaagtattaacccagcttcctgagtgatggcgtgagggcggaacccaggttcatgaaaagtattcctattattgaattttaccagttattttcagaagtttgatacaatgtgagttgatttcataacatgtcctctaactgcacttgatagcaaattatcttgttatcctgagttgtagccaacaatgacttggagaatctatgcaatactcagttttattacttctaagctcattttgaagataatactacccatggctgatttgttactataaaataggtttagtatttgctgtctggaaacattctgattagtgtctcctgggaggattataaatttatagtacccaaagataaactgttgtttccctttcctaaacttttagtgataatcagtctctgccgtgtctcattttcatcacttgccctccaagctcccatctcactgaattcttgcagtgttctgaatgttgagagccccaagtgggtcttataacagccagtcagcaacatttctgtttttcatctgacaccaagggtctcgtctctttgcttttctaccagttattctgggctcttcagctctaaagaaagtataggtcctgaaatctttccctaccttctcaatttcctggggagggcttctttggaaagtgggattggaaataagataaatttgaagataattgagaaatgaatggaaagtgaaattgaagggtccatgttaagagattgcaagttatgctatcaccaaatagattttttgtgcctgagaggattaattcatagtgcatattatgtgttgactttatcattgaggtcctggcacatgatagcattggcatgatataatttgagctactgatactatagtgttgcttctggtgttgttaccagaacatctaaaatatattaggatttttttaatggcagaggaaatgaagactaatatgacatagtccttgtcctagtgatttacagtttagcaagacatacaagcaaaacattaaagtaaagcatgataactactttaataaagcattttttaaattcattggtaacataagagaaggtagaagagtttagcaaacccttcccaaaagaaatgattgacaagttatatgagataataattcagggaaaggaaattcgactttctaaagccaaattatttgacattggttttcatatagcttggtaaaagctgttattttctcccatgttctttattctttgactgttataagtatgatttgtacagagaaatggcaatttcaaaacagagggctttgatggattaattgctttgaattgatccctcatctacagtatcttgtcaggtacttgagaaaataatgtacttaaagtttcctcttttgactttcttttggtattctatactgtaagttggggaaaaaagtattttctcttcctgctaattgggctacttgaaaattcccaccaactttgccaataccagtgttctgtataacccagaattcagaattagctgcaattaagggaattcacagcttttctgtagtcagagagcaaattgaaattaaagaaaaaagaaatagtgggaggacaaatgaggttttacctttacacttgaaaacagatttaagaacaagccttatacctagatttattaatactttgaggtatgagagggaagagaagcttagaaatacggcagaatgggctttctttgttcttctcccagctatgctgtttttatttattattgtatttttaagagagaagggaagtgtctctcctgggtcacattaattaggaaatacagagtgttttcataatgcgtaaagtctagtccatttaagtcttgtttcaaaatgctatttatattatttgagcaggaaggcagagaccttaaactgctccacccaattcattttacacaaaagattaaaaagaaaaaaacagtgtcaaaaggtcaagtgcccagtgttgcacaactaatgataggcaaaacaagagaggaggggaaaaaaaagaatcctgactcccgactcctagttcagtgtgttcttcactgttagaaggtgctgctgaacatagttataccatatgaagatcacactatctatttgagattgtagaaatttgattactgcagagctctggctgggctagattcacttcttattctttattgcattgcagtattcttaagagataaatggctcttttagaatcagattggccttggctgttgaaatgaggcattaattaccttggtagctgacacattcttacaggtcaggggcttgatgaagtttatcttcttcccttgttcctgtgattgctctgtaaatagaacacattcagagcccttgaatgcacttgcagcctgtgcctcccacagtgatcgatggtcagataatgggagtttaatgaccagtactgagagagattatttccatggctgctatgggccaagaaagctgggtggtcagaaagggaccttttccagactctcctgggttgtgttatttctttgacattggtttcctttcatgaggcgccaaggtgtatttgtaagttgtccagtgttgcacagctaatgaggggcaaaacaagaaaggaggaaaaaaaaagtatcctcactcctagttcagtgtgttcttcactgttggaaggtactgctgaacacagttatatgttcagtgtacaatgtacaatgttctttgacattccgtcatttgaaggatgggtcctatggatagtatcatctgcatggttttgaaaacaaaagatataagctaattttgccctgtctagtgactacgagacagggagagaaaatctgaatatttgttaaagtagacacagacccataaattgaaaaggacactaatcctgccttaggagacagtaaggcacttgtccctgctatctattagctgtgtgtccttggacagctcattgcttctttctgagccaccgttacacgttatctatcaagtgagcaggttgtacactagatgaattcacaggaccttcttccaagtgcttttctaatcttcataatttagataatctctcagtagcaaaacagtgtacaatatggtcaatctgagatttttagggggagaattttagggaacatcagaaatggcagtagttaaaaggaaataggactcacaggctgacttctctctataacttcacatggtagaagggatgagagttctctctggagccttttgtattaggtcactaatcccaaaggccccacctcctaagaccatcacttttgggattggggttttaacatgattttagagggacataaaccttcatctcattgcattagagatatttgaaagctcagctcacgtgtattcctccacagctcacatgtattcctccatcacccaacctgatggctttgaacgttgtagacataaatcctttcatcattatcaagaatattgccaaaagcttctcagaaattatgaggggtttttttagtttctaaaatattctcaaagaaagtcccatgtactaatgtttgccttttgatgaaaaaggatggaatcttaatgattgccttaataagctcaacagtgcttgttagttgagtcttcttattgtgctgattcttataaacaacaacattcagtataaacattaatgtatgtgattcactaaggtttttgcatgattctctgtgaggcttcagatgtctcttggattatgtgtctttttttcatcgccagcatcctgtggcagctgctactcatttgcttctatgggtatgctagaagcgagaatccgtatactaaccaacaattctcagaccccaatcctaagccctcaggaggttgtgtcttgtagccagtatgctcaaggtaagtgttgcatttcagacaccatttatgagctatttacctgtgtgcagctggctgttgttggcaaaggcaaaaggatgatgcagtagagagagcgcagtgtctatagtcagaaaatctgagtgcaagtctggccctatcacttattaatggatgattgctcatggaatttactgtaccatccagcaaaatgtcaatagttactatatattgagtgagctctgcttgttacatatattgcctaacaatgctcaaaactctgagaagtagtaagtataatccctatttatgggcggggaacaggaactaagaaatttttctaataatttgaaggtctcacagcttttagcattggagtttcacttctaatcatcgtctccaaaacccaacttttattaaaactatactaacactggtttctctctgggagaattttaaaattctgtacttagggctgggcacagtggcttatgcctataaccctatcactttgggaggctgagatgggtgaatctcttgagtcctagagtttgagaccagcctgggcaacacggcgaaaccccttctctattaaaaatacaaaaaattagctgggcgtggtggtgtgtgcttgtagtcccagctattcaggaggcggaggtgtaagaatcacctgagcccaggaggtcaaggctgcagtgagccgatatcatgccactgcactccagcctgggcaaacggagtgaggccctgttatgaaaaaaaaaaaatctgtacttaggctttcagatcaggctgtatgtgatgtatgtcgaaaacacagctataattgattgagggagaaacgttaccattttaaagtttatgctttcaagcccagatttggccactaggaatttcccagctcactagtgaaactgctgatgagtgattatttgccagtgagcctttcattctttctaaaatatgtactactagttgtgacttgtaggctataggggctataatatatcaagacaatctttatcctcatgaagcttacagttaagtaagagatagagattaaataattataacaacagagtgaagaacagtgaagaaaaagtacagagttataatatatataatagggccaggactgcatgaggaaggtaggaaagacatttcggcaagaggttgtcagggaaaagacttgcttgagaaagagccaagttgtggggtctggctgcttagcaatgaccataatacctaacttttgctatttttacatgaagtaactaatttaaccctatgaggaaagtactactaccatctagattttacaggtaagtaagcagagatacagagaagttaaactcttcacacggctttggctttaaacctatataggcttcagagcctccccacttaaccactttgccatagctacatccatattaggtgctaagtagatatctgttaagtagaaggaggatgaaaggatagttagctagttggaaaatggatggatgaatgaagtgatgcttaagctaagaacaactttcaggggtaacatgcaaagaataatggagcaaagaagaaaaaatagaaaatgggataatcctttttctactaaggggtaaccatgtgtgttattcatcttcaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgcattatggagtttatgtttacttcagggaatttttatcactgactcagtaagattcacttatgttacctatgtaagcatttatttaagaaggaaaagcatttgaagatatttcaattaaaaacaaaactatgaacctttatgacagggagatatactcagataatgcctagtgaatcctaaaattatccttggatgtttgatgagtctgagacctcagagaaaagaaataagagttttgacaaaatctggatattggtgaatttattttctatggtgtgtatcttgtatttgggagtattggttagtcttcagtaggtgagcaataatagcttaatgagtgaaatactagcagcttagatttaaatagatttttggaatctcccagagatatttcacagtggatatgaaacctctatgctaagtaacatatgccttctcttagaaattatgtaacaggagaataaggcagtcagagctctgaaacataaacacggaccacagccttttcaagctggaaaggaccataaagatcatgtaatttaaactctttgcacagatagagactcaacttagagggcaagagatgtgtccaagttcacacagctggcaagtgatggagtcatgcttaaaacttagatcttcgaaaccgagttctctttgagcaccttcgagcactgaatctcagcatttcccaccagagtatctgcaatcaccagggatactagctgcatgcttggaaatttcaccttaacattctgagtttcagagttttgtgcaaaacccacgtattttctgcattaaaattcactataatgatgtttttaccctccttgaactgcagtagggctccaggagtatgcaccatttaaagtttggcttcctggacctcctggcatgctgccacatacctttgatcttttcaccacatggtggcacagaaacagcactggaaggcatagccagggtcggaatcattggaaggcctccaaggagatgagatacattttctttttattgttactgattgaatgtaatttccatcctattttgtgcccagcctcactgctatgtgaacatataaacagacctttgaaatcaagcataagttttttttcactaaaattcatgaagatactatctgtcagtttaacaaacacaattctatttaacatgtaagcatgaatttattctctagttttccagttggacagcagtcggctgacacatgagaacaactcatcatgatgtagagtgcctgtgattttgcactatttcatgagggccctgactggctcttaagtaaattcattgctggtgtcattcattaaatactttaggaaatattaaatggctaaatactggtgtgaacctaactggcatggaagtcagattatacaacatgtttgcttgaggacaagcaatgatttgaagaggccctaagttttcagagattatgagggattgcccagaataagaacttaagatagactacatttcaacttggatttatctactgtcgaagtctgcttttcctgtttctgtatgacagaaagatcatttatatcatccatgttgcagatttcatcaaatacagtgactaaatggaacattagggttccacaaaccatgcgattagactgttaagctgtacaaaaagcagttggtgtcagtatctagaactttttatattgatgctaatagaacacatactcggagtcttttaacaaatggagctctagaaaaaaaaatcagatgggaactctggctaacctccccaaagacattcccagaaaatctacaaggattatctacataaatgatgccacaggtcacaaagaagaaaaataatatttagctgggcagtctaacacaagcataatattgactctggagctgtagtgcctggataagagttttgactctgtatcttattagccatgaaaccttaggcagtttccttatctacctatgcactgtgcatcctttctttctttctttct

SEQ ID NO: 12004 - DNA, 26075 bp, Human
tttgtcagtttattttcttcctcataatgaacgctgttttcctgtttctttgtagctttgttattgtttttatcgcacatttgaaaaacagccacatttcataatctatatatattctgtgtcatgacaatgatcagctaatatgcttggcatattcttaagtctcgacatcagccctacatgaaaacttaaggtcttctcagttcttttctgaacgtgcatctgcctagactctgtgtgccctatttgatttctccaaatacccaatggttttgaataccttatcatgtcaaaaattcacagctcagcttctcctaagtgccatagatggcctattgtatgtctcttccccctaatctcttgccagtggcatctgtgcatctatagtcaccctgcatctctactgagccactctataaataaatgagtttattttagttcatttcagattgttttttgataattccatgggagatttgagagctttctaatctaccatcctgctgatgacactctgtgtgaaaatttttaaatggctctattatattccattgcttcaatgtatagtaatttacctaattattttcttttattgttccttttaggaagaagtgaatagaagaaaagagggtgttgcaaatcaaaagcacatagagatatcatcttacaccagtcagaatggctattcttaaaatgtcagacaacaacagatattggtatggattcttcacagatgttaatcatcttcgttttttgttttttgtttttttttttttttttgagacagtcttgctctgtcgcccaggctggagtgcagtgacccaatcttggctcactgcaacctctgcctcctgagtttaagcaattgtcttgcctcagcctcctgagtaactgggattacaggtatccactaccactccagactaatttttgtatttttcgtagagacaagatttcacttgattggtctcaaactcctgacctcaagtaaacctaccgccttggccttccaaagtgctggggttacaggcgtgagccactgcccccggcctaatcatcgtgttctagtctgccctccaatgggagaaacaagtaaaattatgccatgtgaggattattcaccaatttattttaattacttttttctttataacatttaataagatcacaaattatataaaatagttatcagctttttgggaagttacttttgctggtttcttataaaactgatggaagatacaaacactattaaagaactgtttgcatgttgcaaatgatgtccaaagtccaaacattgttaataattaatactccaataaacatcatgtcagaatttctgttttcttttccctttgaacctttgcaggattaccacatcatcaggaccacaccttcatcaggaatgaatattcctactacaattaaagaagaaacaaaattaatttgttggtgaaaaacgtaaaaagagaaattttctttggttttgtttaatttctttattgagggtcaccactaaaaaaaatgctcactggtcattcttttgaatactgtctgagagaaagatgtaagatggttgattatttcaaatgacagaagataaagatgggatatcatcatggcatgaacaaaaacaagatttgtagctggaggtattttatagtctaacatgatcaccaatcattctataaacctgttggatgagtttatcagacagacagagagagagattgattgattctgaatagaaaatttcactttagaaaaaaatattttgactatataataatgtatgtaaaaattctctttgataagaaacgagtgaactggattcaattttcctcacagcctgtgtaatacaccatcacttgcttcctcctacatgccattgattagccccagggagcagtgcagcactgcctgcccatgttttacataacccctgaatataaatgccagatgttgctgaaggaaacaggatctgcttagtgaaagaagtggcaagcaatggatcccaaatatcagcgtgtagagctaaatgatggtcacttcatgcccgtattgggatttggcacctatgcacctccagaggtaataatcacattttcagcattgagcatttaaaagagcaaagctagaataagtgaacgatgacctgggttgttcagctttgtgtttctgttaccctgagtgactcacgtggtctgtcttactgggctagagctattctatgttcaaagagaaaaggtagtcaatgtttgttttgcactgaggtctgtcatatggtaatttactgcttatttttattttatacactgtttttatatgctgtttctgtgtattgcccagcttggcagaatatataaaactcaacagtgaagaacactgcctggcagttccctttctaggagatgactgcagtgagaatggtttctccatttatttctgtggttgaagaaatcttttattcttctactagacgtgatcaaaagaaacatttgtggtaacagcacctaaagatggggtgtatgaaaactgttgggagagtactgctgagctgccgcgtggtcttgagcatgacacagtaatactggtcctggacttaatacaatgccctgcacaactctcacctctaggaaaattatctgaaaggaaaaataactttattctaaggaaaacctagaacctcacaagaaaaattttaaatttttggtccgtgttaatatgcatcagatttgtatcaaaatgataggggtggccctctgacacggaagtgggcaaaatggagacattttttctagactgagctatttctacactggaagaaaacttgtattccaagactactaagtgtgttaataaggagtagtcacataaaatttttgtctaaatttgatcaactatacgttgtaagaatttacagagaaacaccttgaagaccatcgacaggagtggttcactttgtaatgcaaattggcatgaaggagaagtaaggaaaagcacaacacggaagctctagccttggtaaaccttgagtgcctgcacagcaaacagaggatcagggttggcatcaggggaaggtagtgcaacctggcatctagttccttttaatttcactagaaaaagaaagcttcagaaaagcttatattaaaatagaaaattgtttcatttacggttttgtcatttaaaaaatatacctttcaaatctttatccaaatttggtagataagtcaataattttaaatttcactgaaattatatcgtttctaaaagagttggtcttattttttagggataaagcgtaccttactaatctctcacaggtcgcagttaatttcttaggtataaatctacatccttggaatgtatgtctttactcctagtatttagttctgtcatgcacacagaatggctaatggctgtgtagaaaggagttaacacaatagactgccacccgtagatgcgcctgttttcaaagttggagcctggctggtatctgagaagttgaatttctcaccccttcctaactgataagggtagcatctataattaactggttgtacaaagtgtggggtttctgtatacctgctttctttacaagaccggaagtttggtgtgtgctatacagactgggtcaatttaaccagcacccagttaaaatcttgggaattgagtctccaaatagcatcccttgtagtcaacatttcccctatgttgccaaaatgtgatgctggaggaagtcagtgtgtttcctgaaacatcactgagagacgaatcataggaacttacaccgtattcttaccataatttcttccatgtgcctttttccatgtgttaatttcactatattaaaaataattaggagtgtgtatgcagtgactcatgcctgtaatcccagcactttggtaggccaaggcaggtggatcccttgagctccggagtttgagcctgggtaacataggaaatcccatctctaccaaaaatacaaaaacttaaccaggcattatcatgcctgtctgtggtcctagctatttgggaggccaaggtgggaggatcacttgagcccaaggtaaagaaggtgggggtgggggcagattttgtagtgagccaagattgtcccacttcacaccagcctgggtgacagagtgagactctgtctcaaataataataactatttataagttgagtcttgttaatttttctaacaaatgactgaatctgaggttgttgttgggaaactccatgctagtgattaaccagtaactgcctgggactgaagaggtccagggatacccaatctttattactaaccaggaaagacttcagcaaattgggatgggtttatcaccccacatatagaaccaacccaagacacgaggataatgtgatttttgtgaaggtcagtgctggtgcctgaactactgatagggatgtgctgggaagggaagagcgtggtccctttaaatgatacagaaagcgggaagggaagtgctggctagaggaggacgtggtccctggctacggctccaccgcctcggacctaggtgaggacaggcatttttgttttcctgcccaaaagttgcatttcccaagaccaccctggcctgccatgcccccatcctgtgcctataaaaaccccaaatcctaacaaggcagagacagaaccgggtggactttgagaggatcacatcggcagaggaatacacaggtggctagacatctagagaaatgcaccgaaaggcaccagtacgccagcgggccacctactggcagaagcagaatgacgctgagtttggctggggcagtcagaagacagtccaggctgctgagcagccggactctaggggaaaacgttcctactccatccccttctgacttccccccaagctacctccactcaatgaaaccctgcactcattcaccaagcccaggtgtgatccgatccttccggtaaaccaaagcaagaactcaggatacagaaagccctctgtccttgccataaggtagagggtctaattgagctggttaacacaagcctgtagatggcaaaacttaaagaacaaaactaaaagagcaccctgtaacacatgcccactggggcttcaggagctgtaaacatccacacctagacactgtcaacgggtcatagtcccacaacctgcccccatctgtatgctcccctagaggtctgagcagcgggggcctgaagaagcgagccacacccccactgcacaccctgtgaggacaagggaacttttcctgtttcactacctctcaagcacattgatcaccaaatactacctttcgttgctccttcaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaaggtactgtgcctatgatgagcatgtatgcacatgtatttaatgggattgtgtggagatgacaattctgtaactggttcagtagttgtgggtgaattgtgcttattagttccaatttattcacacatattcaggtattaaagctaaaataaaaggcagagaatgatgatgcctttctcatcattgttgtgttcaaatttactacttgaaagttactttaggttttgagcctcagctcagatcagtataattattttatgaattcatattttaatttcaacaggttttggggtacaagtggattttggttacatgaatcaattctacactggtgattctgagatttaagtgaagctgtcaggcgatcactggacatcgtactcactatgtaggcttttatccctcacctcactcccaacctaacccacactgagtcttgaaagttcattatataatctgtatgtctatacatcctcgtagcttagttcccacttataagtgagaatgtacagtgtttggttttccattcctgaattactttacttagaataatggcctcaagctccaagttcctgcaaaatatattatttcattcctttttatatatacactattccatgatgtatatatatatataccacattttcattattcatgcattggttgatgggcacttggattggtttcatatttctacaattgtgaatcatactgctgtaaacatgtgtgggtatgtgttttttatatataatgacttcttttctttttggtagataccagtattaggattgctgaatcaaatggtagatctactttaagttctttaaggaatctccatactgttttccataaagattacactcatttacattcctaccagccgtgtaaaagtgttctctttttactacattcatgccaacttctactgtcttttcagctttttaattataaccattcttgcagaaggtgatatctcattgtgattttaatttgtacttccctgattattagttatgttgagcattttttcatatgttcgttggctgtttgtatacttcttttgagaaatgtctattcatgttatttgcccacttttcaacagggttatttgtttttatcttggtgacttgagttccttgtagattctggataatcagtcctttgctggatgcatagtttgcaaaaactttcttccattctgtaggttgtctgtttactcgcatgattatttcttttgctgtgcagaatctttttagtttaattaggtcccatttatttttgctttttgtgcatttgcattttggggtcttagagacaaattcttggctgaggccaatgtacaggccaatgttaagaagagttttccaatgttatcttctaaaatttttatggtttcaggtcttagacttaagtctttgatccatcttgtgttggtttttgtataaggtgagagatggcttccagttttattcttatacatgtggcttaacagttgtcccagcaccatttattgaatagggttattttccctaatttatattattgtttgctttgttgaacaaagattagtatttgccctaatttctgtgttctctattctgtttcattgatctaagtgcctattttttataccagtaccatgctgtttgtataactatagtcatgtagtataatttgaagtctggtaatgaaatacctccagatttcttctttttgcttagtattgccttggctattgaggcccttttgtggttccatatgaattgggaatatggccatttttatactattgattctttctatccataagcatgggatgtgtttccatttgtttatgtatcatttctttttagtagtgttttgtatttttttgtagagatctttcatctctttggttaagcatattcttagggattttatttgcagctgttgtaaatggaattcttaatttgactctcaacatggttgttgttggtgaatagcagtgctactaatttctgtaaacggattttgtaacctgagactttactgaatttgtttgtcggaggagctttttggatgaggctttggggttttgtaggtatatgatcatattactggcaaacagcaatactttggcttatccttttccaatttggattccctttattttttttaccttgcctgattactctggctaggacttccagtactatgtttaatagaagtggtaaaaattgggcatccttgtcttattccagttttcaggggaatgctttcaatttttctccattcagtatgatgttggctatggatttgttatatatgcattttatgcctagtttgttgagggtttttatcataaatggatgttggattttattaattgcttttttgcatctattgaaatgatcctatggttttggtttttaattctctttgtgtggtatatcatatttattggcttgtatatattatagcatccctgcacctatgggatgaaacccacttgatcatgatatatttttgatgtgctgatggatttggttagctagtattttcttgaggatttttacatctgtattcatcagggagattggtctatagttttcttttgtgtgtgtgtgtgtgtgtgtgtgtgtgtgtgtgtgtgtgttatgtcctttcctggtattggtatttggtgatactggcttcatagaataatttaggcaggattccctctttctctgtatttttgaatagtttcagtaggattggtaccagttcttctttgaacatctcctgtggagatagcaactttggctttcaagctattcccctccccatccaccttcaaggccaggtgccagccttctgcatttgtctgcagcacacttcctgctttcccccggggttctggccaagggggctcattcccacttgagataatattaatatcatgaaattcagttaggagcttctttcgatctgtgacatgtggctgaactccccaagttcaagttggctgactttgctgatgtcccctgtgagataaaataagaaatggcttccctcagtccatgctggagactggtaatacctttgtgacacttgtcactgccgcttctactttatttctcacctctccctaaatcagctttgggcctgggtagggttaaggccttacccatggcctgaattctcagattccctggtggggaagagtattctggaggcagtttctccccttctcacactctgggcacttacagtttttcatctgtctcacagtgttggctgtagcctgccacttctttcaaagggtctgtgaattttcacttttcctattaagttcctgcattgcttcttggaaaaaagtttgcagtgtgaatctctatatgctattctgtctttccaagtgggagaggcatgctaacactgcctccaatccacaatcttgggaacaaaaaactcagaccaggatggtttaacatagactacagattcagagagacctataatcaatattttagtttttcttatgtctgggatgactttcttcaatatcttattctgaatctcaattgtccttttcagtgaagagtgtgggaggcagggagatgcaacataaggatgttatgagtatgaaacaacagataacagaagtatcttgaatgattgctcaacacatgtcagcacgtaaaaactttttgctcttcagtttctaaacaggaatgcttattcttgcccatcgggttcaatggatgagaaaaattagactattcaaatgctttataatttctctcaaacacagttcagatcatcagaattacttgatatcaatttttacctactgaaaattttaattccattgttcagcagttgtactaactatatatgcaatatgtagctttcatataggtaggtcatatcaaaataaaacaaagggaatttttgccagaggtcatctgtttggaacggtgaaaaatgtctaaatattaggtgaagcaaactaataaaactagctcatgtttttattcaacataaatcctttattttaccatgcagctttggtgcactttctttcaaccacagatggtccaaccagccttggaaagctcactgaaaaaacttcaactggactatgttgacctctatcttcttcatttcccaatggctctcaaggtagggaatttgtgagatcaacttctcttctgttctcagcatgaccatcctttatgatggttgaattgaacttcttctaaggagggtgtaggtgttattacatggcagaagagtcctaagtataatgcctaagccattttcttgaagagtacaaccttccttctgtaacgtatgatgacaagagaagacagtacatcaacctcaaagcctctgcttcaaaaattcaagaaaataacaacagccaccttcaaggctctgtcttaattagggttcctgagtccatctcttaggatcttcacagatacagagatccatgcagctgtggtaccccaaaaaaactgctgcacatgtggtgtacagtgagtttccattatctttccccattttaagctgaagtagatttggtggaactcactctgggtgagttttaaaaaggaaaccataataggacctgagaatccttgcctttttcactaaggcttgtttcacaatggagtttgtagctttgcctagtcatgaatttcggttgtgcataacttttaaatttatagaaaaaaaactcaggctagtttatttaaaaaagagtttattgcatgatgcaaatgggtagtcactgccatgaatacatttcaagatttgacgtagactctaaaaatgtgacctttctccataattatctatgaactccaagaagttttctggatttttgtcccagcctttttgattgttggcaatgatagctttgaggcagctcaatgctcatggtgattaacataaaagaacctccgtgggtcttacaactttcaaattaatactgaaaagaacttccatttgaacatgtttagcttatgatcctgctcatggactatcaagtcttcagggggataaggaactcttattgtatcacctggatcaagaatacaatcccttattgctggatatcaagggctgtttgagtcaaagagaggcatttcccccaaaaaaattataggatcagacaaaagtaacagaagtcgactgtgaacccccattaaaacctgtaaaatggttattaatatatataatggaagtagaagattaaaggaagcctgtctcctaaagacattccttaaaactctgtacgtgaaacacttggcccacatcactttctagaacatttcagcacctacctcacggtggattattatcctaaaatgtacatgggagcatgcctatgggtggaaaagttaaatggtgacactaaagtgactgcttctacttcagccaggtgagacgccactaccaaaagatgaaaatggaaaagtaatattcgacacagtggatctctctgccacatgggaggtgagtgcttggaggacagagtacagaaaaggaagacaagaagaggtaaacctgttccccagctttcatatgcaacattggaatatgcaccattggaactagaaattaaggagcttgacaaaggaagttttgctgagtggtagggaagaatacatgactgaaatagaatagcaggaaatgaaggagataaactggggacaaggaagacagatattcctcccgctccatggacatttatctctccagcttcctaaagaggatacacaaattcttcttgctgtcactatccttttgttatctgttgtaattttttctcttgagaatcactgctattttcattgtcatatcttaacagttgttgctttaacagttctgtcttgcatttatcataatctgcagccaactgcacaaataattcctcacaacccctttctccccaggtcatggagaagtgtaaggatgcaggattggccaagtccatcggggtgtcaaacttcaactgcaggcagctggagatgatcctcaacaagccaggactcaagtacaagcctgtctgcaaccaggtgagcaccctcagcctcctctcctttctcttctcaatgtccatcttcctgtcctactgcctggcttccatttgttttgttccacttacatttgtgaaacagaagattctagaaagcaaaacatctgtctagaagaaaacggaagacccttaattgcacctcttcttggagaagtcttaatgaaaatggtacagagaccttcatgctaaattgtgtgtactattttggggggaggtgaatttcatcaaggaggactgaaatggttaatcagaactcagggagaaggtggacttatctctaaggtatgaaagaccaccagagagtggattggtaaagatgatttggagtagaatgtatataattatagaggccataaaaacatgggatgagcaataaatcaggagacagtgagaataagagaagatcggtactacgggtttaaatagggtttagatgtctgaatgctttttgtcatctctgttttcatagttcttgagcaggtactaaaaattaactggaaacaatgaaagtcatccaggttagggagaggaagttacccgtttatgagagttgcttgagagataagctgaaaggatgtggcgtgctacccccacccctgcctcgtgtagaaaagcctgccaatgttgcctcatttagacccagactccaaaacgggagtcttatagctgggccacctaggaagagaggttctaaagcataaaaaagaaagcatttcattttgggacacttatttgcagctggaaatgggggaatgggctaactggctaaactactatcttgtccatcctgccttcacttcagtccttccacattgttatttggtgtttggactgtgctagaagaactgttttatacaggctgctattcaataaatttgtaaataccatacccacaccaaaggatttaacactgaaaagattaaggtaattttggaaaattctaaaagtcacttttcactcctgagatgtaggtggtcagaagaaatgaggaacactgtagaagccatatgcaagatgcacagatggcattgtgtttgttgtggactgttgatgttaacaggatggaagaagtcaaaactgaactttataaaatagggtataagaaaataaagatgtccctgtacttacaggtgctaagaaactagacttgaagaacttgtctctctcagaaattgagaaattgttagcaatggttgaactaagctcatcaactccttggcatttgcagcctacctgtgcaatcataggacatgaaataaaggaaggacttgagaaactccatgatgtgataatgaagagaaaaatattgcagtaatataaaaagatgaatatgataccttttctatatatgtagaatagattttctctggtctgattttgacaaatacaagactgtctacagcctagttttcctgtatgccctcctgggtgctatcaaagcttcatttcattgaacaatcagatgcccaactctgtggctttgtggaagatgagtaaatgcagtaatgcttgaaatggtctcttctccctagcccacaaatattttggtactatcattttgggaagtcaagcaagtatagtaaattaaccagaacacaattgtggaaatttgatgcaaagttagtgaaataaaactttaaagagtgaaaaaaagaaagttaactatttatggagataactagttatggtggatgaaatcaacactgaggaaaatttagcagaacattgagctgaccttttgactgtccacatcttattctgatgcactgctttgctttctgtcatcaaatcaactgtttagatgcatttattctgcgtatggttctgttctcttactcttttactacttagagtcaatgagtacaggtctacagttgaaacatgtatttaaaatttatgtatttggtaatataatacaaaatcatgattttcaattaaaaaggaattaatgtggttttaatattagttttactcaatttttattatgacaactttcaaattttagagaaatttgaagggataatacaggacatctacatgttatcatctatttccaaaattgttgacactttgccaacctggcaagtatataggcatatatgagtatatctgcatcaatacaggtagtatttgttgaatctcttcaaaatatattccaatgatcacaattcacctctacagacctttcaaagcatggcataggaatgaagatattctcccagtaacagtgcaattattatatctaaggaaataacaataatgccctcatatcattgattatccagtcagtattcatatttcccattgttttattgaaagatctcttatacctctattttaaccataaatagaagatgaaaaaatttaaagataccataagatattaagtacctgaaattatacctaataaaagatgtgtatgacctctaaggagagaattataaaacaatgaagaataaataaaagatgtatcatgaaaacaaaaacaaaaaaaaaacatccaattgtgactttcagtttgttgtactttggtcagttaacttgttgttccaagtttttaaaatttaagtttgtgtagattagaagttatacttgaatgctttatatcatagaagttaaacatttttggtgagaaactgcctctacattgctgtatccctgaaattataccacagtaggcagcatgaaatgacagattgtcccacaattagtgatgctaattttgatcacttggttaaacaagtggtaaccagatctaatttccagagacatgtgttctcccctttgtaattactggtaatctgctgggtgaaataagagggaaagttatattacacagcaaattttcacatgatgattgagtatacatcaatgatgttttaaatttttgtattgtattattgtatttgttctttccttggggctttaaagtaattactttcaattttaactacaagttttactattctttacgttttattataaaaaaatttttttcacaaagtcaagaaaagaaacaattactgctctcagatatgccaaaagcttaactccttccctttaattattcatttcctagaaaaaaaattactgtaataatcactatattagtccattttcatgctactgataaagacacatccaagactgggacttatagttccaatatggctgaggaggtctcacaatcatggcagaaggcaaggaggaacaagtcacatcttacatagatgatggcaggcaaagaaagagcttgtgcaggaaatctcctccttataaaaccatcagatctcatgagacttattcactatctcaaggacatcatgggaaatatctgcccccatgatttaattatctcccaccaggtccctcccacaacacatgggaattatgggagctaaaagatgacatttgggtggggacacatagccaaaccatatcatgccacccctggcccctcccaaatctcatgtcctcacaattcaaaaccaatcatgcattcccaatagtcttccaaagtcttaactcatttcagcattagatcaaaagtccacagtccaaagtctcatctgagacaaggcaagtcccttccacctataagcctgtaaactcaaaagcaagttagttacttccaggatacaatggcggtacaggcattgggcaaatacagctgtttcatgtgggagaaatgggccaaaacaaaggggctacatgacccatgcaagtctgaaatccagcagggcaaattttaaagcttcaaaatgatctcctttgactccatgtttcacatccaggagtcaatggaactccatttacatccatgctgatgtaagaggtggttcctatgttcttgggcagctccaccactgtggctttgcagggtacagcctcccttctggctgctttcatgggctggcattgagtgtctgcagcttttccaggtgcacagtgcaagctgtcagtggatctaccattctagggtctggaggatggtggcccttttctcagagctccactaggtggtgccccagcagggactgtgtgggggctctgaccccagagcactgccctagcagaagttcaccatgagagtgcatgcctagtggtaaacttctgcctggacattcaggcgtttctatacatcctctaaaatctgaaatctaggtggaggttcccaaacctcaattttttttttttttgagatggagtctcactctgtcacccaggcccaggctggagtgcaatggcgcgatctcagctcactgcaacctccgcctcccaggttcaagtgattatcctgcctcagcctcctgagtagctgggattacaggcacgtgccaccacgcctggctaatttttgcatctttagtagagacagggtttcaccatgttggtcaggctggtctcaaactcctgactttgtgatctgcctgcctcagcctcccaaagtgctgggattacaggcgtgagccaccacgaccagccccatacctcaattcttaacttctgtgcacacataggctcactaccacatagaagctgccaaggcttgggacttgcaccctgtgcagccatggcctgagctgtaccttggccccttttagtcacggcaggagtgattgagatgcagggcaccaagtccctagactgcacacagaatggagaccctgggcccagcccatgaaaccattttttcctcctagacctccacctccctctgggcctgtgatgagaagggctgacacaaaggtctctgacatgccttggagacattttccccattgtcttggtgattaacatttggctccttgttacttatgcaaatttctgcagctggcttgaatttcttctcagaaaatgggtttttaatttttactgcatcatcagactgcaagttttctgaacgtttatgctgtttgccttttaaaactggatgcttttaacagcacccaagtcactgcttgaatgctttgcttagaaatttctttgaccagatatcctaaatcatctcaggtccaaagttccacacatctctagggcagggacaaaatgtcaatttctgctaaaacataacaagagtcacctttgctccagttcccaacaagttcctcatctccatctgagaccacctcagcctggttactatcagtatttttgtcaaagacattcaacaagtctctaggaagttccggaccttcttatacttttctgtcttctcctgagccctccaaactgtcagaacctctacatattacctagttccaatgtcacttcattttcaggtatctatctttcaacaatgccccactctaccatattagtccattttcatgctgctgataaagacatactcaagagtggggaaaaaggggagtttaatggacttacagcttcacatggctggggacacctcacaatcatggcagaaggcaaagaggagcaagtcatgtcttacatggacagcagcaggcaaagagacagcttgtgcagggaaacccatttttaaaatcattagatcttgagagacttattcactatcatgagaacaacacaggaaagacccattcccatgattcaattatctcccctgggcccctcctacagcatgtgggaattatgagagctacaaaatgagatttgggtggggacacacagccaaaacatatgaatcaccattggtgaaggcaaatacttttgatcactctgtcttttaaccactcaacactatgaagacatggattgttttgctataatttgtaattcattttattcattgttggtttttgatgctcaaatctatgcaaatgttactgggattcctataaaactacttttctcttttaaacctgcccttatgagtctttaaagaaattcttacattctggcacaatttgatgttcaaagctcagaatcttaacctatcccaagtctagaattggccatgtgcacttctagtggtcaaaggttgttagaaactggctctggttcatagagttgctaatgctcagaaataacatttctatatatacttttagaccagcaatataaactgtatttttataaactgattgttacttgacagtaatattctgttcaaatttaatgttatactttattcagcttattttaatctttatattaacatatctgttttgaattatctgatgcttttctctcttgatcatctaaaggtagaatgtcatccttacctcaaccagagcaaactgctggatttctgcaagtcaaaagacattgttctggttgcccacagtgctctgggaacccaacgacataaactatggtaataagagcatcaggaagtttacctaaaatgccattttgatgaaaaattttagttatagcatactcagtctcctagagttcattctcaatgggtcagggtaaggggataatttgcatttcttatgagataccaggtgatgctgctgctgttcagggacctcacttgagaggctctggtgcagaatgaacaccttagtctgtttagggagcctcctaccaaactgaatccagcctcaagacttcagcatttctggctttccttccagggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtgaggagttgggtgggcatcagggctcctgcacagtgtccttcacacgtgtgcttcttgtaaggttctcaggacacccttggactaagtccacttcctgggcatttcctatgcacaaatgctttgtgtgcataagtgttttctactctaccacaggaggggcagcatgggtggagagaatcaggatgggaccaaaaccaggaattttggtttcacaacataaagttggcaacttaactctatccctctgctagggacatcaccttttcttcattttctgaagtgaggagttgggttaggtgttctctaatcttcaaaaatcattgcagatttttcatgtccttgtttactcagtataaatttcatatatttattctcttagaattatttgttgagtgcctgttgaaatctttgggtattttattaggttgcatgtctttttctatgtgtagaagatcataattatactgagtaaacttattaaagaaaacctctcaacatagaggtttaatacaaaaccatttatttaactgacaattccatggtttgaaatttagcctaaagctccacctgaactcagtctcgtcctgtttctggctgggctttctcacgtgtgtgcagggcaatgaggcagctctacagaattaatccagaatccatattctggatattctttaacagcttcaaatgtattgttgaaatagcctctcccaaaatgtacccgtattttgattccctttatggtggttttaataagcaaaagtttctactcttaatgtagtcaaattctttatgacattttctcgtggttgctaatatcatgactttttctatattggaaacatgacaatatgttaatatattatatagtaaaatattatgtagtaatacaaagtaatatattattgtctattaatatcttataaaagtattaatgtgcttttataaactgggatagtaatttgatttttaatatgtgaaataagagtacaaatgtacatatacataatcttcacttgatactaaaatgtcctactaagaattattgaaaagtccatatttcctcacttatcttgatttttcatcctaagtgtccataagtacttcactgacatttcccctctttcagagttaactttcctgtactgtttaagattatgttgaatagaaagtcttactaccataatagtaacagtatttttctgacttagtctatatataataatggcttggctagtcctgaatgagtgttctgttacataacattcagtaatatcaacttcaacaaaagggctaatattttgttctctggctgaaattgctgtgaaactgcagatcaatttggtgagaactgattgagacttccagtttacgaccatagaccatatgaatattcagttatttatgtgatattttaatatgtgcttcaattagttacatagcattctttattaaggcattcgtgtatgttttcctagatttattcatagaaaacttatacttttaatagtctttggataactttttttgagaattttctaatctatgcaaatattctaagaatacaatgaatgcttcttacctagactcatcaattgttaaattgatgacatttttattcttttcctctcattctctgtatcattagagtattccattaaaatttagtaatttagtattatgttagcaatgagtgacatctttttgatatttaaattctttccaatttgtatactgagaccctcttcaagaaactatttgtgttctttgagcatgatgttattaggatttggacaattactgtcttgaattttattgaaaacaattgtttttcacattatagctgtttgtcaaagatggaaatacagatgaataaatttggatttcagtatttctacatctgatgtgaaactgtataatgctgcagacaaagaggatctcaacagatactagagatgaaataaagttaaactggtgtgtacatgactggttcatgtacttataagattcggaagaatctggagaaaaattttgaaacttataatttagacagtttgatggtgatacaatttggatatttgtctccttctaatctcatgttaaaatgtgatccccagtgatggaagtggggtctggtgggaggtgtttgtgtcatgggggcaaatatagaaatatagaaatccaacaatatccatctgtattagtctgttttgtgctgttgtaaaaaaaatacttgatgctgggcaatttatacagaaaagagctatatttggctcacaatttgcaggctgtacaaaaagcatagcaccagcatctcattctggagaggcttcaggaagctttaagttccaacattaggtcattcctttgcacccatacctgatcataggctgttagaagcagtcacactatctcttgaatgttttcctgcttagaaatttcttccaccagatacccttagtcatcactaagttcagacttccacaaagtcctggaatggacacgatgcagtcaagttctttcgtaaggtataacaagggtgatctttgttccagtttttaataagtttctcattttgatcttagacctcattagcctaaacttagttggccatatttttaatcagcattttggtcagaatcacttaaccaatgcctaacaagttccagactaccccttatcttcccattttcttctgaaccctcctgacacttccaaactgtgctaattatccagttctaaagccactaccacattttcagacatttttagcaatgtcccactcctggtaacaattttccatattagtccattgtgcgctgctataaagtacccgaggccagataaaatatgccgaaagttgttttgacttaccattttgcagactgtacaaaaatcatggcaccagcatttagttttggtgagggctcaggaagcatttactcgtggtagaaggtgacagaggaggaaacatatcaaataacaagagatgaagagggaaaaaaagaaaatgtcaggctcctttttaaaccagatttcatgtgaactaatgcagtgaacactcattaccatggggagggcacccagccattcatgagggatgcccccagggcacaaacacctcccaccaggacccacttccatcattggggaattacattttaacatgagattaggaggggacaaatatccaaattgtatcaccatcaaactgtctaaattatacatttcaaaatttctctagattcttctgaatctaagtacatgaaccaatcatgtgcacataaggtcaacttcgttccatctttagtttctgttgagatcttgtcttcagttttgtgcagtttcaatatgtaatatctaggaatagatttatattttatctgatattctttaatcacttgagagtttagagatggtctttcataacttttggaaacttatcaagtattttacatattgcctctacaccctactgtgtgatatacttggctattccaagttgacaattatgcaatctaagaataaacattttctacttctttggtaggtttttgaattccagttgacatcagaggatatgaaagttctagatggtctaaacagaaattatcgatatgttgtcatggatttgtaagtaactttggaaaatgggtttcccagtttatttttagaggaggaatgtcagatgggtgttgaaagtgacctcaataccagggagacagaggccagtgcaagtgagaggtgagacaggaactctctggaactctccttctggattcactccagagctctgttctctgacagggtgagtggacccagggtcagcatgggtcaacctgtgcctctgctctcctgactccatggaaatttccagagcagccaatattattgctaaatctgcaactttcatgtaggcctggcatttctgccgtggcctagtggacagtagatattgcccatatggcttgattaatgtttttccaaatctgtacttatagctttttcttccaaatccactcagtttcttatcagctaaaaaacatttccaacaacactggtgtccatgccagaaattctcttctcttccatatggaattgctcactagatcatgtcaattcagtatctttaattgtttcaaatttctttcttccttctctttagacatttgctcatgacccaaacactgcattttgcctccaggaagtttgcccttagtaggcaatagaactcttggctttaatttttgcaatatggaaatctcaatgcagagtataaagaagctttagagaagatagattaaaaatcaagggaagagccaggctcagtggctcatgcctgtaatcccatcattctgggaggccaaggcaggtgaatcacttgaagtcagaagtttcagaccagcctggccaaaatggcaaaaccctgtctctactaaaaataaaaaaattagccatgcatggtggcacacacctgcaaatccagctactaaggaggctgagacaggagaatcccttgaacccgggaagcagaggttgcagtgagccaaaattatgccactgcactccagcctgggcaacagagcaagactcagtcattaaaaaacaaaaatatcaagggaagagttggaaagtcccatctttggggataatatatagctgacaaaagatcttactcttttctatatgctccaaggttctaggattcacagaaaggcactcatgtgatgagggcaaaacaagttatgtcactgcctgcagtggagatgttaacaagtaatagacatgagataatgtattaaaaaggataagcacagcagcacatcataagaactcaaacatttttagatatctttattagtttagaggaaaatagtaaaatagaaaatcatgaaaaggaaaggaagagtggcaaacatcagtaattctcaccaatcaattattcaatattaatgaatcatttattcattctattttgtgtgattttcacctaaagattgcccttagcatattgtagggttttgaatatggaaccccatatcacatatgacaatttacatgtctgaatcaaagaaaatattttccatatggtaagcagctagtcagtaatgaatacattcttttaaaaggatatgtgattgctaccaataacatttaaccctcaaaactttttgttaatgatgaacatatagctggcttatttctattcaaaacaatgcaagatgagttcctgctttcattgagaatttgaaatagaaaatgtcagaatatctctttgctctgttgacagatatggaggactatgtttgaacaattgaccctgtgtagtttgtgtgataaattccaggcaagggaatataagttgaaaattttcttattttgaaaaaaaaaaaacacattataaactcatgttcatgaaagacattccacaaatagtccgaaaataaacttcttaacattcacactaatggcagcttcatataaattcactttgctaccagctttttaatagagtcatttcatccatatttatgtactatcctttctcttttcagtcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaattgaatgtttttccttaaagattcttttcctactcctttctctgttacttgtgtgtttcttttccttctagttctttaaggccaaaaactgatttgcctataagtttggggcagagagcagatgataaccaatattttatagacatttttgaggtgagagtaggtggagttttcagcctctagaggagaagcaagtgacatatttgttagtctgtctttagctcttccagaaagaagaaaacacacagcacagaacctgaacatgagccatattgacaggatgaccaacaattaatggcctccctccagcatcgcaagaatgggagctccagcaacctaggggtgcagcatccctgtggggtaatggttagggaggtgggagggcacccatccaggagaaataattaggagtcagatatgggagaggtgagaagggagttgagcacattctgcttgggaaatacaaacacatgctcttttgttaattacgtcttgtgcataaaaggaaacttcccacatcgttttaaggctgagagccaggccttgacctcctctgtgtgcccagtatcagcagtgaccttgctgggctgtggtggagcaggacatcaaagacaccagtgactggccacattctcctgaatatcagctccatttagaacaaattttagattctaaaaatatactcttaatttgttctactcagtcttttgaaatatttcatacattcaaaaaggcacacttactaatataaaatatctgaaagccattacatgttgtcaaattaatttcaaaattgcaaatacatctaattatccaaaatttcaaaactcttctgtaaacagtgtatgtcaatagcatgatgctttcaaactttgtaataattattcctgaaagttactaaagacacctaattgttcatatagtttgtaggggtacaaatttaatcagctagtcaagaaaataaaatttcattccagacaactttttgaaaagttgggacaatgttatgggctactggccaaagcactttgagactgacaggtgtttatgacctgtgcacattttccagtgcttttaccctccactgatttaaccccattagaggggtttccttaagccatgtctttcagctgagaaatatcctgccaagttttgtagtttacaatatttcctaaaatgatttgtttcttagaagtggaagaggccataaactttggaagacccttgggtgatctttggactggttttctgtcttcactcatttccttgatgatgtcaaatattctcatggctttaaatacaacctctaggccaagaaaccacaaatcaatatcggcaggtgagctttttctccgaaactccagaatgaaacatcatattgtctgcatctctacattagtgcctaatggactttcacacttagcatgactcaaacaaagctcatttcaattgctgccttcctgttccacctcaatgttcctagactaagtaatgattatttcacgtcttgtaaagttgattgacataatcaaaaattaatgtttttttaacttattagtcaagtatgtaatgctaaagaatttcagattttcttagtatgcatgacattattttccccaagatgtgaataattagaagtcatttataaatagtaaatctaaaaaaataaaaaataaatagtaaatctgctacaggcttattctacttgtttacccttcattttcacagaaatcttattttgaaaagaaagtttaggccaggtgcggtggctcatgactgtaatcccagcactttgggaggccgaggcgggcagatcacgaggtcaggggatcgagaccatcctggctaacacggtgaaaccccgtctctactaaaaatataaaaaattagccaggcgcggtggcaggcacctgtagtcccagctactcaggaggctgaagcaggagaatggtgtgaccccaggaggtggagcttacagtgagcagagatcgtaccact

SEQ ID NO: 12005 - DNA, 101894 bp, Human
  misc_feature (1)...(101894): n = A,T,C or G
aaccaaggtactcaaagaggttaataagtaacttgcgctggatcacagaactaacgggaggcagggctggaatttgactctaggtctttctgacctcaaagtgcagtaaagtcatggaatttctctactaggccacctggaagaaaagtgatcttttttccagtcttttttgttactgtttttcagccaggagatagtagagttaggtagtagaatagtagtcactggcatccggtagtcagccctccaaaaaagtttttgatttttttttttttttgtcttaaacttggaagctactaactttcaggtcatactttcttatcatccaagagctggatatttaggtagcagaaactatggaattatcctaagtcctcttgaagcttcagctgttaaaattaattggttctgattaacactgtgctcaagatttacatttctaggagccacagtttgattggtctaacttggatctatgtgttttctttagctggggaggagaaggtatcttgattgataccttcaccaggactgcatgcagtgagggacagaagtttccttaaaataattgggttctgttataggaagaaggggaaggagataccaagtgggcaaaacaatcaggttctattacataaataataaacctaatgtgacgataataaatggataatatgattattttaagtttggaaatatacctggttattagtattggatatctggtagtggggttggagaaaaagtcgagaataagaaaagacttaaaatcgtaaaaattaactggaaaagaggatggctgagcagatacatatatgttagataatgttcataatggcaaaccaacctgaagatttgtttaaattgtagtatgtagccaggtgtggtggtgcttgcctgcagtcccaactacttgggaggctgaggcaggatgattgcttgagcctaggtttgaggctacagtgagctatgtttccaccactgctttccagcctaggtggcagagcaagaccccatctctaaaaaaataaagtaaaatgaataaattataatatgttatgacaaatatagttatctgaagtcacagaaaatgtgcatgtgcatttaatgatgtgaaataatttttaggaagtatgaataaaaaaatcaacttttaagtgtggctagtatgatcttacctgtatctcacttatagaaaatataaaaggctgaagccagtcaccagtttaatagttctaacctcttgtttacttgattcccttttttctcctccccagcaatcctcatatagttaggtaaagttggttcttcatcaggcttgttgcagaaacccctaagcctttttacttaaagctttttgaaacccagaaacccatcttttgaattcaaaagttttgactgttattagtctttttgtatgtttgttggccgcataaatgtctcctttttatgaacagagaagtgtctgttaatatactttgcccactttttgatggggttgtttgtttttttcttgtacatttgtttaagttccttgtagattctggatattagacctatgtcagatggatagattgcaaaagttttctcccattctgtaggttgcttgttcattctgatgatagtttcttttactgtgcagaagctctttagtttaattagatcctatttgtctgttttggcttttgtcgccattgcttttggtgtttcagtcatgaagtctttgccagtgcctatgtcctgaatggtattgcctaggttttcatggttttgggttttacatttaagcctcaaatcgatcttgagttaatttttgtataaggtgtaaggaaggggtccagttccagttttctgcatatggatagccagttttcccagcaccatttattaatattaaatagggaatcctttccccattacttgtttttgtcaagtttgctgaagatcagatgattgtagatgtgtggtgttatttctgaggtctttgttctgttccgttggtctgtatatgtgttttggtaccagtactatgctgttttggttactgagccttgtagtatagtttgaagtcaggtagtatgatgcctccagctttgttatttttgcttaggattgtcttggccatacgggctcttttttggttccatatgaaatttaaagtaggtttttctaattttgtgaggaaagtcaatggtagcttgatgggaatagcgttgaatctataaattacttcgggcagtatggccattttcatgatattgattcttcctatccatgagcatggaatgtttttccatttgtttgtgtcgtttcttatttccttgggcagtggtttgtagttctccttgaacaggtccttcacgtctcttttaagttgtactcatcatcactgatcattagagaaatgaaaatcaaaaccacaatgagatgtcatctcatgccagtcaaatggtgattattataaaaagtcaaaaaagaatagatgtgggtaaggctgtggagaaataggaatgcttttacactgttggtgggagtgtaaattagttcaaccattgtggaagacagtatggcgattcctcaaggatctagaaccagaaataccatttgacccagcagtcccattactgggtgtatacccaaaggattataaatcattctgctataaagacacatgcacacgtatgtttattatagcactatttacaatagcaaagacttgaaaccaacccaaaaagccatcaatggtagactggataaagaaaatgtggcacatatataccatggaatactatgcagccataaaaaagaatgagatcgtgtcctttgcagggacatggatgaagctggaagccatcattctcagcaaactaacacagaaatagaaagccaaacactgcatgttctcacttataagtgggagttgaacaatgagagcacatggacacagggaggggaacatcacacaccgaggcctgttggagggtgggggacaaggggagggagagcattaggacaaatacataatgcatttggggtttaaaacctaaacgatgggttggtaagtgcagcaaaccaccatggcacatgtgcacctatgtaacaaacctgcacattctgaacatgtatcccagaacttaaatttaaaaaaaaagaatttttctcctctgtgggtttcagaagcctacatttgaaactgggatactgtaatatcgaatcgtgttctccatgctctgctgtgtatttcttttcctatggcaatggatgtctctgactgaattggtgtggggaaggtgtgtggaggggtcaagaaaatagcatggactaaggaacttgcttagtctttcctggaggtgttccactacagctctactactgtcttcacaggtaagtgagaactgcatatgctttgagaaatggctgatccaaggcaaatcctgtcattttaggttaataaaatctaactgtgagcacagtggctcacgcctgtaatcccgacactttgggaggccgaggcgggcagatcacgaggtcaggagattgagaccatcctggctaacaccgtgaaaccccgtctctactaaaaataaaaaaaaattagccgggcgtggtggtgggcgcctgtagtcccagctactcgggaggctgaggcaggagaatggcctgaacccgggaggcagagcttgcagtgagccgagatcgcgccactgcactccagcctgggtgacagagcgagtctccatctcaaaataaatgatagatagatagatagatagatagatagatagatagatagatagatagataaaatgaggatctgggactacagacgtgcaccaccacacccagataatttttgtatttttaatgaagtcggggattcaccatgttagccagtttagtctcaaacccctggtctcaagtgagctgcctgcctcagcctcccgaagtgctgggattacaggtgtgagtcaccacgcccagcctttgatatattattataggaaaaaagaggagatgtactttatgtagaagagaactttaatttatgctgtgacggtacctaaaagatacatcctttattcatgcgtaagatgaaatcgagaggtgaaattggatatactgttgcttttaaaaaattttaacatatatgtaattttttgtacttatctcattttagcctatataagttatatatattttgtttgtttgtttgtttgttttgtttgagatggagtcttgctctgtcacccaggctagagtgcagtggtgcaatctcggctcactgcaaccttcgcctcctgcattcaagcgattctcctgcctcagcctcctgaatagctgggattacaggcacctgccaccgcgcccagctaattttttttatttttagtagagacagggtttcaccatcttggccaggctggtcttgaactcctgaccttgtgatccacgtgccttagcctcccaaagtgctgggattacaagcgggagccaccgcgcccggctgtaagttatatcttacacaaatctaggtttcattcagagaattatatgcaaagaaacagtgcaataggattattttaaagccattgttattgttagaaaacataatacctttaaaattccttttcacattagaaatatagtggcttctccccagtttaggatagaaattttccttttcttctccttctttatactattcagatttgcatgtttgacagaacaaattataagagaaaatatttgaaatgtcacatactaaagtaaatgtttgaatgtttgaaaattttctggttttcagagattttgaattgctgaatcgttgtgtaaattaagatgttgagtagtttccacagagtaattatttgaaagtcactgaaagcaagacacatgcctaatgtaaatgtttattgcactactgtacctttttctacctcataaaaatgagaatagcagtctgtacttttccacttcgtcattcgtaagtctttgcagaaattcatattttgtttgcttattatcttcacgctgtaaatagcttgaaaattctttaagtggggctagcgatgtattatggatacatgttaagtggtatagaaatttcacttttttttttttgcataaagagtaacaagaccagtagtccatatttcttcagctctacccagagaagggcaatgtaggagggaaaatgaagtttgcaaaatatttcatagtaggctttttcttaaagtaacttcagacttacagaagtttaaaaatagtacaaagaatcccatatacctgtcaccccaattcctgaaatattaatattttaccacatttgttcattatgtctgtattctccaagtacgatatatgccattatatgtaatatgtagcattttatatagacatagggcatgtatgcactatatatttttttctgagccacataaagagtaaaacgcagacatgacgtgcttttactcctaaatacttcagtgtgtgtattccctcaagaaagggcattttcttctgtatagctaccgtacacttctacacttttcaaaatcagaacatttacattgataccatactatgacatgatctgcagaccattttccaatatgccagttgtcccactgtgtcctttagtacaaaagaaaaaagttttttttcctggtctaggagctaatcctggagcacatgttacatcctgttgttttaatctagaaccgttcctcagttctttatctttcataaccttgacatttttggagagtacaatccatatattttgcagaatttcccttagtttgggtgtgtctggtttttccttataagattcattttatgcatttctggccagagtaccacagaagtactgtatatcttaccagaaagcctaagtggcatttgcattttctaaatgatcaattttaatattatatggaaagcagagtcagagattctcacatatgtcaagatattataagtattcctgttatatttattctccaattgctttttctcaagaaaatgtgtggcctttcagctagcttttcaaagtggaagttactacataacattaggatgggagggtggggaagagctttattaaagctttaagattgagcttttgagtatgtgttgtatgtaaatgaaagtgggcattgatgcagggattgggcctttaaacctttggccaagaatggtatcaattattattattattattttttggagtacttctgctaaaacactgaaatcagtgtgccactctccttttagaagttttacacctttccaaggtacacttttttttttggagacgagttttgctctgtcgcccaggctggagtgcattggcgcaatcacagcccacttcagcctctgtttcccagactccagcagtccttccacttcagcctcccgagtagctgggattacaggtgcacaccaccatgcccagctagtttttgtagagatggggttttgccatgttgcccaggctggtctccaactcctgagctcaatctatccgtcctcctcagcctgccaaagtactgggattacaggcgtgggccaccactcccggcttccaaggcaggcatttaaatgtaataaatagggagataagcaagaaccctgttggacctggtagaagcaaacatttattagtactattacgttgtttaaaatattagcgccttctatattcatgtcctcccagaattatcaaaaaacctactctatagtttatttggcttatatctcaggagtaataaaattagttaatagtattggcatcgtggttctttgtgtattcctcccttatcccaccccaagttgatttcacatgatctcttgatctagtctaagaatgtttatagtgattacgagaagttcagattctggctttaacatatataattgttttttaatctgtaaaccaaagagaatgagtttgtttaaactagaaagatggcaagagtagtctgggaattttgttccattccttaaaagtcctataataaaataaacatatcttgtgttttatttttacaatttttttaaacattagtacagagtgccacttcttatattctatatcaaataatgagctacattttcaataataacctctgagtaatttttggcattaaaatctgcattacaaaataatttgaggatataatttataatcacttatgctaaaatcacctatttgaaattatgtatgaggttttcaaagtttatagtgctttggaaaaaatttaaatgtttctttgtttatgtatctttattataagctgtagcatatatcatgtagttgtcaaggatgctgatagatacttaatatttaaaggagacttgtctaaagttagctgtccaggactagaatctgggccttttggtaacagttcattgctctatttacttaaatgatgattggattcgttagaatttctctattttcatagctgtctctatggttctatgaaaatactgtgtgtgtgcttatacatatatgtatacctgtaagtacaaagtagaaaatgaaagttcattttctgcttttgacaattgtaatccccagagataaccgttattaatatgttgtctcatgtttggtcatactgttttctctgtattctgtgtattactgtataaattttacacagtaatttgcatattaaaaatgctggtctacacctggcccttttttaaaaactgcaatttattatggccaattttttataccagtatatattgatcaaccttattctttttaactgctgcatttcattcattaccaatagatgagacatttccattggtttgaatttttcagtattacagataatggttcaattaaatatttaagcttttgtgcacttgtagaattaattcctagacatagaacccttatattttgataggtatttccaaatttcttcccaaaatgtttgtatctctttacttccactctcaggtctaataattttcacttggattatcatatttcttacccagcctgttttttacactctaaactctttttcttttctttttttttttgagacagcatcttgctcttggcccggttgaaatgcagtggcacgacgaccaacctgggctcaagcaattctctcaacttagcctactgagtagctgggactacagacacatatcaccatgcccagcatttttttttttttttttttgtatttttagtagagatgaggttttgccatgttgcccaagctggtctcaaattcctgagctcaagcaatccacccatctcagcctcccaaaatgctgggattacaagcgtgagccactgcacctggcccaaaagctctttttctaatagcaatataaattgtcttttacagactatactcatatatgtttcttctttcagaaataggtgttaagtgtatctaacatggaatgtatagctataattctcattgtgaaaccatagcctaatttatttcatattacaatttaaaattcatattttttaggaagttttcttagattaatccgcctagttccaggtgctacagtcccaagatttctttctttttaacaaattaaatataggtaacatgactagaattgtagtcaaagaatattggaaccttggaacttcagtatttgaactttattttgaaatataatttgttatattataaaaatattataatatattgcacctggaagttaggggcagttttttttaattctctttgtatctgctacactgtaaagtgctatttatgtaaaaaattcttaatagaagtcttcagttgtaaagtctgctgtacagactttagatcagggattggcaaactatgagccatgtgccaaatcctgcccttcacctgttttgtaaataaagttttatcagaacacattcagactcattcatgaacatattgtctatgatttattttctgctactatggcagaattgagttgttgcaactgtgtggcatccaaagcctaaaatatttactctctggctctttgccaacccgttttagattatgagcactttggcattattatgtttttgttttctttctatagcacacagtaagatgttctgcccacattgtgcataatttatgggtttattcaaggatttatgcaagtgtagctgcaagaaaaaaacctagaagtgaacttgctaggttgaagagcatctgtgtatgttaaattttgttagctttcgccttcccaaagggattattccatttcatacttaaactactaattttgtgataggacttctttctccatagctttgctaaattaatgcattcacacacttcatctttactaatctgatagagggaaatgatattgtggatttgatttgcatttctttttatgtgttagcttgagcttattttcatatttaaaagccaattgtatttctttttcttgagctatcttttaatgtccttcctgatacatttctgaagtctgtgatactcatataagatatatggtgaacatgtgtcaaagatttatttgactctaatgagggaacccgcctgatgacaaggctgattgagaagaggatgtgtgagatgaagtgtatatcatcagtgaaagaaagcaaattcttacagggcaaaaacaaaaccacaactctaagggttattgtttctactggacagaattcatttgcattttaccagataaaaattactattttcaatttatcttttacaaatcattttctaattttacagagtctattccctaatcagtagtaaatagtcttcaaaattctccgcagcgtcaggtgactattatgcaggctaattgttgacactcgggcttgactttaagagaacatgccataatcttttggccttacttccaagttttggataatttttcttaacacatttttctctaattgcaatgatttcaagtgatattatttcttttttttaaatttttttactatttattgatcactcttgggtgtttctcggagagggggatttggcagggtcataggacaatagtggagggaaggtcagcagataaacatgtgaacaaaggtctctggttttcctaggcagaggaccctgcggccttccacagtgtttgtgtccctgggtacttgagattagggagtggtgatgactcttaatgagcatgctgccttcaagcatctgtttaacaaagcacatcttgcaccgcccttaatccctttaaccctgagttgacatagcacatgtttcagagagcagggggttgggggtaaggttatggattaacagcatcccaaggcagaagaatttttcttagtacagaacaaaatggagtctcctgtgtctacttctttctacacagacacagtaacaatctgatctctcttttccccatatttccccttttctatttgacaaaactgccatcctcaccatggcccgttctcaatgagctgttgggtacacctcccagacagggtggcggccaggcagaggggctcctcacttcccacactgggcggccgggcggaggcgccccccacctcccagacggggcggctgccgggcgggggcgccccccacctcccagactgggtggccgggcggagaagctcctcacttcccagatggggcggctgccgggcggaggggctcctcacttctcagatggggtcgcggctgggcagaggtgctcctcacctcccagacagggtggcggctgggcagagacgctcctcacctcccagacggggcagccgggcagaggcgctcctcacatcccagagggggcggccgggcagaggcgctccccacgtcccagacgatgggcggccgggcagagacgctcctcacttcctagacgggatggcggcggggaagaggcgctcctcacttcctagatgggatggcggccgggaagaggtgctcctcacttcctagactgggcggccgggcagaggggcttctcacatcccagacgatgggcagtcaggcagagacgctcctcacttcctagacggggtggcggccgggcagaggctgcaatctcagcactttgggaggccaaggcaggcggctggcaggtggaggttgtagcgagccgagatcacgccactgcactccagcctgggcaacattgagcactgagtgagcgagactccgtctgcaatcccggcaccttgggaggccgaggcgggcagatcactcgaggtcaggagctggagaccagcccggccaacacggcaaaaccccatctccaccaaaaaatacaaaaatcagtcaggcgtggcggcgcgtgcctgcaatcccaggcactcggcaggctgaggcaggagaatcaggcagggaggttgcagtgagctgagatcgcggcagtacagtccagccttggcaacagagggagaccgtggaaggcgggagtcggagacgagggagagggggagaccgtggaaagcgggaggtggagacgagggagagggagagggattatttctgtatgacttaataatgaatttctaagaaggtcacttagctcactgttgtctcttctaaaacatactcatctttccttttctcttctgtaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacgggtaagtgtttttagtaaaaatttttaaaaacatagtgcataattagatcttttaataatatatttctgccaatgatctcaggctgccaaatgtttacatttaatataagtaaatgtctacatttcatatgtggtacatgtttttttctttttctatgtttaatttttttagtttacttataccctgtaactttccagaaaggatttcaggtagctaaaaaacaaagaaatacaataagaagacaaaataagaaggaaagggaaaaatacagcacaggagttggggggaagaacaagccaagttccagatatggaggtcagcatgattttgggctttgagcagcccaccagctaaggcaaaaaaggaaactcattgcatagctcttacctatggaaaaagaagaaatctactgggggcagatggtcttgtgggattttgctgttttcttttatctcctttcccagcatttgattctgagatatttctcaatttggctcccaaataaagcttattgagtgttgtaatggtttactgttttttttaaaaatggctttaacatataaaagtacaacttatggatcctttttgtttgtggtcgtgacttactgataatgtaatccaaaatacattttttattttgtatttatttatttatttttgagacggagtctcagtcttctgcccatgctggagtatagtggtgtgatattggctcactgcaccctccgcctcctggattcaagcgatgctcctgcctcagcctcctgagtagctgagactacaaacgtacgccaccatgcctggctagtttttatacaaaatacgttttttaaaaaacaattttttttttggaggtcgggggaccgtcgcccattctgttgcccaaactggagtgcagtggtgcaatcttggctcactgcaacctctgcctcccaggttcaagcgattcttgtactcagcctcctgagtagctggaattataggtgtgtgccatcatgccaagctaatttttgtatttttagtagagatgaagtttcgccatgttggcgaggctagtctcagactcctggcctcaagtgattggctgacctcagcctcccaaagtagaaaatcttcttgaaaaataaaattccaaatctcaaaaggccctatataattttggtgttggaaatttacttgtcaatgaaaatgactatttacacaaattataagcttccatattaatatatatgtgtgtgaacctgaaattcaaattttattatattgtttatgaaaggtacagcctctgagattcatcagatggtatttacctttagggcatatctaaaaataaaatacagtacatgaaatccagtgctttaatccagtgattcttaaactttttgctctcagatcccctttaaactcttaaaagatattgaagagctccaaggaggctttgtttacgtggtttttatcaatggatatttaccatattagacactgaaactgaggattttaaaaaaaaataattcatttaaaaataacagtaacaaaacccattacatgttgacataaataacatttttacgaaactatattttcaaaaattagtgagagaatgacattgtgctacatttgttataaatctcattattgtctggcttaataaaacactgctggattctcatatctgcttttgcagtcaatatgttgtatgttgtttttatggaagtatgtgaagaaattcaacctcatacacagataatatagttggaaaagctatgagtattttaatagtcttttaagattattgcaaatattcttctttgatactacactaaagtgacaattgttagtttcttaaagattagttgtaatgtgtactttgaaactgcatcaatgaactttgtcttctgttacattaaaatccattgattttgaatatatgattttgtaacattatgcagtgatcatttagaaaatattgattcactgatttatgtggatcttttaaatgttgacacttatataatataatacaatattttaaaaatcacatttgttaattttacctttgatctattcagaaaagactctaagtattgggaacctatcatcctcacagtgatagatacaagtttcctaaaattctgatttttactggagagctcaaattctatcattggaaacaaatacacatttatttaacttaaaaatgacaggattacttggtttcattattgagaaaatacctgtcaaattcccaagtctggaaaaccatagtttgatgtcactctttcaagtaaaaatggcattccatgtaagaagtgtctagtttattatgcaactcaaataaattacgcaagtgcttttctttaggacataacttcatacatacttccacaagcagcagatgtgtgtagttatgcatagttccttatgcatggttcttatttcatcacacaaaatattaaaaagactcagtgattgagacgtagcagtttttactgcttcatcaaagatgctcttatttgaaactggcataatatgatttatttatttgattttactgggaagcatggcagtcaagaatgtaatgactgccagtacatttgagtgccactgcttgatttttgctatggagtcagcaattttgccactggttttgcattttcagtaaaaatgtcaacacagtgaaaaaggcacataatgtcttgtattattttgtaaacagttttatcttgcagaccccttgaaaaggtctcggggatcctccaaggtgccagtagaccgtactttgaaaatcactattttaatccaaagtgcctagatcagacacactataaatcctgtgtcttgtatgatcattaggtaaatacatttgtacttagaagtatacattcagagacattaacagtattcaggttgggatttaagtatattttaaagtgtggtacctagagagtatccatgacactatgttcataaaattttagagaaaactgagatcaaaggaaaccaaaacaggctggtcatagtggctcatgcctgtaatcccagtgctttggaaggttgaggcagaggatcgctggatcccaggagtttgagaccagcctgggcaaatatggagactatctctacacaacaaaacaaaaattagctgggtatagtgtcttgcgcctatagtcctagctactcggaaagctgaggtgggaggatcccttgagcctggaagttctaagttacagtgaattatgattgcaccactgccctccaacctgggtgaaacagcaagaccctgtcaccctccaaaacaaacaaaaaacacttttttctctgagtatgtaaatggttagtgtacagtccttgaaaacattgcaaatagtatagcaatatatgaagtagccagtatgtgtcctagctaattttatcaatcatctcttcctagaccaatcaaatatttttcaatattttgatccatgcttatatgaacaagattttttaaagctggaaaattccacacatttatatacttactattgttcttaaaattaattttttttttttttttttaagcagagtcttgctcttttgcccaggctgaagttcagtggtgcgatctcgactccctgcaacctctgccttccaggctcaagcagctctcgtgcttcagcaccccaagtaactgggattacaggcatacgccaccacactggctaatttttgtagtttaagtagagatgtggtttcgccatgttggccaggctggtctcaaactcccggcctcaagtgatccacctgtctcagcctcccaaaatgttgggattacaggtgggagccactgcgcccggcctacattaaattttaaagcctttctatgtcagtgcatatacccaacctaattctttttttccgtgaacttttttgttatgcttgtagccttcctaccccagattatttcgaagcaaattgtcattctgtaatttcaaatattactatttcagtattttacaaaatggttgcagtttaattgttgttccttttttatttattagcttgcatatttctatagagagtttaccccacatcaaccatttggattacctgaagtaagggtggtacaggaaagggagaaatcttgaaatactaggttccttagcatcctcaaagttgaccaatgagattttttgcttgtttggttgtttttttctgtgtcttcatggactcatggatttaagtatatttgtggtttaatcatcactgttattattcttattgatgttcatgttattttagattagtgggagcttttttagtttgctatctgtgtccttcgtcatgtccttagataatcctaatcctaatcctgattcatcgtagacatttcccgcagcaaacctggaatcagccatttctcaaggagctctctgattccattgaaggaaaatataatataggtacaatctaggcactaggtgatacttgttacttctgggttggctattgtttctagcctcctaagtttatatgactgtactaatttgaattcataactatgggactaaacttctaattcttaaatctgcatttcctttaagtcatgccaaaaatctgaacatcacaaacatagtcatttcgtttaccccacaatacacacatacaacattgtcagtataacagtaccaacaccatctccaacaatatgcctactgaaaaattttaggtaatctgtctccagcctcccaggtagctgggactgcaggtgcacaccaccatgcctggctaatttttttttttttttttttttttaagagactgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttggaatagtttcttctgtggcattatgttaccagttagatgcacctttgattcatttaactttacttcaatttttaaggtttgctttttagatttagttttgttttattatacatatatgaagtatttccacggttccaaagttaaatgaacaaaacaggcatgttcaaagaagtctagtttctatctctgtcccatccaacccattgtcttcttccccttataagtaataatttacatttttaacttgtggtttatcttctgatttttaaaaatataagcataaatatttatattcctgtcttttagcatgcttttagccatcttgcttttttcctgtataatgctaaatatatctcattctttttaattgctgcagaatttctcattacataggtatactgcaatttatttatctgatgctatgttgatgaacatttaaatgatttccagattttaggaacggtgatgattgaactctctgtacatatatcttttttacttggtacactccatcaagcaactacttaagtgactgactatgatgctgtgcaagcagttatataaagaaaacagcagtgactcagcctgaaaacggcttaatattatcatgttttcttacacattatttttattgaggaaaagcaacatggagtttagtgattatttttgaaagaaataacctatttctaattctaaagaatggttaatatctgtgtttggttgcttatagggtagaaggggtaaaattgcctcattcaacttagaacttaccgtgtcattttagtggggcgttgtgacttcaaatagacccgattcttgaaatagactgggtccatgtcctttgttgggacatggatgaagctggaaaccatcattctcagcaaactgtcgcaaggacaaaaaaccaaacatcgcatgttctcactcataggtgggaattgaacaatgagaacacatggacacaggaaggggaacatcacacactggggactgttgtggggtcggggagtggggagggatagcattaggagatatacctaatgctaaatgacgagttaatggatgcagcacaccatcatggcacatgtatacatatgtaacaaacctgcacattgtgcacatgtaccctaaaacttaaagtataataataaaaaaaaaaaaagaaatagactgggtcattgaattccagctgtagccctccttcagaacagttgagcactgaagtcctgggctgaaaattgactttttttttttttttgagatggagtctagctctgtcacccaggctggagtgcagtggcacgatctctgctcactgccacctccgcctcccggtttcaagtgattctcctgcctcagcttcccaagtagctgggattacaggcgttcgccaccacacccagctaatttctgtatttttagtagagaaggggtttcactgtgttggccagactggtcttgaacttctgacctcgtgatccacctgcttcggactcccaaagtgctgggattacaagcgtgagccaccacacctggccaaaaatatgggtttctaaagcaacagtcctagtacaacagaagagaggtgttgactagttagggatttaggtttagaagtacattcttagtaagagaggtgagacttaccttcttgtgttttagtatagtgagatctggatcaaatctattactcttattaatctcctaacttcctacactatatccagtagaggacacttttgccttacacagtaaagaaagagcctctggactctaccaatgggatcggagctctccaaacctgcatattaaaaggcctataagttttggggggtccctttgtccacatgattattctgtaatacattgtatttatggacatggtattattatacacagatcctgtcttttaaagaacattataatccacttaactgctaggaccagagaatgaccgataattcaaaccatattgtcttacagaagacatatataaaagatggttatgtgtaccaattgaggttcaaatttgattcaatttaaaacaatctaggccagattttatatagtttgtggaccctttgcactcaaatctcaaggttcttattaaaatgcagatcttggctgggcacggtggctcacacctgtaatcccagcactttgggagcccaaggcaggtagatcatttgagctcagaagttcaagaccagtctggccaacatagcgaggcccagtctcattgaaagaaaaaaaattttttaataaaaaataaaagcagatcttgggtaaagacatgtagtctggtttacaggtattaacaactgtctgtaatgtagtgattttgctccagacttaccttttccattatttagttctgaaattactgttctatgtatggtaaatgagaaaaattgctagattctagaactgtggcttctattcatagttggaaaaatgaagcataaacatttctaatttcagatcaacagcaaaaagaaagaatcagcatgggaaatgacaaaaagtttgtatgatgcgtggtcaggatggctagtagtaacactaacaggattggcatcaggtaaagaaaatttttcaagcaatccttttttagttaacagaagtataaactgttcttccctccttccctcaattttttttcaggtaccattggattttaaaaagcatttgtttctcttcttcaaaaaatctccttaaatataagactaggaggcagaggcttccaagtctagtcttggctctatcactttacgtgtttatccagcttggttgatctttctggactcagtttctatatctgtaaaataagtggtttggatcagatgatcaataaagtatcttttgatattaacatcgtaataaatagctaatatttcttgagtgcttcctatgtgttgtacactgttctaaaaacttgacatgtatttaaacctcaccggaatcctgtggtaccagtgctgtcattatcaccattttgcagatgaggagactgaagcagaagaaaagtaacttagtttgactgaggtcatacagtttagtaaatggctaaaccaggatttgaattaaagccttctagctcaagacctatccccttcatcaccctgctatacagcgtggccacaaagtcccaatgtgtgagattttaagaaagagctgttgaggacctgaaaacaaatattaagcactgttataatcactttcagcttccatgatggaagattatgttcagaagaccataaaaattaaaatttttgtggagaataaagtactgataattctaattggcatgcatagtaattttatggcctctgtgtatgtaacccactgatctctttatgtaagaaggacccagatttgaccataaatttgtgtattttttatattctcacaataaaataatcttgatatatggttttctgtaatttaagaaaatattattcctatgagtttcaataattatttctaatggacattaaattttaatgaaattgacatcatttataagtctgttaattaagttatcgattgaaaattagatttgtgaacctcctgccaagtagctgtcttttgaagatattttagtatcttttaaacattgtttttcagatcacaattaatttgaatgatgtaactttttaaaattccaaacaaaaatagcacttttattgtaaaaaataactctttacagtttataactaaaatttgaaaatcttaaatttatatgtagttcataaatgaccctttatttaggagtctcctgctttctacttgccttttaactagattgttctcgactcccaaaaaattgacttaatttttttaccatctccaacatgtttttataggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagaggtaagtcttgctttgtctcaagatgaattaataattgatatagcaaaatgtttccaattcatttaattatagaactaatcacatattagatgattacatacacatcaaatggatccaccctcaacacattgcagcaagaaagaattaagtgcaatattgtttcaagtagcttttttattagttaactgcatagtcatataacaaatcctctggattgtggtgcaaatatatttgagctgtagtagaaaagaagtgatagttattgcagtaagatctgtgtaaagttactaagaagtcaagttattaaaactaatatattactaagattgggaagtttgaattatgaaagtattatcaaataatttagtaaaatcaacctacgtagagatacattgaagataatcagacatttttatttgtggcattacagcatttaaatgattgatttactatgatctacaaagaacattttagaacttaggatgttacatgtatattttttacatgatgacatggatatattttttaaattttgttttagctgaactttagagctaaaaggtatacatttgcggtaagatgagtagtatgctgtttctcacctggcttaattgaattgagtttaatgatctggaaagttgcagcagaatgaaatctgagtggtgatgcaatttgtttccactgtttccaaaaagtggtttgtaggcagagattgaagtatagctgagatgtgttggtaacaagactttagggattaggaaaaagattaaatgtgctcagggttccttggtatatgtaggcattaatttttggactctacttaaatattttgttcatataaagtttttattattgtggaaataaaccaggagacttttacacattttactgaagtttcttttctttctttttttttttttttttttggccggggggatggagtctcactctgttgcccaggctggagcgcagtggcacgatctcggctccctgcaacctccgcttctggggtttaagcgattcttctacctcagcctcccgagtagctggtattacaggcgtgcgccaccatgcccagctaatttttgtatttttaatagcaacggggtttcaccacattggccaagctagtctcgaactcctgacctcaggtgatccacccgcctcaacctccccagtgctgggattacaggcgtgagccaccatgcctggccgtttactgaagtttcttatgacaagcatttgcattagaggtgcaatgtaaattaaattcatactctcgaactattttctttttagggtcctggttcttatatcatgaactacataatgtacatcttctgggccttgagttttgcctttcttgcagtttccctggtaaaggtatttgctccatatgcctgtggctctggaattccagaggtaagccaagtaatatttagtgtcattaaacattattatgatgcttatctttttgaccttagtgataataaaagttggcttttctggagggaggggatagtttgttcataatatgaaaaaaaaatttttttaagtataagctgatggtagacatcattgaaaaatattgttccccatagtcatttggtcatttactgtgaaggctgattttttttttctctcaccactaatttaacacatgactaggcaaattttcagactatttagttaaacatcaagagcctggaagaagtatcttgtgacctaatgttctttgacgggttagttgttactttgctgttatgaccctgaattttttttttttgagactgagtcttgtgctgtcgcccagactggagtgcagtggcgcaatctcagctcactgcaacctctgcgtcccaggctcaagcaattcttgtgtctcagcctcctgaggagttgcgattgcaggcacctgtcaccatgccctgctaatttttgcatttttttgtttgttttttttttttagtagagatggggtttcaccatgttggccaggctggtctcaaactcctaacctcaagtgatcacccgcctcagcctcccaaagtgctgggattacaggtgtgagccaccacacgtggctatgaccctgattttgattcattcactttttataattaccttttgattagataagttaattattcttgaatttggccattttatgctttgagaaagtagttaatcacagtgggtcaacagtacaaacttttgggttttatttttcatcacaataaagtagagttatacataggattgattgaacttgatttgaacttatctcttctcttttatttttctgtagttaaataagttaccaactttttcctaatacatttctttttaaaatggaattgtattgatctttaagtttgtattaagaatatctttcataaaaagcaatatcatgcagtatataacagttgttactcattcttgatacataaaaaactattgcacataattacagtactcagagaaaacataatattcttatttctaacataatgtccaaaatatatttaaaatattatgcttatttttacaacagaaatattcaaatttgccctttttttggttatgtaattataatccttataattaaggtctgtattcattttaacatggcctgatattttgattttgttcctgagatagtgttgccctctctcctttcttgggtagagaattagattataatatcaatttattatatgtagcataataggcaaagttttcgaaaaattaactgtaaatttttctgtagactgctaaaatttgcaaggttgtttttgtgcataaaacaagaaaataacttggattcgttacattctcatgtttcttaaaggacattaagctgccttaatctttgccttgtagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtaagtgtcttttgtagttaatttgactgaaaaatatatattatatagtatttatttaagtaaagaatttcttagtgtaaaaataataaattctgtattcagataaaaaattttgagatttgtgcttctgtttttcctgaataatctataacatctttctagaatccattcccagtgctgctcagttcgtcttacattttagagaagctttagatagacagctggtgtccattgggtttcagctgcatttcacgaagatcttcctgttatcactttaccttacatctttcctcttctgaagtgttttctaagcttagctttgtttttcactcttactttcaacattaagaggttgggaaatcttaatagctatgttttcctcctggaggcagtgtctggtgccagtgtaagtggtgtgtgatatgaaaaatgctatccagtgctatggggaagttctgagggcctttagaagctcttgaagtttaaatcagaaattcacattaaagagattacaggaaatccttttcatttgattgtttaaggcaatttcctttaccatttctttaggccagcctgagatcttctacaagaccttgaaaccttatatatattatggatttcctctgatgtttccatattgctctgggcattttcctgaatcctttatattagctctagactttgggagcccagtcccttcctattttccaaatctaaatctacagccctagatggtacagagatctttgagtttttaagatatgattttttgaaaaacatctcattaaatactggcagaaccttttcatcttgttgagttttttaatgtactgtaaccaaaaaagtagaatattttatcaaactgtttaatcttcaattgaaataattctagtacattttaatgttcgcattaaaatattgtccttgcattggacgtagatatcccaaaagtggaatacttcagattgtcgtagtttcatctctgaataattgtgattccagtactttataacaaaaatagctagcattattgattactttctgtgtatctggtactgtggcagatactttacttggattttaatacttaatttcacagtaatttagtaatatggccctgttatcctcatttagtgattagtaaactagggctgaaaacagctaactaacttgcccgagactacatacctagtaagtggtggaacgtaggttaaaattcatttttctttgacttcaaagtctgtggtcttacctacttacattactgcccttacgactatgtgggtatatatttgtgtgtgttcaaaacaaactcaaaaccatcctgtagcgtagcaagttagtggctaagatgaagctagagcatttgcctcctcaattcaattccattactttctgttgtacctttatattttttggtaagacttttacttattctaagttcaaaaaatgtaatttattagatgtttgagaaattaagtttacctaaattttaatgttcatactgtagtgattagttaatgtttaatacgttgttattctgtcaccttagtgtatatataaatggcaagaattcacggttagttgaaagcattaaggtcccatagttttgtgtagacaagaggggagagcgttgatatttttaaattaaatgcttcttagatacgtatgaaatggattaaaacatgtatatgagttatagatacctaggtgttagtttggttgtaaattcaggatcaggacattcaaataaatatgtttgctttcctcttagtggaggaaaaaaaaaagaagctaaatttgctccctttcctccccaaataagcagagtctacattttaatgccaacaatttgattaaaacaaatatttatttatttttaattcaccaaacttttataaagtatttactggtgccaggcactgttctaaagcactctgtatatatttactcagtccttaagagctaagtaatattatcacgtttccattttagagaaaactgaggcacatataggttaggttatctacccatagccatacagctagtaagtagcagagccatgatttcaacacagcagcctgactatggagttcatgatcttaaccatttacagcttaatttttattatttataatttctcttctggaaatgtaacaattgaccatttgaagaaatactttaggtagctttggatatttgctgtattaaagtagtgaaagtaatacagacacttggctgggcgcggtggctcacgcctataatcccagcattttggtaggttgaggcaggcagatcacctaaggtcaggaattcgagaccagtgttgccaacatggtgaaaccccgtctctactaaaaatacaaaaattagccgggcgtggtggcaggcgcctgtaatcccagctactcgggaggctgaggcaggagaatcacttgaacccaggaggtggaggttgcagtgagctgagacgacgccattgcactccagcctgagagacaagagagaaactctgtctcaaaaaaaataaaggaatacagactcttagaaaaataattacaaataaaaccctagtgaaattataggtatagttaggtatagttggcttacaggtgggaagtagaccattaccaactgatagactggggagctggagagaggacacggaagagtgtccttggatttttcttttcctttaatttttttgtagaggtgttggttggtgagactgtaacttgaggagctgttgtgtgtgctttcagaatgaggctctctagattgatagtattttagcagtatttcagaatgcatagggtagtgaaaatatagggaatcttacaaggtcttcggttccctgcatatcttgctacgatttggaatagagtatttatggtggagcagttagctctaaaatttgaagaaatgatatcctatttaaaaatagctccccatcccagttactgccctcccctcttacctacacaaacatacgtcttgaaaattgtctatattcattgcctcctcctctttacaccctattcacattagtatatctggcaaaaattttttttaactgaatggtaaatgcatgactgacctttcaattaaagccaggagaaagaaacaaatcttaatagaagaaatgaatagttaccctttgcttagggagcaaggaaacatgcaagttaaattcagaaaatccatttggaaaattcaagtaacatgaagaatttttatttggtatgtttgaatttctatgaaattatgaaataagccatatcctctttctaggtgctatcagctgcctcagctgcaggggtttctgtagcttttggtgcaccaattggaggagttctttttagcctggaagaggtaggtgaaaagaatacaacaattaaaattatatataattaccattacaaatatatttcacacatttcagttttataggtgatgtaataggtagagactttgttttcaaatttatttttctaaagttgttttccactcattcttaataaaaagtaaatgttattcatgctccatacctggaggaaactttttaaaaatttattaatgtatgaatgttagtaattatttaaaatctaactttgttgacatatttaaaagtaagaagatgtgaatttgacttaatagaggacatgtgaaacaatctatttccattggctaaattctgtatttttagtagagatggaatttcaccatgttggccaggctgtttttttgtggggtttttttgttttgttttgttttgtttttgtttttgagacggagtttcactcttgttgcccaggctggagtgcaatggcgcgatcttggctcactgcaacctccgcctccagggttcaagtgattctcctgcctcagcctcccaaagtagtttttgtttaaaaaattttaatcaattcctatgttgtgttttaaagtttttcccatgtgattatttctgatacagttagtgatgttaaagaaaataattttagtgacttcagtggattattttgtttttgttttcttaataggtgtttaagacttttctttttacataaaaatgtaaccaggaatttttttttaattttttttgacaaataataattgtttttgtttatggggtataatgtgatgtgtctatacatgtatacattgcggaataatcaaatcagagtgattagcaaatccctcaaatatttattatgtccttgtggtggtgagaacatttaaaatcctcttttagctattttgaaatatataatacatattattaactgtggtcatcttactgtgcaatagaacaccagaacttattcctcctctgtaagttcatacccgttgactaatgtctcccctttccctgttcacctccccaacccctagcctctggtaacccctattctactctctacttctatgaatttaactcttttagttcaagatgtttttaaatgtacttttttcttttagttgtttgtattctttttttttttttaatgtagaagaggcaaattaaatgcattataagttaacaggagttggtgatggtacatttatttttaactaccatgattgaattgaatgtgaaactcattttgaatataaaacagcactaggtattctattagtatttattagacatttatgatcaattgatactgtcaatttgtaatgatgatcaccatctccaaaaataataataacatcaatttttcttattacagtaaaatccattacatgtaaattctaactacagcaaaatttagagctaggatatttaccattcaagttataatatatcagaaacatcttataaaattatagcattaatttttcttttccttttcttttttttaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggtaagtgctaatgtgaggtgatatttgggtaattttggcatgttcaaaacttatatgtggaatgagagaggttgttgtttcataaatgactgaaaaaagtacttatcttttgagtttaattttaagtaatgaaaaagataattccttagcatatattgttgaccatgttatctgttgctatttaacaaattaccccccaaaacttagcagcttaaggtaactacttattttgttcttgatattgagtcaacgacttgggaagggctcaactgggcaatttttgcttgtggtctttcatatagttgttattagacatggcgagggctaatcatctcaaagcttctttttttcgtttcctttttaaaaaactgtttttgtggatacacagtagctatatatagttttggggtatatgaagtattttgatagaggcatggagtgcataataatctcagggtaaatggagtatccatcacctcaagcatttatcccttgtgttacaaacaatccaattacactcttaattatttttaagtgtacaattaaattattgaatatagttcaaagacttcttcattcatgactagcacctaggctaaaaaaattcagacacctgggctcctgggatcaatcacgcatactgtgtctcttgtgctcactcccgctgtctctctctctttctctcgcttcctttttcctctctctctgtggttttctagggtggtggcctcagggaattggatttcttatattatagctcaggattcccaagagggctgtttttaatgtagccaaagaagtcttgcagcgtgacttgttttattctattcattgaggcagtcacagaggcccgaccacattcagaggagggacatacacttgctgggacaagtgtaagagaattcatgatcatgttttaaaaccacttttattagtttcctattgctgctgtaataaattaccacaacttaatggcttaaaagccacacaaatttaatatcttacagttctgcaaatcaaaagtctgaaacggatctcactgtgctaaaattaaggtgttcgtagggcattctggaggctgtaggagagagtcttgttttttgccttttctggctattaaaagctgccagcattccttggctcctggctgtctatttgcatcttcaaagccagcagtagctggtcaagtctttctcttgtctcatcaccctgacccaaactctgctaaatctcccttccacatttgaaaaacctttgtgattactttaggcccacgcagataaatcagaaaataatctcctttttcaaggtcagttgcttcgaaactttctttctgccaccttgattcctccttgccatgcaacgtaatgtaatcacaggttctgggaattaagttatggacatctttgatgagccattattctgcctcataccagtatagggtattagcttgaaaggacactgcagactcagttaaattactagatctataaatacatgcctttttccatcaagaaattaaggcagctgggtcttatgccctgggacattgcttcttttggatttataaaataacaaaatttgttgattaatggtctatcagtaaatataatttcttatgtgactatcagtgatatatatggggaagcacatatcagcttattcttgttctttaaattactacccctgtacttcatgtaatagtatttgctagtgatgatgtgcttttacagatgtaaattaatgtggaataacagctttgtttctacaaaattagagtggttttagtttttgaaataaggtctcttttctcttgtcctaagtctgtagtccactgagtatctagagttaaataatagaaaagcctggccaggcgcagtggctcacacctgtaatcccagctctttgggaggccgaggcgggcagatcacaatgtcaggagatcgagaccatcctggctaatgcggtgaaaccccgtctttactaaaaatacaaaaattagccaggcgtggtggcaggtgtctgtaatcccggctactcgagaggctgaggcaagagaatcacttaaacccaggaggtggaggttgcaatgagccaagatcacaccactgcactccagcccaggcaacagggcaagacactgtctcaaaaaataataataagaagaaaataataatagtaatagaaaagcctaaacattttacctttttttcttagggaatcaagttaaaagagctgttaaagctctttttcctacaataagtaagtgttgggtaaatcccaactttctcacagtcagttgaactacaagaagctggaggcaattggcaggcctttgttaagtcccacctttgactcagctctggctgaaggatcatacctggcaagagagtgtaaaacacactttgattttttctattgtttatccttttaatgatcctaagagactcaagagtacatgccatcattttgtgtttggctcatttcatattcagaggagtttattactctttcagtagtttgttcgtttgtttgttttttgagacaggatctcgcctttttgcccagactagagggcagtgttgcagtcttggctcactgtaacctccacctcccaggttcaagcgattctcctgcctcagcctcccaagtagctgggattacaggtgtgggccatcacacccggctaatttttgtgtttttagtagagatgtgattttgccatgttggccaggctggtctggaactcctgacctcaggtgatcctttgggaggccttggcctcccagagtgctaggattataggtgtgagccactgaacctggcctctttcagtagtctttaaatgatcttgcttatggtgcttcttatccctgtttattatccttattaaatttaatcaataaatatttttctctttttaattgattcatataaatagacttacctgagagatataggttcagttcagagcaccacaataaagtgaatatcataataaagcaagtcacataaaagtcttagtttcttagtgcatataaaagttctgtttacactatgctgtagtcttatgtgtacaatagcattatgtcttttaaaaaagtaatactttaatttaaaaatacttgattgctaaaaaatgctaatagtaatctgagtcttcagtgaattgtaatctgttttgcttctgtagggtcttgccttgatattggtggttgctagaggtaggactggctgtagcaattcttaaaataagataacagtgaaatttgccgcattgattgacactgcctttcatgaaagatttctctgtagcatgtgatgctgtttgataccattttacctacagtagaccttcttttcaaaattagagtcatcctctcaaaccctgctactgctttatcaactaagtttaaggaaaattcaaaatcttttgtccttttaacaatgttcacaacatctttaccaggactggattctacctcaagaaaccactttctttgctcatccataagaagtaactccttatacattcaagttttttaaatgagattctagcaattcagtcacatctttaggctacgcttatcattctagttctcttgctatttccaccactctgtagttacttcttcaactgaagtcttgaacccctcagagtcattcatgagagttggaatcaacttcttccaaactcctgttaatattgatattttgacctcctcccatgaaacgtgaatgttctggatggcatctagaatggtgactactttttgaacattttcaatttattttgcccggatcaatcagagaagttgttatcagtggtgggtttccaagttgtcaggggcgaaccatacagatcttcagcaacctcaactcttgccttctcagaggaaagaattctacggagggacataaggcagaaaaagagactgaggcaagttttagagcaggagtgaaagtttattattaaaaagctttagagtgggaatgaaaagaaattaaaatacacttgaaagagggccaagtgggcatcttggaagacaagtgccccatttgaccttggacttagggttttatatgttggcatacttctggcatcttgcatccctattccattgattcttcttttggggtgagttgcccacatgctcagtggcctgctagcacttgggaggggagtgtgcacagtgtatttactggagttgtatgcatgcttacctgaggtgtttgttgcttaccagccaaatgtccctaggaggtcatattcataaactccatgattttgcctctaaatgtgcatgcttgagcccactcacccaactcctgggatcttatcggaaagctgccgatcgctagtttcaggtgtttctatctattggaagatggcctttccctgatgctggctgcaaccaattattactttagagagagagcatgagagctgtctcaccatcatcacctgatggttgcctgacattcctggtggggttgggaggatgcctgtcctgccctgctcatgcctgactagctacctgctgtaacaaaagtactatctatggtagctgtagccataggaaatgcatttcttcagtaaaacttaaaagtcaaaattagtctttaaaacaacatgaatctccttgtacatctccatcagagctcttggaagaccaggtgcattattagtgatgagtaatgttttaaaaggaatctttttgtctgagcagtaggtctcaacagtgggcttaaaatagttagtaaaccatgctgtaaacagatatgctgttatccaggctttgttattccatttatagagcacagagagagtagattggcataatttaaggattacttaaaaaaaaagtctttgattactctcaaaaaaaagtcacgtctctcactttatatcaacagctaaaaatggccaggtattgtggctcacgcctgtaatctccatgctttgggaggccaaggcagaaggatcacttgaggtcaggagttagagactaacctgggcaacatagtaagacccatctctacaaaaaaaaaaaaaaaaaaaagaaagccaggtgtggtggtgcacgcctgtagtcccagctactcacgaggctgagtcggcaggatcacgcccagccaagagacgtgacttctgctttcagttgtacacttagagaccattgtagggttcttagttggactaatttcaatatcattgggtctcagggaatagggaagcctgagaagagggagagacaggggaacagccagttagtggagcagtcagaccacatacaacacttattaagttcactttcttctatgggcatggttcatggtgcagtaaaacaactgtaacaggaacatcaaagatcattaatcacagagcactgtaacatataataatagtgaaaattttcaaagtattgagagaattagcaaaatatgatacagagacacaaagtgaccacatgctgttggaaaagtagtgctgatggactagcttgatgcaaggatgtcataaacctcaatttgtgaaaactgcaacatgtgtgaagcacagtaacacaaagcatagtaaaacaagatatgtctgtatatcagtcaaaatattgggcaactctgataagtttgtccacttaacattgtaccacttaagatgaatagcatctaccatttccgtcatttgtaaatatataggaggacataatcacataatcttgaagtaaaagacagtgcttaaaactgaatcagttaagttttatgaaaaatacttcatattgtacttttaaaaatatatattttttaatttcaatagcttttgggttacaagtggttttggttacgtggatgaattctataatggtgaagtctaagattttactgcaactgtcacccaagtagtatatattgtatccagcatattgtccttttttttttcttttttttttttcatttcaccatggactaatgaaaattttgttagggactgacattagggcacccttgagctaccttgagctaaaggaaataacccttgaatttttttctgtttggcctagagaatgtggtttgttttgtaactgaattcatgggattgttaaggtacaagattttgctttagttttatttgtactaggattttgctatattaatacaatgtgaaaagaatcaaaagtgttagaaataaatgcatagaatgtaagtttcaggcatgtgagtagaggatctctgctccataaagagttctgttgttgttataggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtaatatggctgtgtctgcctgtgtgtggatgtttgcaagtctgagagagccaagagaaagtgggacacattcttgcttaattggtgggcggattggttgagtaaaggagggtgccaggaggagatgttttaacagataagaaacagtagtactattagggtattatacagtaccggttttctgtcttacaacatttgttaatacaagaatttaatggcattagcatattgtaatataacttaatacactatggcagaagccatctaagtacaacataagcttaatttgaatcctgaccaaagatgtctttgattctttcatcgttaaggatcttggcttacctataacaactatagcataatacctaagattagcattgcaacagagtttcagagtaggtttactttggttctgaaatgatttattgttagccttagtaaaagatgtatttacccatgctccatcatctaaggtatatttgtaacaaaatgagaaaaggtaacttcattttaatgagaagaaaagcaaaatacctacattaagtacttgagtctatttaatgtctgttagggcaggaaaaaatggttattgcttttcatatttaaaatatcagctacactctggtgataatattaatggttgccattttgaccagttttgtttagtgaataaaaattatgtgattattgatctttaaaaatgtaatatcaattaaaaggaaaggacagactcattttcaccaaagtagcaagtatttattaaatgtccactttctttttagcattgtgctagatacagtgcataatacaaaaagaacatggacccaatctcgactctaatcaagttgaggagacaagatgaacactgagaatacaatagtgaggaatactaacaaatatatacaaggttaaaagagtctaagtatggtaggaatataggggaagaaagagctgaagtacttcaggaagagtagaacatgagctttatttaaaagattagcagaatttaaggaaaaggtgactttgttgaagattataatgtgaagacaaaggaacgaggatgggaataaattttgtattcatgaggctttgaagaaattgactctagagagtatattttgggtacttttgggaaatgaagttggattagtgagaaggaacagattatgaaaagacaagaaacctgattaatgtcaggatgattttatatttgaagttggtcagatttatggcagtcctggctttgccatttttagtttgatgactttgagaaagttccttcttgaagttttaattttctgtatataaaaagtaataacacctggtgatctgctaggtttgttttgaggattatatgagataaaatgcatgcaaaactgttataatagtgcctggtaaaataagtgcctagttttaaaaacaagtctttgtaaactgcttaggacatgcctggtatagggtaggtatgtaatacatagtaggtaggatctgtctccttgctatttttaggtaaaaaaacaaaaggaagagcttcagcttaatacagtatgaactgacgagccctggtaggtttttgagcaaaagagcaacacagtaaaagtagtacttaggaaagattaacaagggaacatggcttatacagtggtaatggggcctggagtcaaggaggtaagataaaatggtattataattaaggaatagccaggcacgatggcacatgcatgtaatgccagctactggagaggctgaggtgggaggatcatgggagtccaggagtttgagaccagcctgggcaactgagtgagaccccaaatcctaaaaaatacaaagtaaaaaaggaataaagtcatgagggcttggactggattgataacagtgagaataccgagaaagggaccataggcagtgtgaacgcagctcactgcagcctcaaaccccagcccaaacgagcctcccacctcagcctcccaagtagctgggaccacagacatacaccaccatgcatgactactttttttagtttttacttttgtagagacagggtctcactgtattgcccaggctggtctcaaactccttgacttaagtgatcttcctgccttggcctcccaaagtgattacaggcatgagccacagtgcctggcccaaatagttttctgtgagtgaatattacttgcatcgttaatgtaaatcaaaggcatcaaagtattttactctttttgaaaaaaatttagaggagaaatttattatattaatattctacccatatatgagtttaatttgtaaattgtagcaaagcatgatgtgctttactaaattcctttataattagaataagcttttataagggtgaaattatgtctttgctacagcactaaaccaaaatggcaaaattgttttagtcggtaagctttgcttttttaaaatatgaaataaacaggtttttaaaatgttattttaatagtcttctctgttataaacaaagaaaattggtgtttctctagagcttattaaaagtagtgattattgtcctaaaagaggagtagcagttttagatgctaatgcttttccctgactgagttctatttgccatttagttttaactgcctagtgcaaaaattctaataaaatgtaatgatgaggatcctgtccttcctgaccagtgggtgcttacttttttcaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaataggtaccctttcaaaaatatatatatgtatatatgagatggatttctggaagaaaggaaagcaataagcagtaacatttaatgggttggatttgtgggggcaagggacattattttatgtcccttaaaatcttctgttctttaggaaaggaaggtatgcttcagtggatgattttctgctatttagcagaaaatctgtatttcagttttgtcttttgatctggcattgtaccagaaattggagtcagattattttcccactcagataagcctagataagttgatcttggttattcaaaacagcatgtaatataagaccttagctaaatgcattcagtcaaatacattcttgtatttaataaagttggcttattggaatacaagttattgaaaatctcatcttcatcagtctctttcatattagaataacactgttttgctttatcagtctttggggttagaattataatattaatttataatatctgatttaaagtgacaatcactgagatttttatttctgatcaaatgccaggttgaaaaagtataacgtatcagtcctgttgtgttttatgcagactttcctgaaaatactgtttaaaggtattagccatagtgtatttcttggagataaattaaactttctatagttctgtttctctaaaatttgtttttctctttaccttatagtcccgcagtattgatgaggagaccattaagacttaatatttttttgacacaatcttatatctcttcctccaacccctaaaaagtgactgaggataggtacatcaagccattgctttgttactccccaggttttagtgccagaccctgaatggaagtgtcaagcctttggcctgtctgaaaggtcattcctgtgagcatatcatctcccttccagcttacctctgtggccattgcaaaaggatttaaaaataatttttgtgccatttgaatggcacaagaccagacagtgtatgtgggggagtgtttctcaaatcaaactggaaactctttaatttgtaagaaccattaagcagagagagaaaaaagaaaggaaaagaaaaaagatcctacagagaacaccctgttcagtttgggaacaggctacagctttggatttttcaaggcctagcattcccatcattctaaattttacttagctaatacaatagtagttgccagagctgatgacatagtattttgtcatgcttggctccgttcaagcattttagttttttagccattaccatggctagacccagtcaaaagaatttcattgtttaagattcccattctctagtttttactagtagccagccaaagaaaagaaaaaggaggtcagaatttcggtatttacatagaaatttaaggggaaaaggccaggcatgtttttaaagtgtggaaattaagaactattcattatcccactgattgtgtggatgtgttttttaaagttttgttactgtcttgagagagagaatattgagataggacataatgttggtttaagggaatgagggtactttctgtaggtgaggtgccaagccatgtcatcagaaatgttagtcacatgactttctaagcacaccttaaatgttttaccgtgtatgtttttgtaaagttttaaatttttaactgggaaaaacagacctgtatattaagttttatatatatatataaatttaaaattacatatatatgtttatatatgtaacttttatatgggagagatatatatttctatatcctctataaaaaaacatatctatatatgaaaattatgtacgtaaatgttaatttataattaattatataaatattaacataattacattatatatatagaaaacctagtgtacagatctgtatataaattaaaaatgtatgtgttatatatagttacatcatataatacatataattgatatatataatgataaatactttattgaaggatgaaaaaatttccatgctgtctcataaaataagatggttgacatatgctaaactagatagattctcctgtttcatactaaagcagaatgttgtaaaatattaaatccaaatgagatgtctcagattaaggccatttcaacaggaatgctgagactttaaaaaaaaaaaaagtctgaggctgggcgtggtggctcatgcctgtaatcccagcactttgggaagctgaagcaggtggatcacttgaggccaggagtttgagaccagcctggccaatgtggtgaaatcccgcctctactaaaatacaaaaaaaatacatgggtgtggtgacgcatgcctataattccagctacttgggaggctgaggcaggagaatcacttgaacctgggaggtggagattgcagtaagccccaccactgcactccagcctgggcgaagagcaaaaccctgtctcaaaaaaaaaaaaagcctgaattatatcagcaaatgaaaactgtaatgttgttctctgtttcagaggcccttgaatgaatagcactaaaaatattttttaaaaaatgaagaaaatgaaaattgtaatgttccttatttaaaaggcccttgaatgagtagcatcaaaaatatttttaaatgggaggccagggtgggaggtttgtttggcaccaggagatcaagaccagcttgggtaacatagcaagacctttgtctctaccaaaaaaaaaaaattgggtgtggtggtgccacctgtattcctagctactgggaacactgatgcaggaggatccctgggactctagagtccagagtgagaccctgtctctaaaacaaacaaacaaacaaaaactgtatttatgtaaaagtaatacttgttttttaaattttatttatttttaattgataaaaattgtatgtatgtttatgtgatgtatatattgtggaatggttaaatcaggctaattaactcagattttttgtgtgtgtggggagaatatctaaaatccctctccttagcagtttccaaatgaaatgaaagaataaaagtgatttatttttttgagacagcatctcaccctgtttctcaggctggaatgcagtggcacgatcttggcttacttgatcctcgacttccctggcatccggtgatcctcccacttcactctcctaattagctaggactacaggcatgcgccaccatgactggctaatttttgtatttcttgtataggcaaggttttgccatgttgcccaggctggtttcaagctcctgggctcaaacgatccacctgcctcagcctcctgaagtgctgggattacaagtgtgagccaccacacctggcgaaaagtgttatttttttaaatgacaaatttaagtcaaagagattgaatgttcacttctggtactttgtatataagagaaacattccattaaataattttttaaacatttctaaaattacatattttgtcattaaatgtttaaacaatcagtataatttcattgatacagtgtttgttattttgtcggtgtttaagattgataattggggttagttttaattcagaatgttattctatttaatgtcacacttcatgtctttttattttgtatatctattaatgaattattttagctatagttattactgttttagagatgaggtcttctatgttgcccagggtagacttgaactcctgggcttcagcaatcccctcctcaacctccggagcacatgagattagagacgtgtgccactgtatctggcctgctgtagttatttttaattcttttgtctttcaacttttatactagagttagaaatgatttacaaaccctattgcagttttagagcgttatgaatttgactatatatttcttataacaacttaacttcagttgcttacaaaaactacagagttttactcccccgtccacattttatactattgatgtcacactttacatctttttattttgtgaatccattaatgatacttctggtagtttttacactccactattcagttgtcagacaccattcagttgttagattgttatgagctaaaagcaacttaatgggtatttttcaaaaatcatttatgtcaattgctaatggacttcttttctatgccatgatcatgctttttttatttttgagacggagtttcactcttgttgcctgggctggagtgcaatggcgcggcctcagctcactgcaacctccgcctcctgggttcaagcgattctcctgcctcagctgggattacaggcatgtgccaccgtgccggctaattttgtatttttagtagagacagggtttcaccatgttggccaggctggtctcgaactcctgacctcagttgatctgcccaccttggcctcccaaagtgctgggattacagacgtgagccactgcgcctggcctgatcatgcttttaaggtggttgagtaagtactagttgctggggctttacttagtgccctcctactcaaatgtgttagaacatagttaagaaggctgtagtgttcaaaaggagtaaaaagcagtgcagtgtttgcagtaatatctgcttctcaatttaggactgatgcttattatggcttaaatgtttttgtagtaaaatttgtattcaaaaaatatatttttttttctttttgcgacagagtcttgctttgtcacccaggctggagtgtggtggtatgatcatggctgactgcagccctgaccttccgggctcaagtgatctttccacctcagcctcccaattacttgggaccaccagcatgcttggccgattttttttttttttttttttttgtagaagcaaggtttccctatgttgccaaggctggtcttgaactttagggctcatgtgatactcctgcctcggcctcccaaagtgttaggattacaagcctgagccaccatggccggccaaaatattttcactataacaaatatcatatctgtatatactcagttttaatactaactcaaagtagaaacataaagctgaatgactattttattttcagattctctccattgagtttccttctccgtcttgtgtgatctctgaacttttctccatctttgccacttcttgtctagcattttttttttatcagcagtttcattcagattttttttttagttctttcaacggtggagtggaagtaggcagcaggacagaagaacttgaagcagagcacactggagaggagaaattaacaaagcctttatgaataaaacaaccccccaatatcagtctgtgtgcattatgagcataattgtactttcatctcatctgtaatgttcatgacttttctagaaaattatactttaacatgagaaaagaaaaagaaccagctaattcatagggatggaggacacagcatagtcaaagcaagaatgaaactctctttagtgccacctccagtgcagaataagtaacattcagcagaggcaggtttcatttgataatggattcctataataaactgcgctcagaatttgtgcaggttttaaaatcccgtattccaaacccacttccttagcccccaagttagaaaacagcttcagtaaagaaaattgtacgatgatataactttaccaaaaaataatttctttccatgaagatgatatattattgttgacttctaattcaatcaaatataaacaattgctaaatggcttttcagttgactcctttcttggttaaggagaagataggaaaaaatgaagggatcagaagtcataggatacattaattttttttatctctgaataaacaggttgcctacttaaaaatctatcagtttaaaagtgttggtctcttctctctcttttcagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggtaagtctggtaccacaggaatcagttcacttgctagaatataggatcctttttagtggaatctatatagttattaggggagcatgtgagtcagctcccaggtgggaaagtctgtcctatggtatagtcacaaatataggatcagtcaatcaaatttcacatttactaaggaataagaaagatgtcatctgcctgctctttgccaaacagtgacatttgtaaataatacctcaaagttggaaaagaggtgctgaaagatctccagcatgaaagcatgttgagcttagagtgcttcttttcctagggaagagtggacctaacctgcatggagcactgcaaaaacctgttttatttttgtaaatgtttcatttttagtatataaatttctagtacaataataagtttctagatattttgctatttactctttcagccaatatttgatttatcatgtaatgaaggaaagaatatatacttaaatgaaatttgtaaatgagctaaaaatctcctttaacaaatgctttgtttccttttgtctacctttctctatacacaaatcttttatatttatataactgctaaggacaaataaatactcatgtatttaaaatgtatacattgataatttatttttccaccttttacacatgaactgccagtgtttctccattgacaggaatataggaaagaaacagatgtcacgggggttgtggagaccttaatgcacagaattgatttagcaaatacactacttcgtcaccactgctctcttttcctggacctgggatctgtttctccacacttctttctttaggacccttcatttccactatatattctttcttgttgaacttaagaatgttgttttatccgaaggcaaataccaaaaaacagagggtattcttggattatgcataaactggatggctaatcctgaacagcgtaaagctggttgaaattctaaacagagaatcatagcagttttttgttgttttttttttttaacatgttgtagaaaacacattggtgacagaatacatgactcctgtccagagaaaggagagaaaaagaacagaaaggaaggaaatttgtttattgaacaccttcatattttctcatttaactttgcaggacctctgcaaagtaggtagttatatccctactttacagatgtagtaattaaagctcaagaagctttaataatttgcccaaagtcatgtggtgaacaagtcatggttcaaggaatcagactgtctttcctactttaaaacccagcctcttgctactattttgcactgtaagtgactgatagaaatcctctttctttgtgatttcttaaactactaaaacattttcttggccaatatattagattgagttaagaatagaaatatgaaactagagaattagatctatgtttagtgtttttcactgcgctaattaaaataactctttaggaatatgaagtaaatcattaaagagataaagcccttaaaggcagggagtttagaattattaaattctaataatttagatactgattggagaagagatgtattcataagttattattgttactatttgtctttgtgtaatattgtttgattaaatgatggcaccgacttcattaagtttaaaaactcagtactagttaaatggggcaacttttcataaagctttgctagtccttgagcccttttatttgttaaatggctcaactggaacctaagctgagttgttacaaactattatttgcttcaagttgttttctgttcctggcatggctttttcttttgtgtactgacaaatataaatgttattctgttgagttatggttaactatgaacacagaactgttagggattaattttcatatttcagtttgttgattaattcccaggtatttggcagcatagatattagaaaggaaaatatttaaaagaaagtgtaaaaataacgaagtgtatagagcgaggggtggatagctaattaaaattttgtctggtcctgcctgttcatatgaaaaaaggggttggactttcttctaagggaatatattaaattgctttcatcatattttccttatttctgtctgtcaaggaaaataaattgatacatatatggggagaaaagagatcatttagggaagtggctcatgggactttttgttttgtttgaagtgtattaggaagtcgggtgttttttttctcacttaaattatttaaaacccagaaaagaaatgatatcttctggtttttaaaggagaccatgaagttctgcatagctatcattgatgtgtagttcatactgcatttttagaagtggaaaatagttatttggaggaagataacaaatctggaaccttaggtgcaaggagaaaaagaatagatgaaagggaaagatgtttgtaaattataaaaatttcaattagctattggttttctgcactttatattttaactgcagaatttttcaaaatcagttaatcttggtggaattagcaggatgttaataggagtgactcagaaaaaacattttgtgactgtctaagtttggaaagtattggattaaatacaattgaggtttctttactatggaactcctcagaacttataatatgttgatattctttgattcccagatgaggggatgggtaataggatacatggttttccagacttgtttgaaaatgcaactatttttgggttgcagggaaggatatagtagaactcatgggaactggtgtttcttggaacatgctttggaaatgctgggttatgccctgttaactcttacatcattagtttttagcccaaaaggaaacagcaaataatgttttatatgagccacattttgcgttgattttccttccactctgtaaaattactaaagcagcactctgactttattatgctcaaatcgctcttctccattaatgtgtgtttctccatcttttagggtttttactttataaatacagagattactgtgtaaaattctaaatttgccactgggtcgttatacatttgtaaccttcctcacagtatattttgtgatttggcagagtttaccaatatagatgatactaactgaaattaatcattctgtataattggatagaaaagcatgagtaagaattcaattggtattatatttaattaattgccaagattttcacatttcctgactacaacaataaaatcaaatgaattgatggcttaaaaaaaagaaatctcaaatgtttagtcaatgaagaacatctattgaatgagtgaatgttcattatatatagtgcattttctgagcttttttggagggggaagttgctcccatgctctgagaacttttaaggatcgatacattatttttaacataataatgagaaaacatgagcagagaacccatttctgtcattcccattctctatcctcctgctcccccacctcccaccccagccatcaagctaagtaactattttacacctggacgtagctataggaacaggctactttgaagtctcctagtgacatccttcaagtctgaatgttcaaaggcagtttaacagggaggttgacttaatgagatcatcaaggaaatgtccagtcatcctgaagggtattttggatgggcttccagaatttaaagattaaagtttttttaaggtttttttattttcactgtttatattgccacattaatttccattataaaaccagtaaccatagttttgttttaattagcaatctaattattttcatgtatcctcattatgagaatttatgtccatcactttgcttgatgtgataacagtgacatgctaaatgagaaacaattgttatttagaaaaaaatgcacaaagtgaaagtccttttaatccctaatcataaatacattttattagcttactttaagaagtggcagtcacagctcctgaacattagggagtgtttcttttggtcagcattatttatttagtgcacattgcctttaattttaatttgaaattatagtaaaatccacgggagtttttaagtctcctcacagccttttgctaccttttcaccaaggtagatccagatgataactgctgtgttgtgacatcatagaaattagaaaaatattttcctctgaggaaagaacattgtaaatgaaactctacatatcagaggtctatagctatgtatcaatattaagtttcttttgtactttgctttgtagtcatcttcattccaaactttcataattattatttttactttaaaaagaaaaataacccaccaatattgaagattagtattgtgtcacttttgaaagtcagtagaatttatgcaaaaggaacctggaactttaaatcattttgtttttattttctaaagttcatgagactcattcttatggttcatgtttttattttttctctcattctttatcattatgattggaaactcttttaatttaatttctcacacagttattagcataataatctgtttcaggattgtcttggggatcatcacaaagaagaacatattagagcatctcgagcaactaaagcagcacgtcgaacccttggtgattagatatatcagatctcctcattagacaccttagaagtcaggaagcatgaaacttgtgaactgttgagttctgtctttcccagatatctgctgaacaaaaatatcctactatgctgccaattacatttgtatctgataaaatgtgtctgtaagataaatttagatatgtgtaaaatcccatttatagaaagtaagcaaaagttaacatctctcatcaaatcattcattacaatttcagaactgtaaacagtttggtagtggaataagtgaatattattggacattcttaaagtgaatatggcaaatctgtctacctcagtggatacaccggtctcagaagacacctgactggttaaaaatgtctgacccatccccgcaagcccttttttttttttttaaatgtttcccgatcttgtggtagtcttatggtaaatctaagctcctaaaggattttaaaggagcttagcaattagaactgcttacagttaaatggattttttaatgggcacactaactagagtgtaatgtgtatattatttgtgatcatagcattagttctttttctgctataccctgcatatcttcaaagtcacagtgtgtgtcctgccatctcattagtgaattgtacctagattatgtgtgtgccccttttgtatgatgtttctggaacgctataagcagcttttagagtcaaatgcattcattttaactggctttatgtcctagtggtttcatgactacaaatttgaattatcttactgcataacataaaaaatgtctggctttagcaattaatgcccgaaattattttgccctgcaattgtcatacctgtatgaaacctgtcccagtttgcttaagtgcacaactgattatgtattcctgtgtgtatgctaatatttcacaagtgtttcatgcatccttttttaaaaaactactaaccagaatattatcgtagctactcattcattctgctttctgcttcacctataataatcttttaggactgccttctgatttttcacctatcttttaatgtaagcattaacaactaagactttcataaaagcactgtatcttaactttcctggcctaaatcaaaaaaaggaaaacattgataagtgtcctagaaacttggattcttttatagatttgttcttggggctctgatgtttgggattgacgttctgtgctgaccattttatatgcattttatcttaatagtatgtgctttcatgaagattctgatacaagtgggcaatccttaaattatctttgaaaaattggttaattttggttaaaaaagggaaagtggctgggtgcagtggctcacgcctgtaatccccagcactttgggaggccgggacgggtggatcacaaggtcaggagttgaagcccattctggccaacatggtgaaaccctgtctctactgaaaataattggggcatggtggcacatgcctgtaatcccagctacttgggaagctgaggcaggagaattgcttgaaccggggacccaggaggcggaggttgcagtgagctgagatcgcgccactgcactccagcctgggctacagagcgagactctgtctcaaaaaataaataaataaataaatgaaaaagagaaaatattgagaggatttggtcatcattttactgctctcttcatgtgatggaaatcaattttccttctcaaatgggatcagtatcatttcctagtcatacatccatccagtttttgttacttttttgttggcatacattaatcaaaatagctctgcttcattgaggcatgcagtcctcagactctcggtggaaaggctgtcatactattagtgaccatagtaactttttataccaaaggatggttgctggataattttaatatctttaccaataaagtactttttggaaatacaaaatcaggctgcttgctttgctctattcctgtcaacaaaaaggatttagctatagatttagcttctccttttattttcccttttatttcataggagtcttctgtttattcctttcaggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttatgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatgtgtggtttggcctttaattatatctgtaacagtcctccctcttcactgctgccctacgcagtgtaggccgatatgcctggcacagggagccccaaaaaggtaataattataatgcttctctcaggttacaaagcatttctacactttgcaagcaaggagcaatagaagagtagatagatgctggattgacagcaggatgttcataccaccagcaatggtttagcgcccccatttgtcagtgaaagctgcaggtccacagaaaactgatttcatttcagctcactttcaaaagtgatttttttttttttcgcaagaaaaattacgctatttgcatgaaaagaggtaaaacgatttatttacatgtctttaaaaaatcaccttggacatttgctaatagaactgccaaaagagggtggtaagtaacaacctttgattaagatgtggtcttttactattaagcttttagtaaaaaggaacacactaaaagttcagagtagatcatttatattcactgagtatttactgagcaattactgggcgccaggcgctattctatgttcttgaagttttcattccagcaggaagagaaatctagagtatgtcagatggtgataaatatggattagttcagcaattttaaaaaaggatttttatgtactgcacactgttacgaatatacaaaatcagtcaagaatcctgttatagtttttgtaatgtacaaaaagtgaaggtgtgtgcacccaccccatttttatagagggtgatcagggaaagcctcagggataaggaagcatttgagcagaaacctacagaaagttagagaaggacatttatccgtgagaaaaaatgttgtaagaagagaaaatgctatatacaaaggattctcctgccaggttcaaggaacactgagtagatcactgtggctggagagggataagagggaagaaagtggtaaggaaagaggttgggggtgtaggcatttgatttttattctaaatgagaagccagtgaggcagaaaagtcacataatgtgacctaaaatatctctcagactcctttgttgggaatagactataagggggcaggggtggaagcaggctaccagctagaaggctcttggaataattcaggtgagatgtggtagagatctgaacctgattgaagctggtggaggtggtgaaagcagttggattcgagacatgctgaaggtagaatggacaggacttgtgaatgggttggatgtagtgtggtaagtgaggagtcaaggatgcctgcaaagtttttggctgagtaatgacagaacaatggaatggccactggctgagttgggaaagacttaagaatagattgggggtggggtgctgtgtgcagaggaattttggttttagacattgttttaaatgtcttttagacttccaagtgggggtgtcacataggcattagcatgtatcagactcgagttcaggagaaaggcccagcctgagagctacacaggggcggcatcatcctgagacaggagagtaccgtgcattgaatgcagacagagaagaggtacaaggaccgagcactgacacatgcttatgtttagatttggggaggtgaggagccagcaaatgagggagctgccagtatggttgggttaggagtagtgaccttcaaagaagggtattccactggtggatatattaaaaaataagctgcgtgtggtagctcaggcctgtagcacttcaagatgccaaggcggggcagcagcatctgagcccaggagctcatgactagcgtgggaaagagactaggtctcctctacaaaaaattaagaaataaaaatatgaactgggcatggtagcacatgcctgtagtcctggctacttaggaggctaaggcaggaggatcacttgagcccaggagttggaggctgcagtgagctaagatggtgctactgcactccagcctgggtgacagagcaagaccctgtctcaaaaagcaagggtagtcccctaaaccaaatgaataatagtttcaaggagcgatgattaactgtcccgtgttgctgataggtgaagtaaatgagggctcaaaatggaccaataaagagagaactgataacttcccccagagtaggttcagcgcgatggtggcaagccaaagcctgaaaggagtgggtccaacagagatttgaagaattgaagacaacgattccaattcttcctatcaggtttccaggaaagtaatacgtgatagttttaagatgcaggatattatagcttcttttcctgttgatggtttgacagggaaaattaatcagaacattcgggttttaagatgcaggaaattatagcctttttgttaatgataggaatgtttgagaggaaaaatagaggagaggacctcgagtaggcaagggaggatggggtcttgggcacacattcaaccttccttgggtagttggtagggcagtgggattctgttaaagttattttggtggcttctattttctcagtgaaataaactgaggatgagggtgggggttgggggttgagagatgagaaagtaggatcgatgggcatccagtgtggccaacttgaggttaaaataagacaagctgccatggttgtgttttttctccagctacctgatactgagcagactctggtaaggaataggcagttttaaaaatctgccttaaggttaacagataaatacaacaaatggagagaagggcagtggagtggaggatgcgggggtgattgtaatgatggggagtagaatctaaaggctcggtaaagagagaatcaggaatggagtgggtgaagaatgaaaaaggtggttacatttgtgaattgtaggggactgtcgtgttgaaaaaatttttggggtactagagggaaagagatggaaggatgagtgatgatgttaagacagtaggatgcttgagattgagatttgggaggttttcattattggtactgagaaggtactagtttctagtttgtcaatcaatccctaatctagatcattgaaagagtaagtcagggaactgagaggttagagtattgtagggatcacctacatatatatatatatacatacatgtatgtatatatataattttttttttttttttttgagacagagtctcactccatcgcccaggctggagtgcagtggcacgatcttggctcactgcaacctctgcctcctgggcttaagcagtcctcccaccttagcctcctgagtagctgggaccacaggtgtgcaccaccatgcctggctaatcttttctatttttagtagagatggagtttcaccatgttgcccaagctggtctcgaactcctggccttaagctgtctgcccaccttggcctcccgaagtgctgggattacagctgtgagccaccgtgtccagccagacattaaaattaattatgataggaatagtttggacagaatgccattaagctggtaaggtcagtgtttgaggtaatgcaaaggtcttaggacactgcagattagtttatagcaatctgttttgcagctttcatttttccttgggtgttattctacatacatgtttgagaggttatacagaaactccattattgaactccaagaggtgagcttagctaaatgtgaactggtaatgattttctgttaaatcctgattggatcaaggttcttcattcatgaaagagcctaggcacttaaactgtgttctcagagaacagaggtatatagatgccatttggaagctactatagcaattgagtgaccagatcctaggtaatatttagtgaactaggtttaagtggactatgcctttagttaaggaaaaagataaaatttggtatcttcctgtagggagcttgctctttaatgaaaaatgttcagtagttggaagatagtacctcctgaaacaggttagtagcactctgacacaactggttggagtttgagactggaaatccacatttcttattactgtcttcaggaaactccattcacaactgtatcatctgaattataaccaccatattcttagagtttgtgtccaatttctgtcttggctctgatgtgcccagcttcctgaagatacattcatattaggtttctgtaaggaatggatgaaaagccgattcaccttttttgtcccctttcatttgttccttgataaaaaatccttctggaatccatattactgataaagcatataaaaaaaaaatcttacaaactatacagttgagactgttggatcaccaagtgacaaaattaaaggaatctaatgtttctagctaaacaaatatttaatgagatacatgaatttggatattttttaagtgtgttaacattaggggcagtatttagaaatggttgagcccgttagaaactaaagaaatctgaggaacaaagctcgaacttctaacattttatttaaaatttatagcctaaaatcatttaagatcaatgtgatttggtcactttttctaataaaatatgtgtgagctaactgtaactgtaatgttttaatataaaacaagttaatagttcagatggttccagggcctggagctacttacctaactaaaatggcagttccttaaaacctaagacctccccattaagagctgtaaaagttcctgcacagttatgaaagggaagctgaagatcttttcagtttcattttggttaagatattatacaaaatatacctaccttgaagaaagcatcttacctgcctccaaaggcaacatgagccattggcagaaaggaacagattttgtttgtggcagagatttttgaccccagaagactttttgtctgagaagtcaagaatccttaactcccaggcatcttatcagtttcccagctcttgccagtttgattctgtctagcattgaagaacatgtgacagggtcattttattcacaaagtgcaattccaaaggtttgtgttactgagggggatatacatccataaaatacatgcccttaagaagcttgcagcctaattggggagatgaggaatgctacttatatttaaaattctaagtgttgtcttttaatagtttactcatacccttatataaaaaagagtaagtacctcaaatatattttaaggggacagctgacagaactttggagaactactgtctagtcaataagttatttgagtaaatcacatcaattttacacaatgtggaggtttaactagatgacctgggatggggggacggtgcttttccatgttgaacttcatagaaaggggaaaaaagcttatacactcctcagccccatccaggaagtttgctattctgcatttcatggtctgccctctacctattttttttttttttttttttggagacggagtctcgctcttgttgcccaggccggtgtgcaatggctatctactgcaacctccacctgagttcaagcgattctcctgcctcagcctcccaagtagctgggattacaggcgcctgccatcacacccagctaattttgtatatttagtagagatggggtttcaccacgttggccaggctgctcatgaactccagacctcaggtgatccgcccacctcagcctcccaaagtgctggggttacaggcgtgagccaccacgcccggccctgccctctacttttaaggtgaaggacatgtaatcaggtttaaggaaaatctggatctagtaaaacacagctatccacagattcgtactaaacatccattgaaatcatttgcaatgaaaaactttaaaatctaaagtaatggtatactgattactatcttatactaaaactatatactatgtatcaatatactagactgtattagtaaatgactgagtcaagagaagatttaaaataatatacctaatgggataactggactacttactgggagtcacctggagctactactcaaaatgcagtttgggtaggtcggggtcaggcaccctggaagagtgcttattgcagtgtcatgagtctccttctaagtttccttctgttcccctcttctcctgccataaacccgatccttaaagctacagctattaactcaagactcagaagaaatattcttagttgcccatatgataaatattgaaacaggactctgtaaggatggtctagttatagccacaggcattagacagtggcttcctgtgacatatcagagggtgactttaattgtcctccaaaatgtgattagggtcaccatttaggtgatttgactgccatttttttgcacattaaagaaggaaaaccaggcagaagaaccttataaacgtttttagtaaatgtttattttttgtattccttaaaaacaaaacaaaaatcacaagtttaatactagtcctttgaaatactgtacaccaatcaaagccaccttactcatgcagcaagttggtctatgttctcttgacttctgtttgccagatgctcctcaataatttctgcaaacagattcctcttcaacagattatatgcaagaggtaaaagctggccagcaactttatgaaaatactgaaaaataaaaatataacattaagcagagaatatagcagatatcctaataagtagcagaaaatatatcaacaaagcacttgtttaacaaaggctacttccaaaatcattttagctacaccctcaggtggttagtgaacataatttaaggacaggcgcctggcattctaagaggcagtcttgttgctctagatgactaatggcatatcttgaaaattaagaaaaccaaattaaatcgagcttccttattcccttaggttttatcaactttttctcaccccaaacaatgcccacaaatactttttattctctctagtgtattcccaggcaaaagtttaagctttattttcctcaattctgtaagaatagctatgctgaaagttttcagatcgtattgcctttatcctcaaattccttctctcccccatccccaacacgtaccgcctcccaatccctgttaagagtcactgccttaggcttatcaaaagatttgagattactgctattatctacatataccaccgttttgctgatcataataaacatttagcccttaacatgcggtaagcactgtgctaaacctttttataactcatacatgttatttcattctcacaacaagcaagtttgctattcactggttcacatcttatggctctacttatttatggctagggcctctctagcaggtcaagtactatttggattggtcaatgactgtcattctggctgttaagcattttgattatttttactgataactatctatgaggtgggcaaagaaaagtagtataatatggtttatagcagggttctcaaaatgtacacccccgaccaggagcatcaacttcacttggcaacttgttggaaatgcaaattctcaggacccaccctagaactcaatcaaacttggggagggtgggaagactgccagtgtgcgtttggacaagccttcccattgacgctgatgcacgctaaagctggagagctactggtttggtcttgcttttcccagtgtggtctgtagagcagcagcatgaccgtcacctgggagcatgacagatatgcagtctcagatctcatgctggacctaccgatagagtgcattttaacaatgtctgcaggtgagtcatatgcattttagtttgggaattactgcactgatttaggcactgattctggagccagactgcttgtgtgaacctgggcaagatgctttgcctctctgtgacttggttacaaagtaggttaaatgagaattaaatgatctgcgtgtgggtatgcactcgtgcacatgtgcacacatatcttacaggtaaagaaacagatgcaaaggtgttggaaagcttgcccgatcttacacactgggaagatgtgatttacaaccagtttggccccagaaacaggtcatatccgctacaccttattgcctctttgatcttcaggcaactatggtcgagtaagcactggtttagctattaagtaaaattttcttatttaatgagcaattagttaacggtaaaacagcatctcttataaagcttaaataatttaaagtgcatttttcatctaagaatttaagcacaataacaaatacccccaccacaatggaaacgaaatggagcctaaggtgtgtgcacacacccccatacctagccccaaacgtacacacacggcaagaaggcatgtccctataatgtgtctaatgagtaaattcactttaatgtaagcctgaatgcaaataatcttcacctttgagtgaatgcaaatattcacctttgccagaatataagatgagtttaaaacatttttaggacatctacgttaaaaaaaatcacttcaaaaacttcattttgaaatacaagctgaatccctgtcttacctctgctggaatttgggggtataaatgtgcacgtattcatgtgtggatgtatgtcgcggggagaggagggaggtgtggcagtgggtagaaggtggagggtttttttactcacatgtgagccatagcaaaagagatccattcccaattcaagccccatgccataatcacattcatcattagcaaactgcacaaaagtcatcatttcctgaatgggagcaaaagcttttagtctctcctcatcacttgcagcctcaactattgtcttgcaaattctcttgaggtcagctgaaagaaatcaataatataaaagattatctacatagttagaaaatgaatcagtcttcaaaagtaagaagattataaagagggtttttcctcctaagactttgtactaatacaacttgtgccaccttgggtagtagtcttcagcactctaatttagaatggcaatttggtaacttttctacttaggattcaagcttaaaaacaggttaacaagtatttctttattaacgactatttcacaggatttagttacagtcacgattttttttttttttttttttttagacggagtcttgctctgtcaccaggctggaaagcagtggtgcgatctcagctcactgcaacctctgcctcccaggttcaagcaattctcctgccccagcctcccaagtagctggcactacaggcacatgccaccacgcccagctaatatttgtatttttagtagagacgggatttcaccatgttggccaggatggtcttgatctcttgacctcatgatctgcctgcctcggcctcccaaagtgctgggattacaggcgtgagccactgggcccagatacagtcatgatttttttaaaaagtctattccatggtggtcatcatgcatttacataagctttaaagattcagcagactagtccaggagttggcaaactttgggcaaacctggctcaccctgtgtttaactgccctcaaactaagtttttttcatttttaaatggttgaaaaatcaaacaagaatgtgatagattatgtagcccacaaagtgtaaaacatttactatctggctgtacatggaaagtctgccagcctggttcatgcactatatagttgcctctgtatctgagggttctacatccttcgattaaaccaagtgcggattgaaatactcaggaaaaaaataaaacatacggattttaaaaatacagtataacaactatttacatagtgtctactttatattaggtattctaagtaatctagaaatgatttgaaatatacaggaggatgtgcgtaagttatgcaaattctacaccaacttatttgagggacttgagcatcagattctgggtatccttcgaggtcctgatactaagacaactggattaaaaaataatccaagtaggcaaaatttattctttttgccctgtcctaccttgtttgctaaaaaaaattactgacttgtgacttgtggtgaactaaacccagaaaaagacaacaatgtaagagacaagaaatcactgcagaattaaacctttaactaaaaccttcaccaaattgggagaagagtaggcatggcaagcatgcgtttgaggtaagaatagagagaaaatgtctaatatttacctaaagaatatatttttacaaattaacatttcaattttggctttcaagatttttttcattctttctggatgttaatgtacatccgatttcaggacgcaaatgagatggaagtatgaacaatatctatttagacttccttttgacaaattgtatgtcctttttaacaaacagtacttctttgagaatgaaaagaatggatattattcaaacaaaccaacaaaacatttccaaacaggtggctgccatactgggggagaggaagactggttaaaacattaacaattatactcaagaatgataggtgatgttaaattctatgtatgaggcacaacgttctgatgagactaacgaaaaatatcaggtatgatattaccagggacgggctgagcgcagtggctcacgcctgtaatcctagtgggaggatttgggaggctgaggcaggaggactgcttgaacccaggaattggagaccagcctgggcaatgtggtgagaccctgtctctacaaaaaatagagaaattagctggacttggtggtggacacctgtagtcccagctacttgggaggctgaggtgggaggatcacccagtgcaggaggtgcaggctgcagtgagccgtggtcatgccactgcactccagcctgggtgacagagtaagaccctgtctcaaaaaaaaaaaaaaaaaattaccaaggatggtattaaaaatatactatatactagtgcttttaaccccagtctatgaataacatttggttcagtcttgacgacagtacagaatacatgctgttaccccagtcacaaaatgtgttgttccctttcccacttttggtggaccagtatcgcattgaacgaatggcaaactgcaccacctacgtttctaactatctataaacagtagtgacatatttgttggtttgaaaccttttacaaattaaattattttacatgagcttcatgacattcctttcttcagaaaaatcagtgctgatcatttcaagaaaacagatgaagctttctccaaaaagctccttaaggatggaaaataagtggttcctccctgttatcgtgggtgtaactgattgactgggacccttagaatctctctcgctgtgctccagtcagccactacaaatcagggtgggtatggaagtgaagaatttaaagtttatcgctttccagtatcttattttctatttttacacctggcaagtcacatatggactaaaaagaataagcaacttatgcgaattactaagctagaaaaacactgaagaacagagatgaaaatattcagctcaccatcagtacaaggaaaaatatgttcttccagcaataaaacattctacagaaatttcatttaactgaaacccaaacttaaagaacatgagtgaagccttaagttaactattcaaaaatgatgacttaaatgtttctactcaaaatactcaatttaatgagttaggagtttcactgctgaattcttactatatccctgccactactatcaactagaatacttaaattaagctacagtagttctgtcaaggtaaaaatcaggcaactaggcaggcaactcttcttacttcggatagtagtatgcactctacagtcagaaaaccaagtatgaaaaccagtgccctcagccggggctttgggaagccaaggcaggtagataacttgaggtcaggagttcgagaccagcctgatcaacatggttgaaaccctgtctctactaaaaatacaaaaattagctgggcatggtggtgggtgcctgtaatcccagctactcaggaggctgaggcaggagaatcacttgaacctgggaggcggaggttacagtgagctgacaccctaccattgcactccggcctgggtgacaagagcaaaattccatctcaaaaaaaaaaaaaaagaagaaagaaagaaaaaaagaaaaccagagcccttactgactaatgctaagcaccgtgagtctatttcctttgtgaacatgggaataagacctacaataaagagttgggtgagaattaaatacatcacttgttaaagtgaatcatgacactgacatttaagaattgctcaataaaacgtatcttatttgctaagttaaagcgttattgtgagaagcttcaaagggttaagaacaaacttagttgtgatttgctaatcattgtcacattaacaaactgccagtcagttatacctcttggcaaatgacactggcaagagcaagaagattaggtccttcagtcttaatgttttgctaccacttcaaaactaattaaatacagaaggatctaatgcctagaatagtagacttggatataaaaccccagaaccacaactaccgcagggtaacaggctttactccagggcactacaatttaacatccatcaccccaaaagctttagagactgcccatctctacaacaaatgtgcgcaacctttcccaaacgagatagtaatcatgctttttaaagctctctctgtgagcagagacatgaagagaagatgacttagtgtagaagcagaagactgaccagtagctagggcccacaatggtcccatcagagactaattgactctggcttcaaagaggagatataggacagatcagcctgtctaagagaaatacagtgtgggttacattttttccagtatccacatgaaaaaagaaacaggtggggcaggagaaggagctaaaaaaaaaaaaaaaaaaccaacaacaaaaaacaggtgaaattaagatattttatttaacccatatttccaaaatagtattatgtcaacatataatcaatgtaagaaacatttaatcctgttttaatttacaaacttaaactaattaaaattatagaaaattacaggccaggttcagtggctcatgcctataatcccaaaactttgggaagccgaggtgggttgatcacgtgagcccaggagttcgagaccagcatcggcaacagagtgagaccccgtctctacaggacaaaaacaaaaacaaaaacaaaacccaccaattagccaggcatggtggtgcacacctgtagtcccagctactcgggaggccgagacaggttaattgcaccactgcgctccgtcctgggtgacagagtgagaccctgtcacaaaaaaaaaaaaaaaaagaagtaaaaaataaatacgagttacaaattttgttgcaggagccacctgtgaggcactcagtggccatcacactggacagctcagccacattcgtcttccctatggcactcctctaagtggcaggggtacagcaaaaacaggtcccgtatgagtagctgccatctaagacatctctacctactggctggagactctggcacagtaaaatttgagaagaactgctttagagaattggtttaaatgcagatgtccaggtcacaaccccccagagactggtaactaccaaggctagttagttctgttctgaaaagcagacggccaaatacgtgcattgggcaggaatatgtggttctttgagaagatgctaagtttgatttccctttaagttttatccccccagaagaggatgatcaataaaggaataccagcagggctgttcacgataagggaatggagacaaggggaaaagaattgagaagcgattttaattctcgatgtttaacgtagcaataactagattatgtgcagtggtccattttcaaagtgtttttatacttacagatgacgtagttcaggatcttgggcttctgaaagctaaatcattttataggcagatgaaaaaatgttcacaaagaaccataaaaacacaatttcaataattactactttgcaagttgactgtaatgtcaaaggttcggaaatagttcccaagaagcaggcaatgggttaaaattctgaaaccccgtctctactaaaaatacaaaaattagctgggcatggtggtgggtgcctataatcccagctacttgggaggctgaggcaggagaatcgcttgaacctgggaggcggaggttgcagtgagctgagattgcgccactgcactccagcctgggcgacagagcaacactccgtctcaaaaaaaaaaaaaaaaaacaaacaaaaaaagaaactactgaattttgaacactgaggcaagcattttgttaagtattttaatacttgtttacaccacaaattcctttatgaagtgcatatgattagctccattttacagatgaaaaagacaagatttcacagggttaaataatttgttcaaggccacacagctatgaactcggttttaattcaggaatgactgactctaaaacctcagcttactctttattactaaggtctagcgactgtgtcagaaaaggtatatagacatacctacttcccaatataagcaaaacctttattcatgtgcattaacatatatgcacatgtttactatgaaatacattaccatctgtttcagggagctctcggtacccaacatcatttttatctactggaacaaccaagcctgcaccatgaaaggtctttgtcacaacctacattaaagaaaagaataaaatgtaatcatggtaagcagacatcaaaaaaaaaaatccccaaatacataaaccctcaacatttctgccaaaatgtaacatttaatcacattttatttcagtaaatttggactccagggtaaaaatttaacactatttttttcttgaaaatcagctaaaagttaaacagttgaagtaatcacagaacagtgaaataattggcttttcttaattgtgccagtcacttggaagtctgcaccctgatttgttaaggaagaacccaatacatcctagaaggcaagtcaaaatattggtttcctctaaggtcaaagtaccttctggtagaaagcacagaggaacctggttctaaaagaaaaagagtaagaaatagttcttgtcagcaagaagatatggtaggacagaactcctctcatccatcctgccaaattgagactcccctatttttacctggaatatttaggcttctctgcaaacttcccaaaagtagggcagtttctaggtttgtggtgtcctttatggaggcaaatcacataaccagtgagcttttattaagtggtagtcttcaaagacaaaaacaggcccaactacaactaccaccataacccttccagtttccattcttcctttagctcatgttagtgacattatttttaggtctttccttagcgaaacatctgtacaaatattccacttctttgtgcaattcagtgaaaagtttccaaggcagaggaaggacacaacccaaaaaccaaactccaattttaaaggcctctcacctaagtctctatatcttaaagatttttttctctctaatctccctattctcccagtctcttgcttctttcattatcctttattaagctgccagaaagggcagattattcaaaggaagttatcagacaactgcttaccacttgggaaaaaaatgaagtcattgtcttctatcttaatctttctatcaagataatctgcagctggatttcagaattaaatgtaaaaataaaaccatacacatatacaccatggaatactatgcagccataaaaaaggatgagttcatgtcctttgtagggacatggatgaagctggaacccatcattctcagcaaactaccacaaggacaaaaaaccaaacactacatgttctcactcataggtgggaattgaacaatgagaacacttggacacagagtggggaacatcacacactggggcctgtggtggggtggggggaggagggagggatagcattaggagatatacctaatgtaaatgacgagttaatggatgcagcacaccaacatggcacatgtatacatatgtaacaaacctgcacgttgtgcacatgtaccctaaaatttaaagcataataaataaaaaataaagacataaaactactcgaaggtaaattttaaaaaataattttgtgatagagaagagttgactatataaaaataaaaagtctatccagtgaaatcaagtacacaagacaaattaactgataaaatatatctgcaaaatgtaatagtaaataaaaattaatgtctttaaactataagggagtctaacaaaggaaaagactaacatccaaattagaacacatgtaagaaaaagactaattctaaccctgatagagaaatgggcagagttcaggcagttaaaaaaaaaatacaatggccaacagagaaaagtatttaacgtcctttataattaaagaaatgctaattaaaactgcagaattttatacctaccagcatggaaaaaactaaaaagactaaagaaaaccccccaaaattagaaacaagcaaagaaaaactacaaacacacctacacacacacaaactactttggacctggcaatactacgtctaggaatttcttctaaaaaaataaccagataagtatgagaataaaggtataaaaggatatctatggcaggattgtgtttgtgaaaaatcttaagcaacccaaactttgaccataagcacagtattctgcagccgctcaaaattatgaggtagatcttaaattggcaatatgaaatgataaagataccatattcataagtgtaaaaagcaggacataaagcactgataatgaaagaaaaagacagcagtgctatagttgccagctcaggctgaacaacataaagaatgatggtaatatgttcagatttttcacagatgattacctgtactaattgtccatgaagaggaatcaattaagaagtcatcagaattgtaattttattaagaaattaagaagaataagattacaaatttaggaaagctgtataggggtgggtgacatcctgaagcatgggatcacaggtggatggagtgccacaccatcattttatgcatcatttaaccaacgttccttatgaagaaatccaggtatgaaaaaggtgaagtggcagagagccaattagtaagaagatggggtggaaagaatgctaaatatggaaaatatgaagttgggttttacatgtgtcatttaagattttggacaagacacaaaacctctataaccctcaatttactcatctataaaataggataattccaactttgcagatttgttgtagggagtcaaatgatataactcataaagactctgcattccaaagtatgctaagttactatcagtataaaaacactgatttctagtgtgctgcacagtgctctatcatactagagtggaaatatgcttacgctcacacacaaggacaaagccactaactcacatatactagtggaattgaattcttcagtagaaaaatatgaattcaatgaagatctcacaaaaacaataaaagaacaaccttgcatttaacagaaaagggtttgaaagtatagtcattaacaggggaggattaaaaacatgattgtcttgaaagttcttttttgtctttgtttttaccagctgtttttgtataaaaaacaaatactaaaatgaaacttcataggggaggggtctaggacaaaaatatctatgaaatttaaacctcaatcatatcttctttatggggaagaattaagaaaatctcctctgaaataaatcatagcttgtggtagaaaaataaaaaaagactgattaaataatttgctaacagctattatgtgtacggatgctcagactttagtcaaaacaaattagaaatacattaactaggttacaaatgctacccttcctcctagtcacaaagtggaagaagcttcctgtgataaccagaaaggtaaatggcaatataaaatcttaatatttaaaatgccatattgtaatgggtttcattaaaatgtatgttttaagaaactttccagtctataggactaaagagtgcctagaacttgatacaaatgtcacccctgcagctgaatcaagatcagagaaggaactgaagtaggatttaatgcctaagtacactaaggtacttcattaccagtgctagtttattaaggaatagcaagttctccatttagcttagaacattcagatgaaccagcatgggcagacaaatggtgagaggctggaggagactggggagccctcattccagtgacaaattttttttttgtttttgttttttccccagaggccataagaacaaactcctatagaattctcatttactccaaaccagaaatcttccagcttgtcattaacttactctgaaatctatagctgaaaaaccaaaagaatccaacactaacaagtatttgctcctttacaaaatactcccctcatattgcagacattaggagagatgcaaaaggaaatgataggattaataaggaaaaagaaaggagcactgcttatatacacgtttactggagaaaatgtatgtatgtaaatttcattatgtacaaagcagctttcacttaactttatgaagtgattaaatggtaaacaagattaaaagagtggtaaatactggcatgagttattcaaccacagcagtgatatcaccagttgcgcaattcaatcagtgtaccaacccaaaggagccatctgacccctgtttcagtgccatcctctttcagtgccatcctcctaacatccctaagggacagcatccagttcttaagataggactagggaagagaagggtaaagtagagatgggaaggaatcaagaggggaaaaaaatatgctatagcaaaacagagaccaacaggttgaaatcatactttcttatctctctgtttcatcttcacggttctctgttcaagcgagtaccccaattctctggctgcttctgtgagtttttcatctatgtttttcaagagattgattttctttttatccgttatttctttaagttttttcgtcaaaaataatctgaaaaagaagtaaaagtccgcattatgtggcaggccactgtactaagtacaaagacctttgaaagttgagccaaggtaaaaatgtcaaattccatacaagaataagtccacagaataattaccaacacttctctcaaaatccctaatagttttcttcaaataagagaaaagcaatattcataaaaaactgccagtcagagaaagagcaaatacgattcaaatttatattagcactctaatgtctacaataaaggtataaggggtatttgcaaagctgagattagtcaaggtttaaactgtatcacttgatactaagatatggcatactactttggagaagtctgacctaacagaaaaaaaagtagacatcaaaaaaaagtagacatcaaaaaaatttttcaggcaaggcgcagtggctcacgcctgtaatcccagcactttgggaggccaaggcgggcggatcatgaggtcaggagatcaagaccatcctggctaacaaggtgaaaccccgtctctactaaaaatacaaaaaattagccgggcgtgatggcgggcgcctgtagtcccagctacttgggaggctgaggcaggagaacggcgtgaacccgggaggcagagcttgcagtgaaccgagatcgcgccactgcactccagcctgggccacagagcaagactccgtctcaaaaaaatatatgtatatattttcagggaccaggcatggtggtccatgcctgtaaccccagtacttttggaagccgaggtgggcggatcactcaaggtcaggagttggagaccaacctggccaacatagtgaaaccctgtctccaccaaaaatacaaaaattagctgggcatggtggcatgcacctgtattcacagctacccgggaggctggggtacgagaaccacttgaacccgggaggtagaggttgcagccatccagtcagccgagatcgtgccactgcacttcagcctaagactgcctcaaaaaaaaaaacaaaaaactgtctttttttccgagatgttgtttcattcttgttgcccagnnnnnnnnnnnnnnnnnnnntcattgcatcctccacctcccaggttcaaatgattctcctgaatcagcctcccgagtagctgggattacaggtacatgccaccacgcccagctaatttttgtatttttagtggagacagggtttcctcatgttggtcagggtggtctcgaactcctgacctcaggtgatccatctgccttggcctcccaaagtgctgggattacaggcgtgagccactgcccctggcctttttttttttttttttttttttttcatttttaaagagacaggacactattataacactaaaggtcgatagattttttttttaatgttgaagtttgtgttaagaaaaatttagaaaacacaaaaggaaagcaaagctactttgtaagcttatacaaaagcataatccaaagtagttctcaaaagtatgtgaatatatatcatgttaatgccacttatggaaataattttatattttgtcataaacaggttaagatttttgccatcaatataaaaggtcaggagtaaaatgaagagcggcaagagtgtgccagacttccaggaagaaggctgagggagtaacaactcctaggaagaaactcacttctattcactgccaacatctgagagtttgtagtattccctgcaacactgttagggagttagaacatttatagtgggtgctagtcttagcttcattgtacttatcaggaaaaaaaaaaggcacagaggatagtcaacttacccaagttgagagagctaatagattaaacccgtagagttaccagtagaactggtagattaaaatgccacagaaacccaagccatcaaaatctaacttctgattacagcacacggttacactaaatcttaccttcaattattaccagctgtatgtctagagggtatttttatatcaaccataaaatacagatttgatcatgtcagtcctatgtgaatcaatcgatctttacagtcttcctcaacactctggcacggcaatatagccattcaagtaccctgtgccacgtattttcacactttcacacacatactgctcccttacctaaaacatccttcttcccattctttctagtaagttcttaggcatccatcaaagcccacataaaatatcctcttttacctctgccactattgaaggcacttggtagctgccttcccatacatatgacattattatgactatctctgtaagtttttgtctctgccgaaacctactctaacactttactgtgtgatgcttaaagataaggtgcgatgtgcaactgaagccataaccatgaacgtgaacattttgtgctgtgactttaaatccattagaatgtcttcaacgcaaatgaatttgtacccatgcatgttatatggcatcatgcaatggccctttggaaatagtggtttactaagttatatagatgtaagtgttgaaacttatatatcaaattcattacataacattatgaaaaaaagctattgcgctcacagtggtattacaagtttctcaatctaatttttatttgaaaccctgaattttatcactgacaaaaaatatagtcagttgttttctttggttcatttgagagaattcctgccagtagctagacccaaataaccagtttgtcaatgagtcactcttttttttttttgcattccaatcttgggtttattcaacacaattcttccactctacacaacaaagtacaaacacaatgtcatctaaaatgctacaaaggtataaaactcaaagagaaattttatagtactgactgtacaataagagcaaaaaagaaaaaaaaagaaaagcaatgtacatgttgccaagataacctgaaagaccaccatgaaggacaggcacaaccatggctgcaggatgaccccacagagctggctctcaactcactcgccaatttcagagtagggtggtggggtggtgtgtgtgcataggtgcacggacagacagaaccatgcacagcaactaccatgggtgagaggatctttgggggtgtgtgacccttgaagtcggaagaggcctcgagaggccgggcctaacagggttggcagctgcactaaaccctggggcagctccctttccaaaaggacactgcccagcgacagcaagggcacggcctggccaccatcccaggtcatcagggaagggaaaagtgtgctcccaggtaggcagggtcaaagcacccccaagagtcttacttgtccctggtggctctgccactgaactgactcttagaaactggaaatgggtgagctttctagccagaaaaccagagggaatcttgacaggcacacagtcaatgagtcactctttctaaaagtggggaaaagttcatctcaaaattcaatcatacaagggcttttttttcccttgagacaaaccacagtacttcagtatgagaaatgctttctatgtatttcctatttcatcacagaatgttaaagagatgaactcaatggtagacatctaatacatgtatactccaacactgacatttttcaggcacagggtcttgctatgtcgtttaggatgaacttgaactcctgggctcgagcaatgctcccacctcaacatcccgagtagccaccatgcctggctccatcacaaacatttttaaatacatttgcatgttactgctgtgaataatgcaatgactgctgctaccctggtggcactatcttgattcctgccaaggtgacaacagtattatccactatttactttgtgccattggtgcaaaaataacattttattatcacaaatagttttgaccttaagggtccctgacccaaggtcaaaactgtttaccccagttattttaggaaaataaataaggcagaaggaaaaaaaaaatcattcctttgttgttcaaagttatttaagaattatgtttacttccatatgcattagacagtatgaaatggaatcattctacactattgttatttgcccacttcataacaaattcaacaaatcaataccaaagtattatagtatatggatagtttatatttacctaatcttccctattgctggatatgttgccaatttttcatttgataaacaatctgtaatacacatatttctgtacctgtccaaaatccctttaataaacagctagaagtgaaattgctaacttaagggtataaatgtgtacttcacatagtacctgacaatgtcacctattaagaaatcttagaatatgctttctaagttaacatttttcaaatgttaacattaaacatttttcaaactgctttctacaaaagttttaccaattaacacatcagtaagggttcttataccctaaccatcattggttattaccattctttaacctttaaaaaaaatctttgctggttaaattggcatttctttagttactattaaatcttgcagacacaagatttaataataactaaagataaaaatgtgttgatcaaaggtatgccttgaaagaccttattcagtctgccataaaaataaattttaaaatatataaagaaattaagtgttctggttagctgatttaaggaggtagtacctaaaaaactaaaaccgttataatactttaaaagtactaaaatagttatatctcaagtaattttttacccctgtttgagataaattattggaggtagttcctcaaatactcacttgctgatcttcacctaagttataaatatcacccatgtattttttttttctttttcattgtctatgttctccaattagcttaaaaaaaaaaaaagataccagaagagtcttgggttatgttacatgaccactattatgttatcttttttaaaaaaaaaaaaaaaaacatgactaataacacaaatgaaaagttaggcttgtttttcgaaaaagagacagtctcactatgttgcccagcctgaaaaaattaggtgtttttacatgccaaggtatttatagaattaatatttatggagcatctagtatggggcagatactctgccctcgtggaacttaacatgctagtgcaagagacagacaataagcaagaaaacaacaagagtttctaataaagatggcaccaatttaaattgaatgataaatccaaagagtttaaaagaagttataaattacaaataccaagtaacattttataggaaactgagaggtattagaaaagaaagaacatttttggacatctacaatgtagctgccttgtagatacaccagtatgtacgtagcatagtctagtggttgtagtagggtgatttagtttgaattcactttactgcaaatttgtatgatcaaatcacagggaacaacagccctttaaagagacagtactaaaagaggtcaaagaaaagataatctacttgtatttgaagtgataaagtttgctttcttcattacaatgcaaactacacagctgctgacaaataaaatggcttcaagtcatgtctgtggctgatatagcacagactggctcactcacctctattccaaccccttccccatgaaagttcactgcatttcccatactactctttagctcaggctccacatgggacctatcttcttccaagcagctgcaatactttgaaatctcagaggcagaagagataccacatggaggctgtgcttccacgatctccatcaatgagcacagctgtagaggcatctgatggttctgcagcagctgtagctgagatcccagcacctggttcttagcttcacgggggctgagaggcaaagagtagggcatccatttacctggcccagattataccaaagataatgtggtcctagagccactcactgtggcagcagttctcgaattcccagctccctgatggtggcagagacaaaatccactgtgagccacacaactgtcattcctggaagctcagcctgctccctcaacccttccaaggatataatgaccacctctttttactttattaagcctttctgtttgaaccatacataagaaataaactcttaacaggtgtttaaaatcagatgtctaacaaaactgttgatgttgccatggaacacctgaggtcaagtattattttcgttaagtaaaatagttacataagaggtgtatttttttggtgaagaggcacaaaataacagtatagataagactacctgcaaaagtcatggaaattatctctagaaatctacaattatgggcttgtctcaaatccgctttgtttttttttttggagatagagtctcactctgtcactcaggctgcaatgcagtggcgcaatctcggctcactgcaacctccgcctcctgtgttcaagcaattctcctgactcagcctcctgagtagctgggattacaggtgtgtgccaccatgcctccagctaatttttgtatttttagtagagatggggtatacccatgttgtccaggctggtctcgaacccctgacctaagcgatctgcccacctcggcctcccaaagtgctggaattacaggtgtaagccactgtgcccagcccctcaaaccccctttgtaatggactaatgtagtataaacattgtaaacaaatataaattaaaatattcttacttgactgcagcaaatacattatctccatttggaacaattatacaatttttctttgcttcatttataccaacatatacaggaaattcatcaggagaatccctgtgtaagcaaaagacattaaaaatttagctgcccataatttatattatcaggcaagtgggatttcaggtctacagacaacaatttacacctattttttttcctttttggaggcctttttttttttttaatcataccagaatttatcgattacatcaaacaaaaatttctgtaatggaaaaggcaagttgcagtcataaaagatggcattcacattcattttagaaagcaacaacgtagatgtaaaaaattgtttaagtgaaaaatgtaatattgcagtcccattttgcaagctgaaaaattttgtcaacacacataaaatctgcacatttacatactgcatgttaaaaaattccatcactaaagtattataaatattgcaaagttaggcttaaatttatactgttgctggtgtatatgtagtagatatggaatgaatgttttcagtttagtaggtagcatcctcaaacaacggacaacagttgtgaaaattacaaagacatttcaatagctcaaaattatccaaattataggtacatcgtcctattattacacttttttccctttctctgtcacaaataggatgattacattgtagtggtaggaatactgcatggtctacttcaaattattcgatctgctaaccccacactagtcatttttcatcagctcctcagtaaaatatcttttaaaaaggaaagccaggtccctcccaaggatctaggttgatgccttttttataagggcatttttaaaaaaattcaaacaaatttgccagttttaagctccaagtttcttaggaatatctatgataaatcttatataatggaacctaaaactaagattcttaggacctagttgcttttatactcaaatacaaaaaaaaaaaaaaaaggaaaaacaagaaaaaggattgtaaaacattagagatgaaaggatcctattcacgtatataaccaaaccttttattttaaaattgaggaaacaaataccgagaggttaaattactcagccaaggacctagtaagttaggaccttggctacagtataattcaattcctagccacatgtgcattctgctgtactacaacacttcttcctgggcacgttccttctattaccttacatttaatcttcactttaaaggatagcatttctactggtacaagcggacaagtattttcctcctggagtttctctatttctaagtattctgcatgcattcatttaattctcataatattcctatcaggtatgtacagttatccctattgttacaagacaggaaaccgagtcacagaaagtcacagtcagtaatgatacagggtcacacagataataaacaagaggaccagtgtgactccagagaccactcttaactaccagttgccactctggcacacggcttattaagcacagctgctctaaattatctttcttgggccaaaagagctcttctgaacccaaaagggaaaaaaagtttacaaggaaaggaaaaacaagtgagattaaacctaaagagtttacccatcctagggaaggttaaaacggtaacagcaagaacaacagatggctcatatatccaccaacaggggaaaatatgcctttcaccttgggtgaggctagtgaataactatttatcctcattagcaggacagcagctgtattttagaggcgaagaaaagatcctttacctgaaataccccatgtggtactgagttttattatctccaataataatggtctggaactcaggaggatcatagtaaaacctccagtgaaggttaaaattcaggcctgttgattttttcttcgttttatgttttccagcaaggatatcataaggaccaactaattgaagtccaaggcttgcagaaagtgaatctataaagaaaataaatttagacaatactttctggagacaggtaggaaataatgcttttatttagtaaactatttctaagcaattgtctttaaaaagtttctaaactaaaaaaatcttgagttatgtgtgaagatgtcagttataaacattcaatggaaaagaagtcagagtaacaggaaaagtggtatttacatttaggatttcctcttaaatttaccactgaattagcctaacatttcagacattcctgttgtttcttattttggccaaagcaagactggtttgtattcctataggcccattaccacactgcagttagcctcaaatacttgtagtacacacaggttaagggagagaaagatagcaaaaatgtgtggattaagagtagtaaaaaacaggccaggtgtggtcgctcacacctgtaatcccagcactttggcaggctgaggcgggctgatcacctgaggtcaggaggagacaagcctggccaacatggcaaaaccccgtctctactaaaaatacaaaaattagccgggtgtggtggctcacgcctgtaatcccagctattggagaggctgaggaacaagaatcacttgaaccctggaggtggaggttgcagtgaaacgagattgcgccattgcactccagcctgggtgacagggtgaggctctgtctcaaaaaaaaaaaaaaaaaaaaggtaaaaaacatttctatcccctttcctctacctcagctaatcacaccagattcccctgactctttgacaatctatttggccaaccctaaccctggatgactccatcttccttctctattcacggatcacagacagggagtgttcataaaccacaaagacatgaagtctgtgcaagtgtacaatgcataacttcaaatgggtccttacttctaagatggagggaagcaccccagacaggacccagttttataaggagggaaggatgaagaaaacaaaaaaattcctggaagaggtaataacatgaatagaagcatggagataacttgacaggaaaaatagttcagcttaactgaagcttaggagagcatacactaatttttaaagcatgaagaaaactaaaaccatccatctcattagccgaagataacagttaatagtctattatacagtaacaaatttccatactctccacccccatgaacagatacaaacatgtaacaaactgagaagggttgttttgtattgtaatctgcttttgtcctccatcctgtcccatttaaatgttctgaatatttttccatgctattcaatgttatttgacatgattttttaatagggcataatactgcattataaagaggtaaccatctattctcttactgagggatatttactatttcttttttctgttctaaaatgtttcagtgaacatctttgctaataaatgtttgtatacaggcatgactttttttttttttttttttttgagatggagtctcgctctgtcacccagactggagtgcagtggtgtgatcttggctcactgcaacctccgcctcctgggttcaagcaattctctgcctcagcctcccaagtagctgagattacaggcacccgccaccacgcccagctaaaggcatgactatttttaaagaaacagctacacagttctgttctgatctactggcaaaattcagaatatgtatcaatacacatttccatcaatagtgtatgacagtgcctactagttaaaaaatttaaatagtatagtgcaaagtaatgaacacagcccattaacagtttctttatcctttcagagacaaaataagcacacagaaaagtatacagggatatgtgtgtactctctctcccccatgctatttttaaaaaaatactaatggtagcatactctatacactcttctttttcacttaacatatttcaggcatgatagtttattatttcctaaaaatctgcttcattcttttaaaataatgaagatctactgaatagatgtggtattggtaggcatttaagccatttcccattttttctttaagtaaatatcctcaaacataattcttagtttatgtaatccataagacaagttcttggaagcagaactgttataactcctgcaacacatgaaagagcttgctttccttcacattcccccagaatgtgatgaaattacctttgccaataaactaggtgacagtggcattactatagcattaatctatatttctttctatattttctcttactagaagaaacatcttggaaaatatttgttttctatgaacagtttatatccttggttaggtttttttttttttttttttttttctgagacagggtcttgctctgtcacccaggctggagtgcactggcacaatctcgactcactgcagcctctgcttcccaggttcaagcaatgatcgtgcctcagcttcccgagtagctgggactacaggtgtgcaccaccatgcccagctaaattttgtatttttagtagagacagggtttcactgtgttgcccagacgggtctcgaattcctgacctcaagtgatctgcctgcctcagcctcccaaagtgctgggattacaggcataagccaccatgcctggccaattattctatgttttagagacggggtcttgctctgtcactgaggctggagtgatcagagctcactgcaacctcaaaccactgagctcaaggagggatcctcccatctcagtctcctaagtagctaggactataggcacatgcaaccacgtctagttttttgtttttgtttttaatttttttgtggaggtctcactatgttgaccaggttggtctcaaactcctggcctcaggcaatcctcctgcctcagctgggattacagagtgtgagccaccacacccagctggtttcctattacattactctttccattaatacaagaatgattctggagcaactcaccagatggcttttcaggatcaagttcttcacagaacttccagaagtgatagaaatcttcaggtaaagaaagcttataatgattttctacttcttttcgaaggtcactggagacatcagcttcacagaatttacttttcttcacatcagttgttttttcacactgaaaattggcacacaaactttagttctccaaatttcagtaactctccttgcataacagtatctatcactcttgttcacccaactctatgaaatacatgtgttttccttaaaactctctaaatggtctttgagtaaaatctgggaattcatttgggcacaggaaaaaagagtagtttatatggtggttaagaggaatccacacagcaagtctttaaatatatttttgtaagataatggaaaccacaaaaaacaaaaaggtaaaaaaaagaaataataaagagcaggaagagaggaataaagaaagggcagattttgccctcttttggttaaaggtgtgagtcttttaaacagattcattgatcaaatgagaaacaaatagaagtaactggatataagcaattcatcagttaaaaagctgtttctttagcaacttctagagttgtgtctgagctattcactacaatcattacccagccttaaaaacagatacctcccttttgattttccagataaagagggaaggttagtgacaatgttaaacatctatagttcctaataaagttagcagaatagcactaaactctgggccaaaaatccaattatttcagaaaaggccttttaatgccaggatgaagttataatactcatctctaggaccaccacaatacaggttcattatataagtatactaggttttataatgcctactagatatttgataaatttctgtaaagacaatatgcttaattggaagttacgtatgtttagttttctaagcagcaatctgtttttctatgaacctagattctttctttttggattaagttctttcctttttattcttcctacctagagcagtggttctcaaccggtggtgattttgccccccaggggacatttggagacctatttagttgtcaccaattggaagaaacggtgctagtggggcagaggccaggtatgctcaacatcctataatgcccaggataggcatcctcaacaaagactactggccccaaatgtcaacagtgctcaagttgagaaattctgagctagatgtttctcatatttatatatttttttattttattattattatactttaagttttagggtacatgtgcacaatgtgcaggtttgttacatatgtatacatgtgccatgttggtgtactgcacccattaactcgtcattattaggtatatctcctaatgctatccctccccccctccccctcatatttatattcttctattttctcagtagtctgaagtttattaacgttaggtatcattcaacgtctacaaaatgtaatcagatgatacaagaatggtcatggtggcattaattccaagagcaaaaacagaacaaatgaaatacctattgttaggagaacagttgtaaggttttcaaacaatagactattacacttaatattacagttgacccttgagcaacaagggtttgaattttgtggacccacttatacatgaattttttttccaaccaaatgcaaataaaaaaatacagtattcttgggatgtgaaatccacttatagagagggccaacttttcgtatactcgggttccacaggaccaactttggaacttgggtatgctcagatttggggatatatggaaatttgttactgtatactagactattaactgtgttatctttggctaatgagatggtttgttttcttgttgctttaaaaattagtgtatgctctcctaaggtcctggaaccaatctccgtcatttaccgaatggttactctatggctacacaatatggaccaacctatattcaatatttttaatgaggaaaaaagctcttgattatatgcagcatgatagcctttttatgaagttcaaaaactaagaataaatattgtttaggtatacactcatgggagataagcctatttttaaaaggcaagggaaaacaaaattcaggatagctacactgaaaataattgacaggaagaaggctgaacggataggagaggaacacgtgtagatgtagagctattgtctgtttcagctttgggattgggcaatgggttcactggtgtttgttacattacttaacataaataaggtcaaagacgatcatgaatatggtaacagtttattatgccaaggattataatgtgtctgatttataaaaaaaattacgttcaacaaaaagcctgttgaacaatgaatccaaaagtgagtatcaataatagcaaatagtaatagtaaagataatataatagtaaaaacaagtagttaagtgatacttactgagaacttattttgtgctgtttcactgttctaagcaccttctgtggattaactcatttagtcctcaactgtctcatgcactagataccattaacctcatcgtacagctgaggaaactgaggttaacctccctacgtccctaactaggaagtggaagagaagggatttaaactcaggtttaaatctgggtccacagcagatcctcaaccacttcactatgctgcttctccaacatcaaatatagaacagtaggaacatatgaagtcctgagctatcctatcttctgttttcataactgtctttgttcagacgttcaaagactggctccaacttaagatgttagaaaaggcttaatctgccttgctgaaaggcagttttgcataatagttaggttgcctgggttgactcctgactctactgatttccaaccttaggcaagttacttaacctctctgtgctttgttttctcatctgcaaaaagggcatacagtgcctatatcggggttgttacaaggaatgttattatatgtaaaaatacacagaacggtcctagcacataatatacaaatgctggccattacggttatagtctctacagactcatcttcatttctgttattgtatttctagttaagcacatcactccaccaaagcagttcttcactgcaccttcaaaaagagaattttttcagctgtgcctttactcacacactagttcagcatctccatagccctaacaactaggatttagaacagctgtccccttcagaggctacacttcttctttaccctggtcttcctagaatgcatgacccaatatgaaggatgcctataccgatggccctttaacagttagttaagccctctaagaatgtctcaccctgtccgatttatgacactaccagagtaacttttctaaaactttagttatcacaatggcacttctttcctgattccccttattgctactgtagtggttacagaacttccgaaatcgtagtaaagtatgagaatgcacacactctctcctcctcccctctcagtagtgcttttatgatcaggtccctcttattttcccatttccctggctccagccaagccgaacgctccgctacgcccaaacatctcctacagttttatgtctcagaatcttacttctctgccttcaaaaccaattttcaaagagttgtcttaaaagtcttctttaacaccccctgggacttgttaaatcctccttcagtgtttccatagcactttctacacaccagcgttataatcccaaacaaaaaagtcacagtagaatgcatatttgcttgtgcccctcctccccaggccgagggctcaacaagcagcaggagcaagcaggttgacccccaaatccgcagcgccccacagaatgtcaggtatgtaatcggttcccaatcaatctggctgggcgaatgaaccattggttggcttaatccgtttccccaggaaatgctccaagaggagctgggcagaagatgcagaggagctactttcctggtccaaccccctgcagagcgcgaaacagcggccctgggcaggatccccgcagcaaaccgcagcccctggacacacagcaagcttaatagtcactggatgaatgaaaagcgctgcctcctggtgccctggctgtcacccaaagcgccccgcgtagcccgcacagcctttccggcagtacctgcggcccctccccgccgggcctgcgcttcccgccaccgccgaccattctgcagctgcagcgccagcagaattccccgatccgcggccgcttccgagcgccgccaaccgcttccgggttcaaaagcctccaagccgaatttcagcgccgcccgggctcgccaatttaggggaaaggctccgcccattccccgccccctgagacctggcaccggacgcgttgaggccccgcccactcccgtgctgggcgcgtgcaaggagcgtcttctgtcagcgtagtctgcatctaggctttctggagcatcttccagggtcgctccagagaccccccagactactgaatctgaatccttagagtggtccaaccttcctcttcaggtgtctactagaggcaaggttggatgtatgcggctgttctcaatacagccccttccttgttttttcttcatttatatttacttaaaatattaatccttttctccttctcctccatccctctccctaccctactgtacggttattggcttacactaattcattcccgattgtctccaagaaggaaataaatgtctgtcggtctctgtctctgtaccgtcgtcttcttggtacaatttggactgtttttcctctacaccgctgatatgcaaagtgtagtccctgaaccagcggcctcagcatcctgagggaatttgttaaaacgccaaatctcaggccttacccagacttactgaatcaatatctgcatcgcaacaagatcccctggtaattcctatgcacataaaatttggaaggcacaactctcaactgatgtccttggacctccttcacatccatcctgggaaggtcttattcctcattcctgagatgagttctctatttcctcaatctgggtgttcctttttcttgattatataccctcatgttgtggaacatatccgccaatagttccttgagagaggttgctgccaggtcttttttcccacagagtgtgcatgtctggaaatgtttttattctggctgagcacagttctaggttgaaaataactttcactcggaatattggagggcttgctccgcaatattttagcttccagaattgttaagaaactatgtcgttatatttccttctccttcacaggtcactaaatttcttgatatgtaacctgctttcctttctgttttgttttgtctcaagaagctttaggatcttttctctgtttccagtgttttttgttttgttttgttttgttttgttttttttgagacggagtctcgctctgttgcccaggctggagtgcagtggtgccacctcagctcactgcaagctccacctcccgggttcacaccgttctcctacctcagcctccggagtagctgggactacaggcgcccgccaccacgcccagctaattttttttttttttgtatttttagtagagacggggtttcaccgtgttagccaggatggtctcgatctcctgacctcgtgatccgccctcctcggcctcccaaagtgctgggatgacgggtgtgagccaccgcgtccggcctattcccagtgttctaaaacactattgagtgtcttggttatgggtcttttctcattcctatcgaccagtttttcaatcctgaaacacatgttcttcagttatgggaattcttctggtattatttatttgatcatttcttcccccccaccccccatcgtatctcttcttttttgaaatttgttatttagatcgtggaccttcttggctgatgttttttcttacctgtctgtcctattttctatgtcttcatatttttattctactttctctgtgactttctcaacttaattggacaattacttaatttctttattatacttaataaagattaattacttaatttctgtattatacctttatttctcagtgctctttttattctctgttcttttatagcattacattatttttcatgaatatagctccttttatctctgaagatgtcaattatagcgtttttaaaaatgctttctacgtaactctgcattgactttgattcttttgagtcttttttggttgtttgtttgtttacatttggttcctgttgtttctgctagaggcattcttcatcttgtgtggtgatccttgctgtcaatttatatgtaaaaatgaggctctaaaaaggtgctttggggacataggcaaggcttgtttactgctggacaaggtgtaagatgatggggaaagaaccagctgtttattttcttctagagagtaatcttctaattactcactttgagaatatacagacttcttggagcccaatgcaggaaggaggctgggagtcttaataatttcattatatgcactgtattagtcggggttctccagagaaacagaacaaataggtatctatttatctatatctatacctacatctgtatctagctatctattagctcacgtgattataggggttgagaagctgcataatctgctgtctgcaagctgaagatccagaaagcccatattgtagtttgaagccctgataactggggagccaatggtgtagattccagttcgagtttgaagtcttgcaaaccaggatcaccaagggcaggaaaagatcaaagattcagttcaagaatctagcagagagagagtgaatcctcccttcctctacctttttgttttattcagacccgaatggataagatgatgcccacccacattggtgaggataatctcttttacttagtgcccccgcagacactcagtaataccgattaaccaggtatctgggcatcctgtggtccagtcaagttgacacataaaattaactctccaccgcgtgtggcggctcatgcctgtttcccagcactttgggaggccagggagggtggatcacttgaggtcaggagttcgagaccagcctggccaatgtggtgaaacctcatctctactaaaaatacaaaaattagccagtcatggtggcacgtgcctgtagtctcagctacttgggaggctgagatacaagaatcacttgaacccgggaggcataggttgtagtgagctgaaatcacgccactgcactccagcctgggcgacagagtgagactccgtctcaaacaaaaataagataagatataattatgcataccttcacttaacaccactgtttcataatagcatttttaccttcagctgtgtctggtgtccctgaatccatattctggttccatatctcccaaaagaaacaatcttcaggttgggaatggaggttagagaatgtttccctgactttgccaggggaggaaatctaggagtcttaactgcttctgggacttttaatggtctcttttcagctcaacccactgaagaggtatggtacttccaattcctgagccattgtgaggttctgcagtgtcagtgagcttgcttccaggcatcatctctgaaaacacttgggttttctctgggaagtccatatgttcaccagtatattagctccctaaagctgccataacaattaccaaaaactgggtggcttaaaactatggaaatttattccctcacagttacggaggctagaaataaaaaatcaaggtgtcaggaggttggttccttctggggactgagggacaatctgtgccatgcctttgccttagcttctggtgactgctggcagtccttggtgttccttggcttgcagatgaatcactccaatatctgcctctgtcattacgtgttctccctgtgcatctgcctgtgtctaactttctttttgtaaggacagcagtccgttagattacggcccaccctaatccagtatcactttatctttttttttttttttttttgagatggagtttcactctgttgcccaggctggagtacagtggtgccatcttggctcactgcaacctctacctcccaggttcaagcaattctccggcttcagcctcctgagtagctgggactacaggcacgcaccaccaggcccagctagtttttgtatttttagtagagacagggtttcaccatgttggtcaggctggtcttgagctcctgacctcaaacgatccacctgcctcagcctcccggagtgctgggattacaggcgtgagcaccacacctggctgtcactttatcttattttgatcacatccacgcagaccctatttccaaatatggttacagtcaatgtatcctttggggggatgcagttcaaccacatcaactgatttctaaagttttgtggcatttttcagttgtctcttctccagttttctttgtttttatgagtatatggtccatctgtccccctttttaaccttctttatctttgttttagtgaggcttcttaaggagtggaggaaagtcgatgttttcaaggtatgttaagtatgttaactggaggatttattgttgctatttttcagttgaataacatcaggttggcagttgtaacctgtaaaactgcacttattatatgcaatttcaagttcagaactaaaactttgctctgaataataatttgtaaccatcttttatagaatgaaatttctattttaattcaaacatttgacatttaatatattttatcctgttcatatgtttactccacagtgattttgaaggaatgggtagagttgaccaaatttggtatacttcttcaggttatcagtgtctgtcattttgaaacaaagttattattaataaatgttttatatctagtacttactatgcaatactattcttttctaatatttatttttaattgacagataattgtgtatatttatagaatacaatgtgatgttttgatatatatatacacacagtggaatgattatgtcaagctaatttacatattcattacatcaaatacctattgttttttggagtgagaacatttcaaatctactcttctaacaatgttgtcatatgtaatacattattattaactatgttcactatgtggtgcaatagatctcaaaaacttattccttctgtctaactaaaactttgtaccctttgacagtatctctgcagttcccatttccaacccccagcctctggtaaccagcattctactctctacttctgtaagttcaacttttttagattccacatataagtgagattatgcaatatttgtctttctgtgactggcttatttcacttagcataatgtcctgtagtttcacctacattgtcaaaaatgacagaatttcgtttgttaaggctgaatagtattccattgtatatgtaccacattatccattcatctgttgatggacacttatgttggctattgtgaataatgctgcaatcaatatggatgcctagacatctctttaacatgttgattgcaattcctttgtgtatatactcaggagtgcaattgctggatcatatagtagttctagttttagttttttgaggaacctccacactgtcataatggctgtgttaattaccactcccaccaacagtgtacaagagtttcctttttcttacattctcaccaacccatgttatctttgataatgtctattgctattgtaacaggtgtcaggtactatctcattgtggttttaatttgtatttctctgataactagcaatgttgagcatttttgaataaaccacaataatactaagtgctttgctgagactgatataagccacataccagtcatgtgaggtaattcctatttgtactcccattttacagataaggcagctaacattcaaagaggttaagtgaattttccaaagtcacacagcaagctctggaggtgggattcaaacctgaatagtctatcctttcagagtactttcaacgctatgcaatactgtctgtctagcaatcagccagattaaataaagtctgtagttcacagagccacttgcatttttaatcctagtttaattaacttaggaaatttgtatctaaaggatgcatctttaaaaaaaaagagagagagacaggatctcactgtattgcccaggttggcctcaaactcctgggctcgaagccatcctcccatctcagcctcccaaagtgctgagattacaggcatgagccaccacgtcctgccaggatacataggttttactgtatcctctgaacctccctttaatcaagagagtggacaaaactgtgggtccctcattttcaaaacggccagtaaaagaggaaataaggaaatgcaatgtttaactattctgctgccctctttaagttgattgaggacctctttgtcactacttcaggaagataacttaccttctcttattcactagggctaactggagcttttctcatgtatttatggttgctgggaaattttcaaataaaattcactgggagtggtttgaaattgcagaatttttagcctctcaatgttttgttttcctctagtgagtttgacataaataatatcctcttttgagatttgtatctttgaaagactttttttttaagtttctcagtgaaacaaagaaaaagttagaaggtggctgggtgcagtggttcacgcctgtagtcccaacactttgggaggccgaggcaagtggattgcctgagcttaggagttcgagactagctttggcaacacggcaacaccctgtctctactaaaagcacagaaattctctgggcatggtagcacatgactttggtcccagatactcaggaggcctaggtgggaggatcgcttgagcccaggaggcaaaggttgcagtgaaccaagattgcgccactgcactccagcctgggtgacagagtgagaccctgtctcgaaagaaagacagaaaaaactagaaggatatcagttttattagaaaaaataatttaaaaattgccagtttccctagaattaagccataatatgtccatagctttgtatcagattgctgactttgcctggggagaaagttatatttgtttgtatagttttttccttttttgtcaaatctggggtgacacaatggtcatcaatatacttttagatctatgtcttcattggggatgatgctagtgagcttacgtggaaaaattatctgtatgaaagcagaattgattggtcattgccagcacctttgattttcccttaataattataatatgataacttaaaatatgtgtttttatagaaatctgtgtcaaacaagatatatagaatgtgattctgtagaatactaataaatgagaattcagatgtgggctaccagaactatagagtgacaagtaaaatcagtgaaatgtaaggatggcacagttcgaggttctcaaaccaaataaaatgctaaaaaagaaaaggatcctaatcacaatacagatttagagaacacacaacaatagtagctatgaaatgtatatttttcaggtctaaaagttactggatttgctatgtaggtggtagtccttggtgaaacatggattaataaaagacagaaaatggaagcaagagttcctatgtattctttaagagcgtctgattctagcattcatctaaatttaagctctagatcaaagagaatatttttagactgggtgtggtggctcatgcctgtaatctcaacactttggtaggccaaggtgggcggatcacctgaggtcaggaattcaagaccagtctggccaacatggtgaaaccccatctctaaaaaatacaacaattagccgggctcggcttatgcctataatcctagtacctgggtggctgaggcaggagaatcacttgaacctgagaagcagaggctgcagtgagccgagatcccaccactgcactccagcctgggcaacagagcaagactctgtctcaaaaaaaaaaaaaaaaagagaatatttttacaagttttttctttttttttcaatctttgtgcactttgaaggccatagatgtcatagctagcttcttaagcatttctttctgcctttgttatgagagctgctgaaaattaaagacaagacaagatgccacttaggatcccaggacttgagagtgtagccagacattcagcattaacgtgtattcagggcagaataaccacatagagcagcacatgtgtaaggaattacaggcttatccaattgaatttctaaggttctaaatgatggaagtcattcactctggcagtcaggattgagctgagtcctgtgactcacgctgttggccaaccctggaggataaatcagctttgagaaggcccagagcccccatagccttatgattctgattcccaaataggctgtaaaataggacttcttttaggggctattcatagcagggggacctaatttgggagatatgggtgattgtattgcagaagaaacagatttgggaaggataaactttttttctaatttgctgtataaaagttagcagaagcttcaggcagagctgatcctagacaattgttattgatgggctgcaaatgagctgtagcattaatctttgacactgcactcttggccttacctttggccactttgactctggcaaattatacagctaaatggtggtgaaactggtctgcccaattatgcttaatccagatcagttactctgggaccatgtaacccttaattagcactagttggatgatccaaacacatctttgaaaggccccagaggttctccagtcttcatatttacagtggatgaaaattccagctgattcgccaattcttttcctaccacaatttcttagaatctagctctgagcacaaactggcacataatgggtgctcggtaaatattaattggcttatcgacctctttaatgaatagcagtcaccatcattaaatagttacttgcccatcctttcatccattcagttatttgttcattcagaacatttattaagtcccaattatgtgtcagaactatgttaggcactgaaaagaccaagatgacacagttgctatgttccaggagcttatagtgtactgaggagtcctataaatgtacagtcagtattcctgctagtcacatagaagcagtgtaagaattatgtaagtctttatcacactccaaccttccagacacattgctccagagtagtctctttaaaagaattgatctaatcattttactctgtgactatcacagagttgatcagagcaaaaattctgaacgactagtgttaccaccaggaaataagaagtgacacaacaaagggcgatatggtagagagcaagctcaggtaatatgaggagtttgcgaggtgatgttacaagggaacatcaaaagcagcaactgagatcaagattgtggaaaatagccaaggaaacaggagctgggaatgtagggagcagttactagaaggatccaacaggatattactattgagtaattgccttgtataaggtcattctcctcaccttccaagttatgtgtttaatttctgaatataaagttatacttaattttagggctgggggcagtgggttattcctgtaatcccagcactttgggaggctgaggtgggaggatcacttaaatccaggagtttgagaccagtctgggcaacatagcaagaccctgtctctataaaaagtagtaataattttagaaaatttgaatactatctaaaaataaaaagaaaattaattatattatgccacctagatgtagcctcagacaatatttggtatattcagtatttttctacatgtatcttattatagtttgttaaatgaaataatgctgcacataaaatttggtaataggccttaaaaagtaagcttaataacaaataaacattgtaaaaatgcttcatcaatattttaatggctacataaatatgccattggacaaatgtttgataaagtaactgttctcgtagttataagtttttactgtgtgtcataactttttattgctatgtataaccctgtggtcaacatttttgtacataaggttttaaaaaatattttggaatattaccttagtttaaattcttagaggaactgctggcttcacagacaggaataaacttagtgtcataatccatattcccaaattgctttgtaaacaaggcagtctgaaattgaacaaaacaatgtaccacattgtgactacagttaagaatattgtattgcatatttaaaatttgctaggagggcagatcttacatgttctaaccacatacacacacaaaggtactgtgtgaggtgatgctatgttaattagcttgattatggtgataatttcacaaaaatatatgtatattaaaacatcaagttgtacaccttaactatatagaatttttatttgtcaattatatctcaataaggtgggggtggggaaggagagtaaaataaaaacgttttaaaataaataaataaacagagacaaaataaaaagagcatatgttattttcccattggcatgagttaagggcactgctgcttgggaataacctacacatggtaggataaaaaagtcagggcttatctgatttatctccattctacttgtcttcagccccttcagagttataacctgaaggtcaggttttacaaaatgcattggacgaaagattggcaaacccaggttctagtcccatccttgcatttgtctgctcagaaatcttgagcaatcactcaattgttctgaaacagtttctcaaactgtaaaataaagatgttggaaaagaagaaaagaaaatggaatgaaaatgtgtttttatcagttagaagcagtattggagagtgctcttttcaaaatagcattgtcatgaaacgcaatctttgctaattgttttgtttagtatttcttttgaggttaaacagtgagatggctattttgtgctcagctttccttagcatgaatttgtggtaggtaggaggcgattgtctagccagggactttatttcccagcctaccttgcatcctgatgcggccacatgatgaactgttgctgatggcaagtaagtaggagagatgcgtgtcacctccaggccaggttttctcaagaagcaagggtgacttcactttctctccctcctctgccagctagataaagagggctttgaggctcttgggataacagagccaaagttagaaggaacctgagcctctaccaccacacacaggcaggccacctgacaattcacaacagctgaatttgattggacttctttatgagcaagaaataaacttttattatattaacccactataaattaatgttggtattcatttattatattaataatagctagcgttgtccttttcaatataagaatccacataagattatcaggtaaggaaggcagcaagctgtcctcttttaaatttaactgtagaagccatatatatgttgcaatgaacattaatgatttaatatattaattaaaaattaagaataaaatacttgcataacaccaatcagcacatttttatccatccatctacccgcccggccatcatttagcaaatattcattgggggtcacttatgtgggaggcattgtgttggtctctataaattccaaaatcatttagccactgtataccaccctacctagaatcaatggtagtctgctccaaacagatttatcaggagcttttttttctgggaaggaggtaagatttcaaaattattcatgcacttttctacctgctacatgacggtgagagagagggtagtaattgtacataaagacagtgtatgggaaggggattccacgggcagcaacgaaccaggacattatcagggtggtccatggaatctttgagccaagagagataagaaaatgtcattagaaagtgagtcaagattgagagatgtgtggaaaattaggtgagaagtgagtctttgcagttctgctgtaaatgtatgagcaggtccttgaatgcttctgctatggtttgaatttgtctccacaaaaactcatgttgaaatttgaaccccagtgtgatggcgttgggaggtgcagccttggagtgatttgggttatggaggcggatccctcatgaatggcttggtgttgttcttgcagtagtgagtgagttctcactctctaaaggctggatcagttcccacgggaattttcccaccaaagtgggttattataaagttaagaggcagcctttgagtttggcctcttcacacattttgttcttcctttgaccttcttcaccatgttatgatgcagcaccagatgccagggctctgcgcttgaacttcccagcctgcagaaccatgaactaaattaacctcttttctttataaattacctggtctcaggtattctgttatacaaacgcaaacagaccaaaatagctccttgtcagacaagatagaatttgatgattgcccctggtttttaacaaggagcaatcatcaaataaggcaaaattagaacagtattttttttctgttcttactttctgcttttgagctgtgtcttagataaatagaggcctgccagataaattatttctggataaatgagagactgttttcttattttacatttgggaaattagagtcatggaa

SEQ ID NO: 12006 - DNA, 33756 bp, Human
cagtcaggcttagattgctgcaaaaaggctttgcaggctggacaccatgatttgtacctcaaatctggctgctatttcccacactcctaggtcccaaagaaatgtgggtgaggtcctgcggttgacacaccgtcactgtcatactactggaaaaacagcccaaactgtttgcctcaatgatattgggtcaattgtgtcatcttcgtgtgggaagaatgccctaattatcattactccctttggacaaaattagcaagtcatttataaatcatttcactttcctccctatttgcctcctcccgcttccttcaggttccatccctcaaagtcattgggaaaagccttgcaaactggatagcagttttgtgcatttccggttcaagctgccttactcactttttttttttaatttaaaaaaactttggattttttgtagagacaggatcttgctatgttgcccaggatgttcctgaactccaggcctcaagcaatcctcccacctcggtctcccaaagtgctaggattacaggcatgagccaccacacctggttcaccttactcacttctattccaggacggttcaactatgatgttttggctcctcttctcaagcagctttccacacctggttccatgatctcttctggcacagtagctggtatttggcaaacataggtttcatcctgggatctcagggattgaaatctgtcctaggtgtgcaccagaaagtggtggcaagagatgaagcttcggaggaggctgacctcggccaggattcttaagtctcaaagtttcagctttctcacccctcaacggacatgaaatctacctatttgtaactccagggaagtaaatgagataatgtttggaagatatctagtctaccagctgctcaggcggggggcgaaggttctgttccctgtcccttctctatcaaatggctttaaaatcagaagaaagtattacgggtaggaaatgggactgcgaaaaaaatggaggctgattctggcctaaaggatacttatctctatacaaagggcttctgattcaaagaggccccgggattcaaaaacacaagcagagctacaccacgtggggtttgggacgagctgaattccggataaagatgcctgtaaagaggagttgatgcgaatccagaaaagcacttgaaatgcccaggctttgcatggcacattccccaggattttttcgcaccgcatttagaggtttagacggagtgagctcgaatcaggccaaaagccttaggttactcctgggcggcagcggggcagaggtcagatcaacaggtgtggaaggctgcgaggtgagggaagaagcaggtgtcggtggaggccccagttcctccggcccagaggctccaacgctgctattggtgttccagcagcgggcggaggggtcctgcccggcatctgggcgcgctgggcccagagcccgggaggaggcagacggaggcggcgggtcagcggcgggccagccccggtgggcttccgctcccctccgccggcccggtccggcccgccgcggaggatgcctggaggttgacgtgaatggcctgtggctgggaagcccccaggcgccctgcctagcccgggggcggggccgcctagccgccggccccggtggcgtgagggctggggcgggggccggggacctcgcggggagggagcgggagggaaagcggcccccgcggcccttcaattggccgcaccgcccctcggcgcagaggcgggaggaggcggccctccattggtcgggcccggcggccaatcctcgaaggcccaggcggaggcgggggcggcctgtggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaaggtacgcctggctcgggcgggcgcgggggcccccggggcacccttgggctggcctggcgctgggccgtgcttcgtttgctcttcgcgctgtggctcaccgttttcctggagaggggccgtcgaggcggcgcgagcgtctctgcctgtcccggtcgcgtccagtccccgggcttgcggggccggctcccgggcacccgcctggctttgttcccgcgccgtgggacaggactagtggctggcggtgggttcccgggcgcctggagtcccgcggcgccagcctttccggctgcgggggtctcgggggccgtttggtgactgcagaacgcgccctccgggaagggggcgctcctgcgtggccactcgcccttaggcggagcccgtctgcgcggccagggacccggcgagccgctgccgcagcccccgccatctgcccgggccccgggtgctggcggactccgcgcctccccacggggagagagaccgcctaatgtcccgccgaccccaggggccccgaggaacggaagccggtccgggacccatcacagtctccgatctcggtgcctgggaggcatttggaggcagattgctgctgctgcttctgctgttgcttttgcgggaaatggagacaaagcctgagcgcgccactgtgcgagtgatatctgcttaggcttgagactttttatgaaacactgagaagtttgaagtacattagactttcacgacataaaggagtatttttgtgggttgcttttgtttggggcttgtttgctgaggcggcttatagtttggagcgattgggatttggtgacgctcagctttgccactgagcccaagaatgcgttaggtttatctttaggacttttggcctgggaaagagatgagaggcgtccccctccccaaatcctctccttccttcctccctccctgcattccaagcccatgacatcaggggtttctggggggagagaccagccaatcggcgcggaactgtgcacagaacgctcattgtctcctttctgctgttctggccaaagcgccacaaaggagggctgcctgtggtttaattcccattaacctcccgggagcccaagcatgtcaggattgccaccgcaccgtccgaccgctggtggaaggcactggcattgtcagagctggaacatcccggggctgcgggggtaggcggtgtgaagcgaattatgtaaagaggtaatgaagcgcaccgttgtcaaaccccaagggagagttgtggctcttgtctcccgctgttagtctgcacatcatactgtctttgaagcaaggagttgattttagtctatgtatctaaagttgaaatgtttaggtcctttaccttttcaaacgtgttgcccgtattagacaacagtttgctaacaatttttttagagagcagaaaggtgaatggtttgtgtatgattgagtgcaaacctcaccaactgaaaagtttgtaacaagttactgtttccttccttccaggatttacaaaccgaactttaggaaacttcagaggaatgggcatgtccaaaatgttggatgtgatgtgatactttggcctggttgtgcacattcattgtaattccccccagtgattcttggctggcagcagttgagtctctactaccttttgcattgtaaatgaggtactgataacgttggcagcccttcaagtgacttacttttcttggatgttaataatatccatgctaatttcttttttgctgactaatgtagcagcttttgcccttttcctgcttaatactgagcagatccaaggaaatgcatacacaggctagatcactgtaattattgtaaatatttaaaaacggtaaaacctcagtttttagaacctttggaaagttagttatgaaagctgtggatttatccctttaagcaccaaacccattttttaataacccgtttcatttttgtagtcctttcagacagtattctttcataggaagtcttttgatcttaacagcagagcagtcctgtaaggtgaggaggattgctgggattatccaacatcatttacagatcagtacactgaagctcagaaagatttgctcaaggtcacagaagttggactattctaagaattttaactctaaaagcgatgtcttagttgagtgaagtacttagggatgttctacacaaactctgctgtctgtcgccttccccccatttttttttctttcttttttgagacggagtcttgctctgtcgcccaggctggagtgcagtggcgcgatctcagctcactgcaaccttcgcctcccaggttcaagtgattctcctgcctcagcgccccgagtagctgggattacaggtgcctgccaccatgcccggctaatgtttgtattatttagtagagacagggttttgccatgttggccaggctggtctccaactcctgacctcaggtgattccccctgccttggccttccaaaatgctgggattacaggcgtgagccatggcgcccagcccttcctcccatttttgctacccacctgtcacttcttgacattgtgattatttatgtcatactgtttctgatctgttctgggcctgggaatcaaatagccatgtttgctaggcctttgtatgagatgctgcattttgactgaggcctcaggactcccgggtgaaaggtgggtatatacaaaagtgacattgcgtggtttgacaccttttgattccttcctgctttttctttattgcataattgatacattgcttgaatgctagattccccccatctacccccacatctcatttaacaaagaagtatagaaacatcctggggagacagtgtggagtggacctgggagtctagcatatgtgagttctagtccccgttctgccacttcctgccttctgtgatgctgggctagctacttgacatctctctcctagcttctgttctgtagaatgggggaaaacaatagttgccacccccagacaccatgttgtggagatgtgtctggcttatactcaactcagtgactgtattgtagctattagctcttagtaacagaaaattagtttttagtattatatttctaagatttgtatgtccctgcctctttaagtatttggtttgtattaataccttttggtcttgttatataatattctagctgtaaaagcatttcatcaatgaattgaggaagtctctgattttaaatactttaatcagtaaaatttcagagaaaaatctttaagacatttgattggtaagatgataatacatggcagaacacacaagcttactttttttaataggcaagaagatgtgtgaaaacagccttaaaaaaaaaaagcctaagaattccagtctttcagcctggaatatgaacaaagtttctttaataacaaagaaaaaaatgacaccaaatgatcaataacttagagtttacaaaaactatcagagagtaaaagggccagggaaaatgcagacactggtagggatggttcggtggaggatggaaacactcataaaataatgggccctacaggtattctacaggttgaaccaggcccttgaatgcatcttgggaaccaaaatgaaaagtgaaacaactctgtgcctcgtaaaccatgaaaaaacataacaggtactcaagggaagcacagtatttcctggcaaaatgttggagttgggggtagtttcccgtaaagttggatgggaagagaggacgcagtgaagcatgtcttcatcaggtttagagcaaatgccgcaggaacctttcttacaggtctcagggaaagtggaaaaaataaattgacaaatggggagctgaaataatcttacctcggtatgtttttttgggaggaagctaactggaatattaagaagcatggaattggaatgcacattcttccagtcttctgcccccttggaatgtctgatttgagcaaagcagcttcccacgggatcttcttgattacaaaatggtatttctcaacacctaaaaaccttcttgaaaggcttattaccaaaatctttggttgttgaagttaaacaatcatacagtaataattagataggaccagtgtccgcgaagtcctcctagcttgtttgccgggtgcgctttagacgcacagctgctctgagggtacttctgatcagagtaacccagggtgacccagctataaattacactcgagggtggtttgccttgtcttgctggtagagcaccagaatcttggtaaaaatgtgttggtgggcttagcttttttctttttaaacttggaagttcagaaattggtttttaattaaaatctttttttgtttgcttattatctgtctcttcccaccagagataaagctctcttattcgcgggtgtgtctcaagatcgatattttacaatatagtttagcacatagcatatgctcaataaatatttgaatatttgttgatttaatgaatttattcatcgggaatagattttgctatctctagacataagaagttagaaattaactctgtagtctaaataagataattctgtagtgcaagtgtgatgattttgaaggatgtggttaaaaagaaaatattctaaaaaatattttattttttgatctcgctatgttgcccaggttggtcttgaacttctggcctcaagtgatcctactgccttggcctgttaaagcactgggattacaggtgtgagccaccattcctagccttgtttttcttaagtagttaaatagttaatattatgttgaaatttttcatctttgctgctgattttgggattatttcttaagatagatattttgactgggctctttcttagacttccaagttaggaatggtagaggtgtcctctgcaaggatttgtccagtgcctgcattttcctgaatactgctggagaaggggccattcagccagggactttgctcctggtaggaaccagctattgctgttggtctgctttagtttttgttttcctgtcttgaccaaaacagataaataagatacactttgctgaagtgacaagagataccatgcttcctctttaaaattctcatccttatttactctggagttttaacgaggattatcgtcaggctcactgattttttacagtctaacatttgtggaaattgttctgtctctagacagtcctttagatttcagaaacaatcttgacaatgatgacatcgctaataccaccatcaacagaggtataggctttttttttccccagtgcctgtttcccttccaggttgggacatgagggttagtgtttcctgcctcctttccctctttaacagtgtatccttaaagtcataatgaatctgatctgcggcataaaaaaagtaagcacaattggatcgttttggtttttcacccatcattagcattgtattcaggagagtgaggaaatgcattttcttctctctcttttttatttttttgagatggagtctccctctgttgcccaggctggagtgaggtcgtacgatctcggctcactgcaacctccacctcccaggttcaagcaattctcctggcttagcctcccgagtagctggaattacaggcacctgccaccacatctgactaatttttgtattcttagtagagttggagtttcaccatgttggccaggctggtctcaaacgcctgacctcaagtgataacacctgccttggcctcccaaagagctgggattacaggtgtgagcaactgtgcccagccctgcattttctttctcagtgaaactaggtggtggttggagaaagcttgtccttagaatttgttggcaagttccatttaaatctaggcattaccctcctgtagcatataccatgtgcattggctctccttaactctgaacttattttatagcccaaatgggctcttaacttatttatgtgtacttgtaccctcagatttttgttaaggattcttggaactcataggtagatccaggttgtttgtggggacgaagtttatacaatttgggggtcctcattatgaaaaatatataaatatcttttaagttttacaaaaacctatggccatgtgaacccttttgaacttgaagacttctccatacctgtcatacaaggttcttgtcagggaaagtagagcttagtggttaagaacatggactgtgggaactgggttggattcctggttctgcatcttactgtgaactttggcaagtgacttaacctgcctgtcttgtatgtaaaatgaggatatcataacactcatctttatagggttgttgggagaaatcagatagataatccatgtaaagtgtttagaataatgcctggaatcaaaagcccacattatataaattttagccatggtttcattttgctgactggttctctgctaattaggctcagtcttgtgttctgagctgctttttctcttctggatgttgatattatctctagaactttaatattcattcacgaatctgtttgtatctgcctgagatttctggtggataggggacatgacaccaagcagtactactgtgtttcatttctgtgtcaggaatgtgatctgccccagagtccttatccaggactccaccaccaggcagcgtgtgaggcatttccacagtgaaagcaccaggtctgtagatctgcaccattctgtccacattgcccttagggctgaggacttctctgtagagctagaggtcttgcttaccgggcttggttgtattctgctttttctaacaggttgattccttttaaataagatatatctttcctttcttggtttcagatagggcttgtattcctccacagctagctggttaacatattttccttcaagtgtttgaatttggcttgcttgaatctggaggctttgagtttatgtgttcttatgaagtctctacctagacctgtgtgaagcaagtccttgagtggagaagactaatgcttagttttcccccacaaggtagggagggaccaggaagcttcagggtgtgggcgtgactgttgagtgctgtgtctgcggtgggaaggccagggaattggaggcatgaatgcagagaaaagaggaggccttttgtgcttggaaggactcttctgggtcagttgtaacctaagcatttatggttatttcccctctgctggataattttccagggaactctagctgtggagtggccacactgggcgggctatggcttcattgcttcttcccgcctccactcccaaatgtttggacactgatctttctccattatctgcagcttctcacccttaatgttacccaggctctgtgaatggatagagtgtgcttcattagtgcacaatttcctggtctccttttgtttcttgtgggaggaaataggagagaaaacaatcaataccatgtgtagcaagtctctgtcctgctgttggttaattcaaacatgtgattccactttgaatgcaaaaatagcaacagcaatcatattctgcttctaattgagtgtagaaattatatgtacattaggcatcatcttgtgagcttgctgtggtctttgggccttagcagctgagctggaaccctagggctgctctttagagtccacctatggctagatgccttcccctgaatggttccattctctactctgaatactggggtggattttccttatctttcttcaaagaattggatgttgtattttttaaaaaccccatccctacctctccttgcttacatacagacgcattctttgccagccagattttcatttcaaggtttattcatctctgagcttcccccccttctttttcttctttagtgacaccctttcctgcagttggtcttacatcaccttcaaaaaacatgcatgtggcaggaggttggtcttcatatgggccagtgggagagttaaagtgtttttagtctgaaacagctctgccaaatatcttatgaactttttttttttttttttgagacagtcttgctctgtcacctgggctggagtacagtggcacgatcttggctcactgcaactctacctcctgggttcaagcaattctcacacctcagcctcctgagaagctgggattacagtcgcgcaccaccatgcccagctaatttttgtattttttgtagagatggggttttaccatgttggccaggatggttttgaactcctgaccttaagtgatccacccgtctcagcttcccaaagtgttgggattacaggtgtgagccaccgcacccagccttatgaacttttgaactgtgctggcaatgcgctttggaactaaggattcctatgggcttgtttaaatcaattcctcccaccccttgccgacttttttttttttttttttttttttttgggagacagtctcactttgtcgcccaggctggaataccgtggtgtgatctcggctcgttgtaacctctgcctctcgggttcgagtgattctcctgcctcagcctcctgaatagctgggactacaggcctatgccaccatgtctggctaattttttgtatttttagtacagtcggggtttcactatgttggccaggctggtcttgaacttctgacctcaggtgatctgtctgcctcagcctcccaaaatgctgggattacaggcatgagccactgtgcccggcccaattagtcctttctacaactgggcaatatattcatgtgcattagtctgatacgatgatattggtggtgggtacatttggatatattgtcacatctccatgagttaaaaggactttatgttaagccagagtctaagcatcttcaggcagatagcatagttgcctgtgctaagactgtgtatagtacagagagttcctgtctctcagctttgttgtagagtagggataggggagcatccaatgatggaaaagacttagacttggagtcagatctgggtccgaatccctgctgagcccacaacctttggacaagtcatctctgcatgaagacagtacatctacctcagggtgccatcttccttgcttatgagaaccacttctctttatgccaacagttccaaaatagaaaagtaaataagtgaaagtatcctgtataccttactcctaccctaagtgcttgtactgctttgaatattgttcaaccattttgaaaactgaattatagtctgttgtatggatttccactgattattcactgcttccctgctggtggatatttcctttaaaagtacttgtgtagaaaagtgtgtaacttttgacataacatttaaatgtattttgatattgccaaattgctctccaaaaaaattagttcctaccaatggtaagaaagaggaggaggatcttttgatgttaaaaaaagaaaaaagtaacttgttttagtttctttattaccaagtcatgagtcattgacatctgtaatccctactccatccctcgtccccagcagactcaggtgggaattgacagtgggctgggatgagggcgttttttccacaaattatttgataatagttttttaaacaggaagcttggccaggcacagtggctcacgcctgtaatcctaacactttttgggatgctgaggtgggcggatcaactgaggtcgggagttcgagaccagcctgaccaacatggagaaaacccatctctactaaaaatacaaaattagccaggcatggtggcgcatgcctgtaatcccagctcctcaggagactgaggcaggagaatcacttgaacctgggaggcagaggctgcggtgagccaagatcgcgccattgcaatccagcctgtgcaacaagagcgaaattccatctcaaaaacaaacaaacaaacaaaaaatccaggaagctttaggtagctttaaaatgatatcttatcaaaatggctatcaaatcatgtcaagtaagtggtttttaatgatatattgaattcaaaggaagaaatctttccagtatcttgattggaatggccagcaaagcatagatggaaggataagtgttgacatttattgagttcttacaacttatgtgaattaactcattgattcttcccagtaaccttctgatgtaagtgctgttaatgatctctggttggcagggaagaaaactgaagcagaggaaactttgtgcatggtggaaatgggcttctaattcaagcattcagtttccagagcccttgctcctaaccattttaatctgaggccagagctcagggagaattgacatctttcaagacgagagggtactgagtccagagagggcagaccagagcaagaaatcccaggataaagtcctttaacaagaagctggaggaggagagattagagggccctcctggaaaatactaggtgctacagagaggcccagaggatgactggagacaggccactggatttggctactgagaagtcactgatgacctgttttgtttgagacaggatcgtcctctgttccccactccctgcaatccccctcccctgtttccccccaggctggagtgcagtggcatgatcttggctcactgcagccttgacctcctgggctcaagcaatcctcctgcctcagcctcccgagtagctgggactacaggtgtgcaccaccatgcctggctaattttttgtatttttcgtagagacagggttttaccgtgttgcccaggctgcactggtgaccttttgagagatcgtcggtagagcaaatttccaggggttaggagagagtactaagggaggaaatgggcaggcttggcatgaaataaatgacaaacaggacagtgtatgaggctggcagcaggttcaattaaaaatttgccatttcagggaagacagggtagcctgtgcccattgatggaccaagtaaaggcaacagcccaaaacagatggtgtgtgggggcaaagcagaagggcaggagggtcagcgggaagagaaggggcccagctcagaaggggaagggaagaggaccatgaaaacgcagcactgatgtggagaagtcctcttttcatctgaaataggggtgtcactttgctcctgaccttattatgctagagccactgatgtccgatggggaagagagcaggaataggaagagatggcccaggctaagccctccctgtgagcgcactgctgattgggctgcccctttggagcttgggcactggttcactctcctctttccattggcccttgatctggaagggatgggaagttgggtttattttgttagagcctggttgtctgtagcaagcctttactgtattatctccaagagacctttgtgttggggcatagcactctgatggaagatgtaatgctttcagggtaacttattttctccctcatccatgctctcagattgcattacaattatgtaaaatatggagttcacctttactgtctatgtggagggtcccctgtgacttcatcataagatccttgcagacttcgggactggaaaggggaaaccatgttcaggctgactttcttttagaggacctctgaatcttgtagttgattatgtccctctttgtcttggtgtttaagaagcttggacttcagtttgcatccagcctatctttgggtggcatttgtgtaggatttggtggcatgcaggtgtttgagccttgcctctgacttcatctttttttcacacatcctcattaaaagcaaaatgaacctaatggctttttacttagggtctcagaaagtacaaaatacctttgtatggtatttcataaggcacagtatgaatatttttaaaaggaggaaatgggaccagcctaggcaacacagggagaccccatctctacaaaacatttttaaaaaggtagctgtagtggcacatgcctatagtcctagctactcaggaggctgaggtgggaggatcgcttgagcctgggaggttgaggcttcagtgagctatgatcatgccactgcactccagcctgggtgacagagcaagactgtcttgaaaaaaaaaagagagaaaatgggaaattctatcctactttgtaatggaaatgtcatattttctcattttcattggggaaaaaatggtgctcttttgcacagttaacatatctgtaagattccatcagcatctatcccatgtttaaaattcgatttcctctctgttcatagctggttgtgtaaagccacctttctcaaatggacagactccattgtagtaagcaaaaaagcatttgcaatctgagatctagacctggatctagactccaagaggagttccagatttactaaggctgacccaaagggctgagatcccatttctccttggcccactttcatgccttgtcccaataataaccttcagtaaaggagccgcgtggtgtttcgactcagttttggggttggcagatgggagcatggggatgcgggtggtcagtgatctgtgagatgagggttccccaggctggttgagacaagttccttcagaacaatacagcgaacttttgggacaatgacgttgaggtggatttcatgccttccttgagtcacagtagactgaggcttgtcctatggagcgggcttgctgaagagttgatgaggagtgagtgtacattctgaaactacagaaaagttgcaaacaggtcatgtgccttgtcgttatggaaagataaatgacagttcttcagtgttacccatgctcctgactcaagggttattttggaggcacctagaggtcctgctgaagagacagtgcttgacaatctggagagtggcaaagagctgatacctacaaatgcgggaatgagtttgttagactcttaaatattctagtggtgagacaaagaaaacaaaaacttgaggaacatctctattttcacctctttttacctgtggggcttcagctaagatctcctttcagcaaaatctctacagatctctaaaattcaagacccggctggccttcttcccagtgagagaatgttctccaacaagctttcttggaggtcatctcttcctgcctgtgcttcattggcactcaaaacatgatatttttccatgcctgtttgcttctagtccatctctcaggaatttctccatatatttccctggcctgtcctctgtgtgtcactcagaataaatcaactctctcttctatatgacttccatctaaatatttagatgggagctaacctgcctctcctaaacttccaggtcatatgtagccactcctggctagccagtttctcataataggctatatatggtttttctaatcccttccccacctagtttactccttctagaaactgatgtcagcttatcagtgtcccttcagaatgcatcactcagaattgatcatagtattgccacagatgtggtttaacctaccagagtacactgggattggtaactgacttcctttgattacaaagctttagctcctcctgttttaaccaacagaatcacttggccaggtagacaaggtaactctgtgtagaagaaggattctaatccttgctttgtcaaattgacttctccagtctataaagtatggtgatgatcactctgggaggttttatggctcacatgaactccatgcgcacccgtttcttataaataatgctttccttggttacctcatggggctgttttgatttaaacaaataagcaatactattttatgaagaattgtataactatgcagaccaagatagtgttggctttttaacttactcaactcactgagtaagtgttactagttctaaaactttggggcaggatttgacatatattttgaataaactgtgtattaacgtaagaaagatccttctgattcccagtttccttaataagtatgccaagtagtttccaagtcattaatgaccaaaacagaagagaacacatctaaatccaaacattgaggtacacatcaccacgagtttcctctgccatgacataatcagcacagtgggcatggtgttccttctgactgtaccctccttctagggttactaaactggacttcaggagtgccctagacataaggaacttttatcagaaagtaatgcaattatatccctagtgggccatctaagattaccagattggcagatcaaggagatgtgacgcccataaaaggcagtgacattcaaatgcagatgcctttccgaaacaagatagatctttaaatctgaggcatttccctaggctggtaatcctgtcagtgggtgaaaaatcatggattgagtgcccactatgtatcaggcatgggcatgaggattactaagatgaacaggagcctgacctcccctcaaggaggggacatgggcaggtgttcttggacatgccttgtgtgtccatgcagccttggtgatggctgcccttctccctgagtgcttgcttgcacactctctccccaagagtccactctaggagggcgcctgccgggctcttcagccagtaatagatccttgccctctgggtggggatggagtgggagcaggcttctctctaggttctagttactaccgtttgccaaggcttctctcacagtgagctgcttgatacccacttttttgttacttgttatttctgagtctagattcttctgggaatccagtgtctatacttgttcgctccttgtttagatttgaactttcaaaaatccactataaactatatgtgttctaagctttgcagtctaaaggtcattttctagacagagaagacaaaattgacattctgttagctctgcatctttctaccgtttgttatactctttgctttaggcactggaccagctcctctttaatcatatatataaaatttttttttttgagatggaatttcactcttgttgcccaagctggagtgcaatggcatgatcttggctcactgcaacctccgcctcccaggctcaagcgattctcctgcctcagtagctgggattacaggcgctacagatgtgtgccaccacgcccagctaatttttttgtagtagaaacagggtttcaccatgttagcgaagttgagctcaaactcctgacctcaggtgatccatctgcctcggcctcccaaagtgctgggattactacaggcatgagccactgtgcctggcttatttatattttttttgagacagggtctccctctgttactcaggctggagtgtagtagcacagtctctgctcactgcagccttgacctcccaggctcaagtgatcctcccacctcagcctcccaagttgctggaaccacaggtgtgtgccatcatgcccagctaatttttgtgggttttgtagagacagggtctcactatgttgcccaggctagtctcaaaggactcaagtgatcctccagtgttggcctcccaaattgctggtgtgagccactgcacccgtcctagtaatttttgaagctttaatttcttgtcagtctcacaatatttgtatattgagtcataatgtttttgtatttacctgattatagacatttggaggggaaaaatttgtgctggttggtgccatatgctgataccttgatctgaagacacagttgtacctctgagaggaggacctggctttaaaatgctcctggactttacttctgtttacctgaggcgagcatgattttccacagcttttaaatgtctagttcctccgcatcaaatctttagcacgttcgtgccatggaatgagtcttagattctgtggtgacctcaagaaaagcatgcattctatcttgacatcactgtcccaaatgtaaaatgtttttctctagaattcccactcccaccccccataagatacatgcctgattttgtaaaatagttcctttgtcctttttgtcagcaacaatctgaaaaagaataagaattcgggatgcaaacacattctaagcagagagaagagctttagcaaagacagagaggcaggaaccagcctcaggaagagtggtaaagggagtggacagtggtgaaggctggcatcccaggtgagcctgtctgcagtggggttttctttgctattgcaaacaatggattgaacaagttgcagtggggtttggttaatagaatgctctgtacctggagctgataaaattggagggcgtgcatgctgttgtgtgtcaggtattgcggtgggttccattcctattgaacaggcttcatcctcacagtggccctggaaggaaggagtctacccacaagaaatggggtgacctgggttcagttacttgccaaggtcacactggaacttgggaacacagggttttgaagtttgacttgaaagcgtgtgatcttcagtaaatgtttataggattcattgcggagagacagggtagatgaaaatgttgaaacctgttcattgtccttgcatgagataccaagaatagcaagtgatagtgagaaggaaggagaggaggaatcttgataccttgagatggaaatctatttggttcctattttgggaccatggtagcccccattgttctctctttattttaaacaccctattttatatatatttttgtgaactctttaatacaccgtatttaatatttgtctctttctgctagaatgtaagcttttaggacagagactttgcctttgaactgtgcctgatatgaactagccatttagatgaaggacagaaagaaggattaatggagaaagaagatgaaagaagaatctaaggaacacacggaacacttgaaaaacagaagctaatgttgaatacgagtttacttagagagtttggagtaatgcaggattatcctggtggctcaaaacggggagccacagctgaaattagggagactgttgtaatcactggggacaataaccaggaattgtctgcttccaggtttgaacaagctctgtgatgataatacattgtgagaaggaatccatgtgaaaaacaagcagtcttcattcttcagtagattctggaatgtcctgggtgtaatgggggcatcagacagttcttgtacatgaatgtcatcactctacctcatggcagatgtgcccccatctttttttcaaatggtacttgagctgaatgctctcggcgtacaccgagaagtaccattcaacagcgcaggaatcgagcttttgggtcagctgtggaggtgctttttgaagctaggtctccctttactctttctccctttctgagggttcttagggggaagcttctcaaatttcagagccagggaggggcatggctgtttcccagcagctggtaggcttgtatctgctctagtgtctgccttcactgttaggacacataggccctcggggttgtgtttctgaaggtggtcttagtccagagctcttggatatatgattaatagtgatatgtgatatgtgtgcctgtgggctggaagaataattggctgaaggataggcccttccctctgggaatggagtgtgatttgtggggggagagacttgtacattttagtgttatctcagtgtttcttaaccttgttttcatgatcaccttctccaagagttgttttagacattgttcctagttacctcctatcccttgctagatttagtacaaaggaataagattttgttgggtagagttgagctttggagggtcccaagtttttgtattgtcttaagatttttttcaccattggtagaaaccaccacaagaaacacttttcacctctttgggacaccaccacccctgttgagaatgcatgcgctacatacttgtatatcatttatttgtttatttttgttttaaagacagagtctcactttgccacccaggctgtagtgcagtgacatgattatcagtcactgcaacctggaactcctggcttcaagcaatcctcctgccttggcctcccaaagtgctaggattacaggcatgagccacccacctggcctatttttttttttttttttttaaagagacgggctccctatattgccctggctggtctcgaactcctgggctcaaggattcctcctgcctcagcctcccaaagttgcaggattacaggcctgagccaccatgcctggcccagcctaatttttttaaaaaaattattattttggaattggctgggcgtaatcccagcactttgggaggctgaggtgggcggatcacctgaagtcaggagttcaagaccagcctgaccaacatggcgaaaccccatctctactaaaaatacaaaaattagctgggtgtggtggtgggcacctgtaatcccaactactcaggaggttgaggcaggagaatcgcttgaacccgggaggtggaggttgcagtgggccaagatcacgctatggcactccagcttgggtgacagagcgagactccgtctcaaaaaaacaaacaaacaacaacaaaaaaccaattattattttagaattacaaaagaaagtgagggctaaagaaaggtcatgaaacaagaaaggactgatctgcatttgaactgaagggtgactccacactggtgctcttagctgtcctgaggagagagccaagggaagctctaagggctgaagccgccaccacgaccacaacaggatgagccctggacccaggcacaggaacatgaagaggagcaggtgaagctgtcggaggagcgagagcagagcaggccaatcgctgaatgtagggaggaggatcagctgtatcctatgccctaggaggcttttttcttggtcttcattatcttcacatgttgattgtatctggcaagagggatgttggagagtttcggggaggagtctccagcaggtgtgcctagacagtattctcctcggtctctggatcatttgtaagtgctccttgatgcaaagaaggctgtcaggcactgcttggagaatgtgtgcgtgtttaagaaaggaaggtgggcatataaagagaggggctgctgtggatttgaaagagccaggcagaaagtctgcgaaagcagcttgggaaggccaagaaaataaatcttgaagaagaataaagaaaaggatgtttatcaacaacttggaagagtaatttttattttatttttatttcttatttttgagacggagtcttgctctgttgcccaggctgcagtgcagtggcaccatctcagctcactgcaagccccgcctcccgggttcacaccattctcctgcctcagcctcccaagtagctgggactacaggcgcccgccaccacacccgtctaattttttgtatttttagcagagacagggtttcaccgtgttagccaggatggtcttgatctcctgacctcacgatctgcccaccttggcctcccagaatgctgggattacaggcgtgagccactgcgccctgtcaggaagagtaatttttaagtaaattagagtgaaatttccatgaagtattaatgaggtaagtttaagcaattattttaagctaactttcttttgttgagagaaagaaaatgtcagcgtttttctgccagatgttgagaaattaaagctttttagatgaagatagtaaatcatttttattggccaaagattacttttttaaattgctctcagttccttgattttaaaagataatgctgtttagctggcctgactgcataaagctcacttactagaaaaatattcgaagtatttggataggagaatcctgttgctcctttacttaaaggaaacccttagcccacaccaacagttatttgatgtggctgcattcctagtcttaatttttaattgatcatatggggctttgagttttgcatgcttgtacatacgaatttcttctgtgcacgtggtcatatggtaagtctcaaggacagcatcacctgtccagagctcccccccacaaccactcattggtagagccaggatttgaactgaggtccatctgactccagtgcttgatttttctatctcatcacttccttgacaagaactgtcaacagagaaggtgaaaacttcttactgggatctactaggatatttcaagttaggtctgtagtcacttcgtggtttggggcatggcaccaaatctgttggacacattttgaacaaaggatgcataaatatgcttttaatgtttttctgcttaaatattaattgatgtcatttggtatgagaattaccatcaccatcctgtgaaatatcccaaactactctaacataatttttctctacatttgaagaaacgagaaaatacttcttcagttttttattatttgaccaaattgtgtagatagctgagagtaggaacggacctagtgcaggcatccagtttagacttcctcttggatcgagagaagttagaggaactaacccaggcccatagcaaagatagatggagccaggcatggcgccaaggcagaactcctctcaccctagcatattatgtttttcttcagattgatcaaaatatatctcctagttgagaacgccctcacttttggggaaaaaaaaaatcaccttacaattagtatttgctttccatagttaatgcttgaggagtactcttttctccttttcttctttgcctatcccctttcataccaccacctccagtttatatagtgagaatttatttttctaggcacccagaacaagaccccagtgtaaaaatatagtcaagacttaaacgtgtctatcggctggacgcagtggctcacgcctttaatctcagcactttgggaggccgaggcaggcggatcacctgaggtcaggagttcgagaccaggctggccaacatggtgaaaccccgtctctgctaaaaacatgaaaattagcgtggcgtggtggtgtgtgactgtaatcctagctattcgggaggccgaggcaggagaattgcttgaactcgggaggtggaggttgcagtgagctgagttcacgccactgcactccagcctgggtgacagagcaagactccatctcaaaaaaaaatatttttaaaaaatgtgtctgccaatttttgttttattttctaaaagtgccataaaaatgggtttatttgatgtgttggaggagatatattatccaagaatatttatctgaggtataataggagtaatggaggcagggggtggtggctcatgcctgtaatctcagcactttgggaggctgatgcgggaggattgcatgagaccaggagtttgagactagcctggaaaacaaattgtatttaagactgtcttttataaactaacctccaggccagacttgatccatgaaacactgcaaagttagtcgtcttaatatgaaaatataaacttactggattttcttttgtaattctggttaagtaaatctacagttcaaatcaattatccattattctgtcaaagctgtagagccatttctccaacttgggtaaagggtgcaaaggatcaagaactgccatctccctaatgccacagtaatttagtgaaatcatttgccctctctcagtcaaagcagaagcttcatgccttggcgtggcggggaggggaaaagaggccctgaaaacagcccaggagtggtctgattatgtgccaggggatctctcaggctcaggtgcatggtgagccttcaagagggggacctggaatgtagacatttccacctacttgacctgggaaacgggatgtttttcctaccttgagaagttaaaaggctgttgtggcttttgatggacacaaaaaggaactgtgatcaagtgtacgctttgaatctgttttttaagactcagcgttggttttcactgttgggtgacttacaggtaagctggccaggttcgtaaatgtctgtcctgatcctggtgatcaggctctctcccttggaaaggacctgaatgcagcccacagtcctatatgctctggcactatgaacctagggcatttcccacagttctgcttggttcctccgtgagtggtgtagactggaacttgtgggacttctttgtgactaaaatgtcaagatgccatttcatttcttccaatgattaaacctccctatgtcttatggacacagcagacatttctaccttcattcccatttccaatgatgtaattgattcccaagctcatgatctctatctcctgagcatttcctatgtatacttggcattttcaccagtgctgaatgagaagacaaatgatactggatctttccttcttcccagctgtgggtttttttttggcagtggggcgggagacagggtctcactctgctgcccaggctggagtgcagtggtgtgatcatggctcactgtagcctcgatctcgtgggctcaagtgatcttcctacctcagccttccaagtcactgggatgacaggcatgcatcgtcaagcccagctgaattttttatttttagtagagacaaggtctctcaatgttgtgcaggctagtctcgaactcctgactcaagagatccacccagctcagtcccaaagtgccgagattacaggtgtgagccactatgcctgcctcagctgtgttctccataaccctgattgaccagccactttaaggggactccaggacaagggatagcttaagaacttgggcatgtgatttttttcacaatattttgtttaaattttattttttcaattattttaaattgaggtctgtggtcttattaaaaagggatctttcaaaacttatgtttaatagttttaccatgtataatagcatagcatttgtgttggtaagttggcctttatttttgaattctgcaagtaaaaagttaaactttcttttagttttatcacatgtttgggtgtcaggttcaattctagatactaagaatctgaatgaactagatgcttttcctgcctgtaagaagtctaataggatagagactacataaacagaatttaaatattgtacagtaattagtactgaggaaagtgtgtgtgtgtgtgtttagtatatagtgtgtatttggctgaatagaaggcaaataccagaactttccagtcaacaaaactattggaatgttatgtattggccaggtgagatactctgtaaaataactgcatgtgtcagaatcctttccccagctttttttggaatagggtgattaatgacttaaaccttaaagtttgagtgccatattgtaacataccattaaatccttgtcacttcctgtggatcatgaaatctgatgtctcttgattgatgttctctccttgtcagtcccagcctctccatggtctgttcaaaattttgtatgacacggtcttcaccaaaaatttgttattagttactgaagttgtaacggttaagtttgccattgagatctattgagtgtcatttactacacttcacagctgtggtcttaatggctagtgaaagcagagcgcgttgtgagtcggcagtttctgatgcttttgtgaaattcttctaaagtgagttaacctgtatttcagattgcttccaagtatgatcatcaggcagaagaagatcttcgcaattggatagaagaggtgacaggcatgagcattggccccaacttccagctgggcttaaaggatggcatcatcctctgcgagtgagttacagccctccagaatctgtttctgctcttccagttctttccacagccttctctctcactctccttctcagcccagggtgtcagaccttgatattctacagatatctttaatgctttcccttactgatgctaaagggagcaacttgatatttcaatccttgtttttgtgtgccagtaaataagatgtctctcatatttttcttttcagacttataaacaagctacagccaggctcagtgaagaaggtcaacgagtcctcactgaactggcctcaggtaacagccaaaccaaccacctctggttctagttggttgcattttatgtagtgaaaacttgatttcaggtttggttttttggttttgtgttttttttttttttaactttttgattacggtttttacatagacattgtagcagaaatttgtgcatatttaattttttgcccttttgtaatggttctgtaattacttatttaactagttctgtaattattatgtttagcttagaagttttcctatatttagtctgtgtacattcagaaaggacttgacacagcttacacagagaaatgcaacccagaccttaaggataagggaaaaaacaaggcattccacataactaacagtggactgcagagcactgtatcagacataaccttagttcatgagtgtgtatgaggaaggaaaatgggatacttactggtcttgaacatgtgtttggagatatgagagaatgagtatttagtaaccacaaatgtattctgaaattaaaataacacataatgaattatttattagtatgagtaattatataccttttgacaaataaaattccaggcctggatagctctgatacagaatccttttaaaatatataaggaagatcttgcccataaaaactgaaaacacgtaactgcttaaaaatattaagactgtgatgtgacccacagtgagagacacactctcttcttgctctttcctgttccagagagagccatgcttagtatgtatttggttgaatccttgtcaaacagctttctgggcagcgtcttataactgtttatgaagacttggaattcttagaaattatgaatgtcaatatttagctccagaaattataaaactcttcttctttatagttggagaatattggcaactttattaaagctattcaggcttatggtatgaagccacatgacatattcgaagcaaatgatctttttgagaatggaaacatgacccaggttcagactactctggtggctctagcaggtctggtacgtacatgtctttaatggctggttaacagattcccaccacattggtgatgaattgcatcattgctttttcatgggggttcagaccaggtggggcggggcctgtctcttctgtaattagtagctttgtggaaaggctgctgacatcagctgcatcgtactagatagcttacttagaacactcacatttcaaatgatgcagtatattattgaacagccttaaatactttttatctctagtttgggcccctttgtctatggacatatcatttctttgttgttccttctgtgaaactctgttggccttttcagttagtgtgcatgtttctgtctaggctaaaacaaaaggattccatacaaccattgacattggagttaagtatgcagaaaaacaaacaagacgttttgatgaaggaaaattaaaagctggccaaagtgtaattggtctgcaggtaagtaatgtggtgttgcttattcaattacttattcaatatgattaattctcaccatgcaaaatattaagcctctcctaagaatagatagaagtactatagtactggggggggggtgtagtttatacaatttatatctatttataaagcccataagacagtgataattttttagaggaaacctcaggtatgccacctgacttgacaattatttctccaggaaacgaaaatttttaattgaatcatattgtcttttttttttttttttaaaagaaaaatacacttttaaattttttattttatctttttttttttgagacagagtctcactcttttgcccaggctggagtgcagtgacgcgatctcggctcactgtaacctccacctcctgggttcaagcaattctcctgcctcagcctgccaagtagctgggattatgggaatgagccaccatgcccggctaagttttgtagttttagtagagataggatttcaccatgttggccaggctggtcttgaactcctgacctcaggtgatctgcccgcctcggcctcccaaagtgcttggattacaggcgtgaactactgcacctggcctgttttatcttttatatatagatgggatctcactttgttgcccaggatagtctcaaactctggagctcaagcagtcctcctgccttggcctcccgaagtgctgagattacaggcatgagctaccacacccagccagaaatgtactttataaattccttaatgttattgaccaaattaggcaattttacacgaccttaatgccaaagtcacttatttacagtaccaaatcatgatatagcagccaagccctgttagaatttgtcagtttaaattcttctgaaatacgtagttcagatgttttccttctcttcattgttctcttcactggtcatggaaacgtcattgctaattccccaaatgctgttggctttactctccaaaagccactgtacctgcttgatacagtgcccctttctactgagtctatgcaagttagatttatttttacacagtacaaaattgtattggtggtgagaaactggaaacctaaatttcagaacagtagtcagttggttgaattacaactccataaaagcaaagtgtaatgtaaaattatacactagagtttgaaaagataggttatgggggaaaaaaatcagatcatcaaatactgtggtcagtatggatttttaaaattaaaaatgcacatgtttttgtatgtatttgtatatatgtgcatctatagatatatacatagacacataggttaaaaagctaaaaggatattcacaaatgttgacagtgaatggatggtggtatcacaatgatttttcccccctcctttttgcttatatgtgttttctgaattttcttcaatgaacagattttatattagtaataaagattttctttaatcttatttttaaagaaaaaatatccaacatcagaaaagtgtgcctaaccagtggaacagggtgtaatggttggtcctgaagccatactgttctcagtggggaagaaaaattaattattgtttccctgaactttgctgagttcaaattcctcattccacctttctccagctctgtccaaggacatgggagttacaggaataaaatgtggttcctttctggagaaaatgttggtgattttgaaactttaaaaagcccttgttaagctcccagagaaaacacttggcatttgctttcacattttatgtaaaacattcctggagtagaacagcatattgcttggcctaggattacttctgttgaaataaccgaagctggtacctcttaatttggttatctggggaaagagtagcagaggaaattattctgccactgtaatgacttttggtgtgtcagtccacctgttaaagtgtgtttaattcttctatgtatgagtttttatctatagtgactttaaattttctttttaaagttagcacttgaaatttgtttgtagacacatagaagagttgactggagcctcagctcagtaacttgtcggttgtgccccttctgtctttttggtagcatggaaagttttgtttgtgttgtgtatattgttgacatctgataatttgtgcaattttatttttaacttaaaagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggtaagcaatacctttttatacgtgtacaagagtacacttaccttatttttattaaccagaagtttaaagtaggtattttttgtatagtttatttagagtatattccttcaggaatgtggactttgctgggaaagcaaaataatcaaaagaccttttcgatagcagcaaaagcatgatgtgtctcgtggtttttgttggcagttagaacagctggcctttctacctagccagcagaaaaaaagatatgtttattacagtgttcttgctccaaaatccaagtaaaatattgctcatttaaatgctgacttttttttttaaggagcccttaattaataggtaaaattacctggtgttccactaagaaggatttaactagcattcctattagatgtgtcaatataaggagatggaaatgcaacatggtgaaaataccagtataccacatccaagatagaaatatttccttgttaaaaatagatcaccagcacctcagaaggaagttcaacaaccatttgagaacagacaggtctcacatccaacaacagctgggatagggtttgaaaaacattttcttaccgagtccaagggagatttatcaaactttgcccttatggaacacatcctaccgggtgcggcattatgtctctcatagctgccactcacgtttacttttctacccactctgaacctggaagtgtgtgcttgatgtaagtagagagatgaagtatgagttactgtactctgaaaaagaggggagtggctgtgaagtggctggttcttctgtatctcagccttttgaaaagactcaagtccttaagatctgctcaacatagtttctgttgaatatattataaatttttgaaattggtaacccagataatgtatgtggtccccatgggcattcacatggaactttctggtgtggaagcattatgatttcacattctttatgtctcattctctcttaaatccagagtaggtagtaatgtctccattttgcagtttgagaaacctaaagctaaatttacgtgtttgaggccacatagtaattttatagcagagcaaggattttgaagaaaggtctcacctagctcaaaagccaatgaatattgcttcatggaagtgattcggtatcaggatattttggttaagctagctttacccctgaaccaaatgaaagttcatgtattactgttcatattcaatgtgaattctataatttataaattattcacaagaatagattctagctgctgttttaacttttatactatgttctaataccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaaccacaggctgattattttctggctagcttctagataggtagggtcagatttttttttaagtacctttttcctaggtactgttacaaggtacattaacattttatttacttcacacaacactgcactctatgcttaaggagattgaggcttaggaaaccattacacatagtaaatgacagaattctaatcattttctgacccttgcttatttcactgacttggctggcccagattcatcttaaattcaacttggaataatcttaaaatctttaggaatattgacaggaggggtggggaattttcctatcttagggtaagtaaacatgaataagaaacatgctaggtcagccataggatgtgctgcttggtaataagccagggtttatagtgaaacataaaccttcagtcctgacagagggaaggacaaacaatagctaggtgtcatagtgacaaaaatgcagtcactaaaagaaaattagtaactcacactttccgacattgtctcagccaagccatgtcttctaataggattggctctattaggtttgggggcgaaaaccgtctgttttttgctgagagatgaggagtatatacacatggtttgatgagcccacaaaagtgaaggctatttgctcatcattccacaatgactaggtttaatgcttctgggaaactgcttgtaaaggaaactattggagtcaacctaattcaatagtggcatttaagaaaaaagtcattgcatttaaagtagacctgagttctaaggctttccttgtcatctttgactcttcaaagtttagggaagggaagccttatatcacactacctgccctgccatttaagtcagattgattcccatgaggctgccaatcaacatgttaaaatgtttctatttggttagagttttaaaaacgaaaagctcttcccctcactcccatctacataaatctctgaggtccaggcagaagtatttttaaaaatctgtctccaggtaatttctcaggtggggctgtggttgaaaaccacttcttccagaatgtctgctgtaagaggagtgcttgtgtatcaggagtttggataaattgtgtgtgccatcacggaatgtgatctggtggagagacataacagaaagtggattcacagtcatatcagagaagagcatggaggaaaaggacagaagagagggcaagtaatgctgctcagaggcattgcagaagcatgatgctatcagagctgggttttgaagaataagtaggagtttgccattagcaaagaggaggaagagtattcagaaaaaaaggaagagcatgtgcacagactaaatcattggttacactcctgcctctcctgtacatgcccagttcaggtggtagttcatgttagagtatacagttttggcttttattgtcaccaaatctaagaattgtactttgaaaagttaatccatttagcatatttccaggattggctgagtagggaagtatcctactctgtataaaagcaactttccaagctgggcatggtggcatgcctgtagtcccagctgcttgggaggctgaggcaggaggatcacttgagcctaagagctggaggccgcagtgagctatgatggcacctgtgcatagacactgtactccaaccttgggaacatagtgagatgctgtccctttaaaaaaaaaaaatccagagatttctgctaacaaaatccttatcttaaaaaggtttatttattagttgtgca

SEQ ID NO: 12007 - DNA, 55703 bp, Human
attcctagactgtctatgatagtgtttctaggcgtaaggtgtgtcccaggcttggctgttcctgtgagcacccttggggtgctgtgggaaggcatctggctctcccttctcaggttcctccatccctggcccagccacctgccctgtctggggcacgggtgggagctgtcaggatggcatggtggttaagagcacgtgctgagtctaggctggctggacatgagttctgctccaccactgactagctgtgggatcccgggcaagttgtgtttttcctgtgctgcaggtttgggaataaaaatggaattctgccttaaggcgttgttgtaaagatcgaaggagttagcatatgtgaagttctcagcacagagcctgacctatatgcgcttcccacctctcccgagtgcccactgctggggcagcaccctctggtagggcaggcggggcctgtgcccacccaccccgcaggccagagtgctcagaaggccccaccccctccgcttcccgcctgctgagctcagcacttcccaggccccaccactgccacagccacatctggggccagctcctcactgggaccacagtggggcgcctctgtggcgtggttggggtttccgctgactcagcgcctctgggtctggaggcgggaaatcccaggcctgcccctacaacctccccctaccccgggttagccgaggccacagggctaggcgcgttgcttccacagagcccccagagcccccctcaactggggacgctcagtttctccctcttcagcccagcatctcatggcctcttgaacctactttgtggatcctcagccttggtgccaataaatttgctttcggtctacagcgggaggagacccttggtggggattccaccttggtcaacggccctgcctctgggcagaactcggaacattaccggctccttcctcctcagagctccaatctttcagcccagctcaattcctcttgcgtccttggaccgtgaatataaagcaggtccctccccagtgctggtgtaaaggcttgaaatccagtcccgtcccctgccagggatcacagtaataacgataatagcagcaaatatttactgagctcctctcatgtgccagaccgtgtgctaagcgcttacagcctttggcccatttcctgcttacagcaaaggtctatgaggcatatactctcacgatcccatcttccagatgagaaaacggagtatggttacacagcacatttggaaccgcaaagccagagcaggggccagggatttgagcccttccaacctcatggagtaaggaggaataaggggactccctcagtctcacttctctgggagtcaggccagagcagagggggttaatttagcacggaggagggagggggttcccaccctcctcctcccagtacagacagacctagggacagactgactgggaatgttaggcagaggaattggaaaaagctgaccaccgaggcttgggcggcagccacatcatgggtgccacgcacttgggaggagggtctctaccctgctccctccacccctgtcccctccccgcccccccaccccgcagccttctgggggcccagccagggacatggaaagggggagctcttcaaactccaggcctgactcttaaagggcccgcaggagcccccttccagggcagctctgggcacgtagggtcccgcctagctcgaggatcgctcacctggcggtgaggcaggaggggcgggcctgggagctcggccagacccggggcggggctgtgcaccccgcagtctagccgcctctggtgccgctggagccccctctaggccctcctcctcctcctccctggcgggccggtccagctgtgttccattagtgtccctggcaggcccccagccccctggaaccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtaagtagggatacagtgggcggcctcagggctctgggctgagaggccctttctgccagacttgctgtgtgacctgaggaaagtggcattccctctctgggccttggtcgtcttctctagagcgagatgagctctaaactccatcctggttctgactccctgcgcccaaatctatgcctctgtgttggggtgagccgtctccttggaagcttctctggctctgtccttgcagccctgcactctggctggagcctgaggagtggcgaccagagactaggagccggaaggggacaggatcacatccatcctcacgcctccacatgcacccacatggcgccacagctggcagcccttctattggctggcaggaggaagaccaggatagggtttgagagctgggatgtgtatatcactaggatgggggatgaataggcaggctgggggcacagttctgtcccagggagaagggggctggagtcctatctccaaatatattggggtaaggggtcctttctgttttcatttcctatccatgattgagggaaggaaaattggatttcattagagttggaaggaatgcagtcagacttgcattagaacttcccaacaggaagacctacaggaggagtggtcataggctggctgtgcgcatgtgggtatatgcaagctggtgtgtctgggtatatcagcgagcatatgtttccgtgagcatgcctgtgtgcagatagctttgtatgcacactggtaccacatatgtgtccttatgtacatgtacctgcgcatctgcatgtgctgtgctgacacatgcatggctctgtgtttgtgcacgtgagctgcctgtcctgggggaggccagacgatgtatggctctgctggccacttgctgagcctgcatcgatttatctgggcccatccatcagggtttaataaaactaaaagacaagcatccatcagctgggggcgggggtggctggcaatgaggtcctgagccctagagacctgctctcctgcccactatacctatggggaaagcttccttggcccccacacagccctatggaaggctgtggcccacaatctcagcccagtcaccagcccctgaccctgtgggtgcctgggagggcttcctgggctgagctgggtgcgctagtaaggtatcaggctggtatatataccaggacagtgcacaagatgctagacttgaaatacttccacgtgtcttgaagaatagcctcttctttaagccctcatcactattccaacttctctggccttctaagaccttctagacctctcccaatccagcaagtatccactggcacagccagatgctgcctggacactatttcagtgcagtaggcagctttctgctttgcctgaaagctggtatccgtgccataccggtggttaaatattttgaatatcgcctctgctcaaatcctagcccaagggctgtggttgggcctctgagagagactgatgcctggccagacctcctgccaccccaataccagtgcctgggccccacaggctgtccacgacttgcccacgtgtggagttgtgctgtgtgaactcagaaatccgccttcccggtctctgtggttttcaggtgctgtggctgtagctgacctctttggaccgggatgtgggtatcctgggctcctggcctgtggctgctcggtctttgggctaccttcggccatggggcaaatacaggtgagatgacacaggagagtcacagtatcacaggcctgcaactggtatcctggggtgctggggtccttgcacatatgtgaccatgtatgtgtggtcgtgtgggcagttatagcagagtctaggggctgggctcagggtgatctgaggtgttggcacccttgagcctgtgtgcagtgagctggagagtgtgtgtgcctgtgtcttcgtacgtttatgtctctgagcatctctgtgtttgtctctcagactggctttgtgcattcgtatgtattcctgtgtctctgtgtgtaagagaacaacctcccaccccaatacgtaagccaatcctgtggacacattgctggtaggaccagtggggtggggaggaacaggcagtgagctctccctgcagaaggacgccgcctccccagagaaccccaagtcctgctgatccttttcatggtggagactccatccctctagctcacgtgcttctcctcctccacggctggccctgaatctctaataaaaggcccaccccgaggcccagactctggatgagacagagggtgcagctttccagggcccaaagccaggggaagttgaccgggcaacttgcctggccttgctgggtgccctctgggctcagtagctcagctgcttcgccaagcaggaacagaactcctaggacccaaacccagctaggaaaagcagaaaaaccaagaagctgaggtgaaagggattgtggacccagggtgagtgtggccgcctgccccttgtatgtgcacatatgtgtttctgcttgtgtgtgcgtgagctttgctctcctctccctcactgggtcccctgggggggatggggcagataatttcaacatctgtaaggaatctgggcccattgccaaggggtgagtcacccattgctgctgtgatgctgaagacagtgatggtctttctgaccagacctgggggagggagagtgcagtggggtcattggcaccgggccccagggccccaggattccttcttccagccagtctagccagagagtgcaaggccagcttctaggagctgtcttcaccgtcttctcccacctatccctctgcattgatgagaaggcctttttgattctggcctctgtctttcctgttgtagcacctcccccaacacttctgctcagtcagccccagggcgagggaggcccatggctgcccacctgttctttcagggctttggaaacctgagttaagctatctccttctctgggagccctaacccattaatatgcccttcctggagctccaaggccctggtggtacccttgagcttgtggtcccctcagaccctcagtctcttctcgctgtttcacaaggtggttattcaggtaaatattcattctgttggctcctacttgtgtctggcctgcttgtctgatttggatgtaggacgttcctattgctgagaacacgtgtgccagctgcacatgtcatccctcgtggcatgggcacctacaactcccacatgtacagacacgtacatataattgtacataacacacaatgtgcatgattctgacatttccttacccctgaagagctcctctgccccccacctgggtgtatgtcatggagggggcacatgtgtaaatacacagctccccactccatctgtgctcgagagccacctagagcttcgtgtattctctcccttgctggcctagctcctgacttggagtgctgggagatttgggttcctggagttctgggcctgctctgctgttggctcacttagtgaccttggcctgggcctcagtctctggacctcagtcttccaaactgtatgctgggttgggggcctccaggcttcctggggagccagggtcagaaggcaggtggtgaaggcaggatctagctgatggtccagagtgaggactataaacttgctccctcccaggttccccaggcgtccagccgtgcagcaaccttggcctgagcgcacctaatgcccccctgccccttctcttctaggtgcacaatgcccaccttcacagcaggaaggactcaaattggaacacagtagtagcctgccagccaacgtgactggtgagcacccaaccatctcatcgcgccgtccctgcaaccttcctctgggagtgatctgtacccctctccacctgctcagctgagctcttcacctgatgtctcccccaaaggcttcaacctcatccaccgactcagcctcatgaagaagtctgccatcaagaagatccgcaaccccaaggggcctctcatcctgcgcctgggggcggcccccgtgacccagcccacgcggtaaatgcatccatgtgaccactgagaatcaacactgacctcagccacactcctcagcaactccagatgtggggcttaagcccaggggcctgtctgtgggtcattgcatcccagcccctgccaggagtcaacctggtctccacccctgggcttgcagggtgggctgagaggtggtacctggcagacctaccttctgtctttcccctgtctctggccagcagtgggtgggaacaggtctgcatcctgtgggcactgtgagaacacaggatgtgggcgggaacctggcaagagtcatgtgcgtgtgtgcatgtgtgtgtgtgcgcacatgcgtgtgtgtgcacccatgtgtgtgaaatccaaattcccacaagccctggcctggcccctgcttgcctcttcaacctcagctctcaaaatgctcttttttatctcttgctgctctggtcatgctgaaccctttccatctttttttcagtatctctccttccacccttgctccagttattcacctagggtattctgggttcattggaagcacttattcaaattgcaatgcgatagcgaaatagtcattctggggattctttgctcatggcctccctgcccccatcagacgtgaaggctccatgaaggcaggcagtgcctctgtattttcaccactgtgtatgtgggttttttgtttgtttgtttgtttggttggttggttggttttctttttgagaccaagtcttgctctgttgcccaggctggagtgcagtggcgtgatcttggctcactgcaacctccacctcctgggttcaagcaattctcctgcctcagcctcccgggtagctgggattacaggcgcctgccactacacctggcgaattttttgtatttttagtagagacggtgtttcaccatgctgcccaggctggtctccaactcctggcctcaggtgatccgcccacctcggcctcccaaagtgctgggattacaggcatgagccaccgcacccagccttcaccactgttattcccagcagccagacccgcacctagctcgcggaaggcactcagtaaaggtatggagagtgaatgaatgtatatgatggaagatgtgtgcctgtggatgtcttgggtaggctcagcagtcctgagggctcagggtgggcagcatttgggtcctcattggagcctcagggcaccctccctgctccatctccagacgagtattccctcggggtctcccggaggagtttgccctggtgctgacactactgctgaagaaacacacccaccagaagacgtggtatctgtttcaagtgaccgatgcaaatgggtatccacaggtgaacctcccctgtgccctgattgcctcttagggcattgggtagcaccagtccagcccacctttcatcccggcttgtgacttctggggtctccctgctccatcctgtgcctaccctcaagcctgtccccagcgcaccagtacctacctcattctttcaggatgtatagctccttgaccccagccggctttcttctctttctgggcctcagttcccctcctgtgaaatgagttcaaggtccctgaacgtgcccatggtgtgactctggagctctgaatctctgtcctttccctttccaaattctacccagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcggtgagtgctaggtcaggccctgacctctgttcctgccttctgggaacctgagtgggcttcctggaatccgtatcggaacaagtccttctcctgcttagaatcttcccctgctttcctgttgccctccaaatgcagcctaaacatattcacctggcattcaaggcccttcatgatctggtccttataagtgtctgcagcaccatcttcctttacatctctccgtgcagctctgctctgatcaattccatcctagccatccagcgcacccagtgctttcacactgccgtgcctttgcctacgctgttacctccacctggaatgcctttccttgcatactcatccgctgagtagctaccagcccttcaaagcccagcatgaatggaacctcctcctcttttgttcctctgggcctcctctccctcgttcctgtgtgcgcagttttgttctgcctttggtgacaactctatttttgatgtctcccaggccagactggaaacaccctgaggtcacatcctggggcagagacatctctgtgcctcctggggggccaggacacagagctatttgataaaatgaagtgaaattgatgtgtgtgtctcctgcagtttgaccttcagcaggtgcacatctactgtgacccggagctcgtgctggaggagggctgctgtgagattttaccagcaggggtgagtggcccggcccttgggctgcccagggacacactgtgctggagatgagggtctggaaggtgatgcctggaggtcttaggaggagtctgctcctgtactgaccctagccccgctcttccaccaaacagtgccccccagagacctccaaggcccgccgggacacccagagcaatgagctcattgagatcaatccacagtctgaaggcaaggtctacacccgctgcttctgcctggaggagcctcaaaacagcgaggtgggtgggcaggacaggtggatgccagcacaggcaggcacaagtgagatacccctcccctgagctgactgacgtctgccaccagggtcagttggccatgggcccagggcaggaggggcactggaagccctccctatttgtacgccacccctaaatgattcagggaggcagagacagcccactggccaccactgggtggccctgtgcccacctacctatgggtgttgagagtggtaccatctagctctggcactgcctagaccctcacggatgccatccagactcttctgatgagggcaggaccaggcttgtccctcaaagccagtttctccagaacagagatacctgggatcagaggtcaggtcatactgcttccccccagggatggctcactctcctgggcccagcgccggccagggccagactggttttacacccagcaccatggccagctgtctgcccactctcaggttctttagaggtggcatggaagcctggttcctcctttagccccaccccctggctgggcactctccctgcccgctcgggcatcttgcccagccttgggctgcaggaacacaggatcccattgatgcatggtcttgttggctctgacatcacgtgggtgggtggggggggaaggagggggacctgttggggcagccacaggggcctgagcaggcccttgatgccccaggaggtgccagatgccaggctgaaggattacctggggcccatgccccctgcctgggtgcccctttccagcctggaccccagaacttccccctcctcaagggtttctctttgctctgtctgcccaggtggatgcccagctgacgggaagaatcagccagaaggcagaaaggggagcaaaggtagaggtgggggtggggggaggagcctacctgccctcagtctgccctctgtgcccctgtaaaccccagggataaggtgctccactcccactctcctcccgcctttcccacctcctggacagagcttaggacatgtaggtgccagctctgatcaagaaggacggatgggggtgagacagacgcagtgcctggcactctctagagtgcccactcctgttggtttgggggtaggggtgttggaaacagtgctcggccccctgagctccctgcccattcccacaccccccaccctttcctcaggtccatcaggagacagcagccgatgaggtaagcctcccagtggactggcagcaggggaggtgccagcatgaaccctttgcaccaggctttgggcacggatcctcagcataggggtgctggctgactacacagctcctggcattccttgagggcctgatgctgggccctgtctgtccactgcctctcgttgggttggggggtaggtagccctggaggacactcctgctgagttggcagcaaatggccacgggcatcatggggagagcccagccttcagccacggtgcccttggattctgggccgtactctgccccagcatgctgtgtgacctggggcatattgctattcctctctgggcttcagtttccccatctgaaaaatggctgtggggctgggtgggtgggaaatgaggggtgaggcttgttttataggattcctatcttcaggctcccctcagattccactcaagatatgtgtgatgttctgtgggcctggtggtgatggaggtggggagggctcaccccaggggctcagaattgacctcttcgcctgctcttccctttcagtgtccgccctgtgtccatggtgcccgggacagcaatgtgagtgaatggagggtgtgcagggtggagcgggcaagagccgggagtggacgttgcctagagctggcttggcagcctcctgggtgaggacaagggggtctttgtacactttcacactcgctccctgcccatctcccagagccgggcttaacccccactgccatctccaccaagccaggactgtgtggaagaaagcctgtgacctgccttgtcatctgcagtgtgttcgggttcagggcatgggcacgggatggtggccggcaggaccagcgccttggttgctgatcgcagctttgcactccctgcaagttctccccctgccctggtggaggcttccttcattctcctggaggcctagagaaggggaagagctggctcagcacggcaagggctcccacagcgttggttcagggcctgctgtctctttctagctggccctggtccagccttcctatgggggtccagaagggcaaggagaggggctcagtgtgagcccagctggcacccaactgtgcctcttccataggcagcatgagtcaccatttttctggggcctaacattctgagttgacctgccacattggtccaccaagggcacaaccccagctcccctcagctctaagccccctgactttgggggacatcaggagtacctcctaggctccctgctccctctttcaatccagtcccccaccaaatctgttaagactgatggtccccagatgtgcagaggttaccatggaaaccaagcagccatgttatcccagcaactgggaggcggagctaaccaaagccaggcagtttagaggaggtaggttagaccctctgcaaatgttacaggctgaggaaatggaatcggcttgctagtttgcctgggaagcagagcaggggctgggatacaggctgctggtcctgctaccatgctgtgtgaccctgtctaaattgcttgacttctctgggcccctggttttctctctctaccggaagtgtgatgccctctcctctgtcccctcaggtcacacttgctccctctggccccaaggtgagtcctaatggagaacgggacattcccgtcctctttagcatccccagccattcccacagcatgtgaccctgtggctgtgtgtttctatcagggccacctgagcctgtatgtgtgtagggtgattaagtgtatgcgtggtaaagaaagcaggggtttgtgtgtgtgcaaagatgctaagagctgcccttttctgaggcccttctgtgcaccaggccttaggccacacctatgcacacttattacccttttgaaccctctcaatagtcagcctgcagggtgggtgctatcattttacttcaggggaaactgaggcccagctgtgcccacatatgtctgacagggtgtgttagaatgattatgtgtgggtgtggctacatgcatctctgggacacatgtttgcatatgtgtggcacacgaaggctggagttgaacccatatacctgtgggcctaacgaggctgcagagcttgtgagtgatggggagcgaagctatgcaactgtgagttgtgcttgtgtgtgctcgtcaataccgttttattgatgaagaaactgaggctcagaaaggcgacatgacctgctctgagtgacatgctagcaagtacaggatttgaagtcaggcagcctgacactcagccagcatgggtttctgccaccgtgcatgtgtgtgtccatatgcctccggctgtgctgtgtgtgagctgatgtgcttgggtacgggtgtgggggatgggatacccccctgcttgagactgtagatttgccaaatatagcatcttggggtgggagggcatgtggatgaacaggtgtggaatccatatgcttgtgtgtggtggggggaggcgtggggcaggacactgctcacatgtgtgcgtatttgcgtacccgtgtgtggggggatgggtggagggggccagaagtggggagagctttctcaaggctcccatgtgccccctctggtcctatcttccattctggtttcactctcagggagggaaaggtgagcggggcctgcctggtccaccaggctccaagggagagaagggagcacgggtaagtgtcccagccctgcccgtggcaggacctttgccagctgtgccctggggtgaggtgggatgtgagccatcatcccatcatcccggcagaaagcctgcagcttggcccagatcacgggaggggggtgagggccagggtctttctaggggtttgggtgtagaagccccccttttctagggatacttaggactatggggttcccgggccgatcctcctcacaacacatctaggggacttccccaggagttcccacccctgatcccttgttccctactcccagggcaatgactgtgttcgaatctccccggatgccccgcttcaggtaagacttggaggtgatgcctgcttcagggccaatatggggccagcccctggggagggactgtgcgcttggcagcccatcaggtgaccctctgcccctctcaacactgtgttcccctgttcagtgtgcagaaggcccgaagggagagaagggggagtcaggagctctggtgagtgtgggaccagggatagggcagggatggtgggtccagggcccagccttaccctcccttcctctgtctcccttcctcatctcagggaccctcaggactcccaggctcaacaggcgagaaggtaacaagcctggatttggaggggggatttccagggaggtctgcaggctctacagccatgaggaaggaggagtcggggttctctgaggagagggtgtcagtgggcacagagctggcaggaccctccctcccccatctcccccaccccagtcaccctgcctcgtccaaatacccagccgacctagagggaaatgccacagattcccccagtaagtggcctggctggtttggaagttctacctgttgtctggtctgttgtctaccctcccgtggtgattgaagccattcaccctcaggggagacagagaccaggggtctagaaggcagttgtccctccaccagatggagctgcccagctgtcccaggcccttccctcatcctggtcactctgcttcttccttccccagggccagaaaggcgagaagggcgacggaggcatcaagggcgtgccgggaaagccaggccgggacgtaggtgcctgggacccttccccaccacaacccacagcacggggtctgagaatgctgggatttaaccttcgggagtccagccccctccccttgctcagacagggtggggaggggctgtgccacaggaggcacagcaagaaggggacagaaaaggacctgagcccaggccccctcactcccagcctcagagccccgaacctctaacaccataaggttgacatgtgctgaccttggggcaccagggtgggctctggtttgggggaggggcagggagggtgggacaggtgggcattcacctctcccagtggggcggtgccaggcctcagggctgtttgtacaccctcccccttatccccccacagggccggccaggagagatctgtgtcattgggcccaaagggcagaaggtgagttgtggatgtttgtggggtggagatggggtggcagggctggggtggcagctctctgatgcccaccttatgtctgtgccagggagaccctggctttgttgggcctgaggggctggcaggagagcctgggccccccggcctccctggaccccctgggataggactgcctgggaccccggtgagtacccccttgcttctcctgctgtgcttttctcagagaccgctctcccaccctggccagggaatgaacggggggaagataaggctctgtcccagggatcctggctggaggagagggtgagggtagaagatctcgctgtagcgagaggtccctggaaacttccacgtgactctgtttctgccctcagggggatccaggtggcccaccaggccccaagggagacaaggtgagcataggtgggagtgtggtcacgtggggagctccatgcttgacaggaggagagagaaggggctggggcagcttcccacaggggaagcaagtcccagggaggaggccgggcctttggaggaggaggctgggctcggcttggccaggccccttggcggggagcgtcctgtccccatcccagtgctcactgagctgctcactgcaacctccgcctgtgttccaggtatagggatgggcagacctaagtgttgtaaagatcaaagtggactttgctggagggcccaagctcattttagagccttgtgcctggatgtgcagaaagctctggaaatttctgtctgtgactgctggggtcacgcggatcacctcttaacctgtgcaccagtgaaggggcacacagaagcttcattttctcccttcctttgaaacctagaatggcttgggttagacacggagggcaggcaacaggaaccgaccgaatggaacaaatggcaacaagagatttggcaacgattgttctgccatcacagaggggcacgggtggggaagggggaacgcaccgagattgcattggccagaaggctccccgcttatcctttcttctgaccacagggcagctcggggatcccaggaaaggaaggccctggtgggaaacctgtgagtgacaccaatccagcgggggagggtcggctcttccaaggcctctggagggaggggctaggtcctccggccctcagttggcacaccagccctctgccctggcactgatgcccattgcctcttttctaacaggggaagccaggtgtgaagggagagaaggtgagtcctaggcctggctgcccagatcggggtgggaatgggaccccctttctgcaaatgacagtgagcatcaagggccctaggcctaggggtgctggaccttcctcaggggacccccacccgttcttcctctgatgtccatgtgcagtgagtacataaagaacctggcttaggggtgagctgggttcaaactctgcctccaccacacacatggttatgaatgtgccagatcaattagcttctctcttagcccaagtttccatgtctgtcagtggggcacagtcatgttttaaggcttacggcgaggatgtagttttgcgccaccctggaatcttgtggtgaatgaatgagtcagttgaacaggaagccccagcggcattcctgctgtccactttgatgttgggggtggggctctggtggacccaatgtctagggctggtctgcgcaagaggccccttgccttccctggggtctcagccccaccctgtccacatactgcctctcccttctgctagggtgacccctgtgaagtgtgcccaacactgcctgaagggttccagaactttgttggacttcctggaaagccagggcccaaaggggagcctggtgatcctgtaccagccagggtgagtgcccagggtgaccattgagggacctcccccaacacacaaagaaacctgggggcatgatcatagagaggaattgggcagaggggctgggtacttctcgtggctacagagagattatgggcagagagtctaggctcttactgtggtaaggggtctgaaccatagaactcagggctgggctagagtgccacctccggtctccatggcaacctcccagggctttccaggagactctagggtgccttttgggcaagctgggctggagcccacccttactgtgagtgaggctgtgtcctaggattgggtatgttttgggggtggaggaaaggagtgagcaggactgggttagccccctctctcacagaccccctctttcaggagcacctgggagctgtcagacaaaaaggtgattgggtatatgcaggaacttcccactgggttagcttaacctggcgtcattccccccgccacgctcctgcttgttatgtgggttgatgaaccctgcctctggggtgctggccttggaccccatgggacccctaggtgtttggacggtttgcgtgtgtgacattgctgtcctcgcatattgccagggagtttgggggtgccccatcgtgccctgcctcagcccacaaacctttttaccctgcagggagaccctggcatccaaggcatcaaaggagagaaggtgagggaaccctgctctcctggctgccctcctctgcctacctggaagcatttctgatccttcctcttctttccccagggggagccctgcttgtcctgcagctcggttgtaggggcccagcatcttgtgtcctccacaggggccagtggagatgtgggttcccctggctttggtctgcctggccttccggtgagtgacgactttctcccagcccagcccagttcagccatccttgccatactgttgatctccctggcttttcagatcccaagtctcagggcagggatcaggagggaggggaagaggcaggtgtcccaggcctgtctcctggtccctccctccgtccctgtgctgccccaggctccttgccctggaacttcctcttagcacctctagcttcagttgtctaactgaagaaactgtccagctacctgaaggacataattcctatcttaccgttctgtttctggttggacactgggacccggggagccttggagaggtgggagtggggagatgctgagactctgtcttggttgtttttcagggtagagctggggttccagggctgaaaggagagaaggtgagacctgggttagatgtcagggacactggagtttcttggcaggcaggcaggggaggagtggtgcgggcggggaataagggtaatataaacaagagattcagacggtaaattcacagtgaaattaatttactagtgttttgcagacttgagtcaaagaatttatttctgagagccctcatgttctgtaagagaattccttagtgtagctgtgatgatattctaaaactattaagcacattcaagattaccttattatatttataatatgtaacacttctttattgcttatgatgtgccgggcactattccaaatcttgtaagtatattcacttgttttgtcctcccagagtttatggggtatgtgctccattattcccatttcacagatgaggaaacggaggcacacaaaggccaagtaaattgccaggtgattggatgcagagctgggattgagcccaggaagcctggctccagagactgtaatcttcactacgcctgtgggtcactcaatttcagtgcctgtgttaacgtatctatttatgattgcattggagacaaatggcaggcttgaacttctaatgcagtgttacccaaatgttacccaaattctgtgggtgtacgagtgctcaagtgtgagaaacactgaagtatgtgtgcagactcaaccctaacaggggaagcccacatgtcacatcacatgtggggcctttgcacccccaccccacctgccgcctcttcccagcttccccatctcagtcatcagctcacagccagcccctcaaagcccagccttgcggtcgtcctcagatccttcactcctgacgctgccccctccctctagccccccagcgagtcctgacagttctgcccatgatggctctctcaccccctccacttctctccacgcccaccactgccatagtaatctgcgtccccatggcctctctcctgcatggtggaacctcctctggcctgcccgtggccactgtagccctgcagcagtccggttttcacctggtagtttttcgtgtgtgtgtgtgtgtgtgtgtctgtgcgttgttggtttttttttttttttttttgagactgagtctcactctgttgcccaggctggagtgcagtggtgtgatctctgctcactgcaacctccacctcccaggttcaagtgattctcctgcctcagcctcccaattagctgggattacaggcgtgcaccaccacactcagctaatttttgtagttttagtagagacggggttttgccatgttggccaggctggtctcaaattcctgacctcaagcgatctaccctccttggcctcccaaaatgctgggattacaggcgtgagccatcgtgcccagccttcacccggtagtttaatgtggctttgtagaagaatcagtatttccctccttagagtccctctgtgacttactttctaacatagctccactgtatctcacaggaccccggatgccccagcccccatccttcccaaattcatccgcttcttccccttctcttcgggtttactctgctttagccgtgcggatcttctttccattatggaatatgtccggactactcccacccgtcagattttgtacttgtggttcccactagaagcatccagaatgtttttcctctctaccctcccccattctttcattggatgaccttattctcattcttctggtaataatcagggttaacacctctctgaccacctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaaggtgtccaatgaaaggctgttggaaaaatgccttcgtgatttttgtgtgctgagacatggctgagggtgggctggattccatgaggtgaagctgggggcagaaatagggcttctagcccctggctggttacagactcccttggggaccttggagaaagccctcttcctctctggacatgagagggtagtctggacatctgaaggggttgcttttacagttttgggtttgggattgctctagcacccagactccatcccctctttaatcatggtttctgtgctttctctcagggtaacttcggggaggcagggccagctggcagtccagtaagtatgttttggatggcaacagcttgggagaggacaaggtgggaggggctgataggcatggccctggcagatgctgggcattacctgtagcgtcttaacatgcaggggccaccaggaccagtggggccagcaggcatcaaaggggcgaaggtgagtctggggacattctccgtgctgcagcctgggtgagcttcctagatagacactcgtcttgctcgacttcgaaccctctggggctccttgctgtctgtcgggcagagtctgactccttagcaaggcatggagacccctgatgactcagctccacctttgtttctttcctgttctcccttcatctttcccaagataacccctcacccagcagaggtgcagtgtcagacccagtgacattccccagccctagattccaaacctcgctcaagtgcactagggcctgggggaccccctaactcaatgtccttgcttggcagggggagccctgtgagccgtgcccagccctgtccaaccttcaggatggggatgtccgtgtggtggccttgcctggcccatccggagagaagggggaacctgggcctccaggctttggcttgccaggaaaacaggtgaggtgggatataggcaggggcctctggacgggggatgcaggcggggctaaggagaggggaggggtcctgcctgggtctcttgactccctgggcagttgggggtagtggggagggtgtggcggggtcagagcctctgtctccagcaggagcggccctcacaggtctctgccctttatcctgggacagagtatggcagagtgggcagaaagcacgccatcctaggagcagagagacctgggttccaatcttagctttgcttcttactaagtctttgacttgagcaagtcaccttctctccacctctgtttcctgcacagagtaaagcctagtaatggcgtgtgtgaagtgcttagtggtacaccatgggcactggggaaatggcagttaccactgtggttattatcactgttactgctttcacagtaacggccagcactaccacagtggacactatgtgccaggcactgctgcacacgacatattagcttgtctaacctcacaggatccctacagggcagaagcctatactatttttatcatccccatttgacagctgaagaaactgaggtacggagatagatgagctaatttgctcatgtcacccaggcaaagagtctggcacaaatctttgctctgcacctgggcaagattgcttcactagcacgaaagcagagattttgtttgtttgtttactgttgtatgccccagcctgatgtggtgccgggcactttggggtggctggtatgagtgagcgggtgctggaaatgctttctcctcagggcaaggctggagagcgtggactgaaggggcagaaggtgagagggcgtccgtgggcacgggggtgggcatggcatcatctcagatcccctccttgcctcattttcctccctccctagcccccaaccctcagccccggcaaaggagtgtgagtgcctgcgagtcccaggggggcaacctgcccccggctgggccatccttgctttccttgaaccccactccttacagggtgatgctgggaatcctggagaccctggaacgccgggcaccacagggcggccaggactgtcaggagagcctggagttcagggccccgcggggccaaaaggagaaaaggttagtcaggcggggtggttggggtcggggagtttgttgcataaaaaaaatcaggtgtcgcaccagtgagggaaggactgcagggccagctggggccttaacggctgtcagagtcactgagcggaggctcctcggggcttctcctctgctaggagtgtcaggggcctgttttgatttcccaggctgacgtgggagcattcaaggggcagagtgttcagaggggtgcagggcgtcctggcctgggtgccagccccggctcatgggctcctggctgtacccatctctgaccagggtgatggctgcactgcctgccccagcctgcaggggacagtgacagacatggcaggacggcctgggcagcccggccccaaaggagagcagggccccgaaggcgtgggccgacctggtaaacccgtgagttgcctgccctccggcccttccctgcctgggctttgcctcctctccctcctgtccccctttctcctgtggggactccatgggccaccttatgccttttagggccaacccggtctaccaggagttcaagggcccccaggactgaagggcgtgcaggtatgtgtgagtcttggggccctgggccgtagctacgtgagggcaggggtgggatagggagatccatgggggcagtgggcctggagtgggaaatggaggcagggtgcagggcaggaagaagctggaggagaaggggctggggagaaggggaaagggtgactggggaacctcgagccagggactgtccttctgcctcttcagggagagccagggcctccaggaaggggagtccagggaccccaggtgagtctctagccctgcctttgcctgtcctctcagcacttccattagccagctacctacttccatccactcccaaacttcagggctctgcctgcccccagaggcacaggacttagttctgggaccagggatcaggccgcagccctggcctgctgttgcttctgtcagggacttgcctttgaccccagcctctctgaccctcagggtctccttggggagctcttctgaatttgggctggcagataccccacccagaccaggtctgccggtgcggcagggccagtggggcaggttggctgtggctgctgtgccctagtctgccctttctgacttgcagggggagcctggagccccgggtttgcctggcattcaggtacgtctgcctgagtcctgaaggaggatagcaggggagggggccattctaggatatgggttaactaactgtgcttccatctgcagggacttccgggacctcggggaccacctggccccactggagagaagggtgcccaggtgagcctctgcctccatgggtattgggcctgcagtattccagagtgtcccagaagcaggcacaggggacatgggggccaagtgatgcctatcagagggctgcctaagatctgttgagatgtgtcttacctgctgggttgtagctggcttccaattctgcccctgagacctttgtaccttctcttacacagggatctccaggggtgaaaggagccaccggacccgtgggacctcctggggccagtgtctctgggcctccggtaagtcttctctgtgctccatgctggtggtgttgctggaaccaaggatgtttctgctgggaagagggcacagggctgaccctgcccatcccagcagcacaggggatgggaggagagaggcctcagcccagcctcagacaaggaaaacctcactcttttaggggaatgcttgaataatacaataatgatcaccaccattttttgagcagtgatcatgctgaggccctgtgctaagctctaaacacagaaattcatgtcatcctcacatcagccctgtaagggaactcacttcatagatcaggaagttgaaggccagagggtgaggaggcagagccagggacttcaacctaggcctgtctgactcaaaccaaagcccatccccagtcattagggacatgtgaaccggtgctgcccagtacaactgtctatgaggatggaaacgctgtgttctgcacaaccacaggtggctgttgagtgcacctgaaatgtggctagtgtgactgaggaactcaattttaagtgacatttaattttaattaatttaaatttaaatagccccatgtggctatggactactgtatcagacggcacagatccagaccagcaactacttccagtataattggaaagaccttccctttgtactattcacccagtggctcccacgttttaagagacatgtctattgaacaaattgcacggattaagtaatcataagtgcattttctcatttttaatcatcaaagacctgtatagtcgtcagcttctactccacatgaacccgctagaattttaccagataatctaattgcagccaaaatcaaaggcatgctacctttcagccagtctgttccatgccaggcggtgggcaaatgcgtaatttgtcttgggcttttggtaatgttaaaaatagcccaggtgaaccgtatcctcttctgtctttgcggatccctggagaaattctagttccagtttgggattcactgataggagagtgcaccaacgtccaaagcaggcagggactcgcccaagcccacacagccggtctctattgtccctcagagctggacagccagggttcctgcctgtcccagggagccccaggcaaaaggagagatgtgggccaggtcctcaggggcttcaagtcccacgtgtgaaggtggcggagcccacatgaaggagctatgagcacagagctacgagcctctgcgtggccaggctggcttctcctggcctgagcagactccatgccgttgcccaaactgctttccttttcaggagaacgttccagacctctactcatgctgaattccatccagcaggcttcccttcctcagccccacactcgctaggggcgtgaccctaggcaagtgacagcttctcaaagtctccaatttcttggaggggctgaaatccctttctcccagttaggtcaacagatgtaacttttgtgatagggagaaagtgtatcaagcactaaagggagagaggagagagcagagacttcaggctacacacgcctggctgcagctggctgttgggtctgtcatgaagtttcttcagggctcagtttccacacctgaaaaccagaacaataccgtcctgccgggctgggagagcggattccattcagtgttccccgacgggtacttggcccagtggctggcactgagacgtgctcaggaaatgccagtcttcttccttgtccggcacctcagtctcctcctctggaacgtgggccctcggccctgggctccaggggaacctggcgctgcttctgtttgtcctacaccccttttctgcagcaggccagatggctggccgctgcccagtctcaccctctgactctgggctctctctcttcagggccgtgatgggcagcaaggacagacgggactcagaggaacaccagtgagtacagtgccttggggcagcaggaagccatggccggccctgcctcggcacccctatctgctcaccttcctgtgtttcttccctgcagggtgaaaaaggaccacgaggagagaaggtgagttccaagggcctgtgacccatattctaggggattagcagcccctccagccttcccacctgtgacccgtactctgggggattagcagcccctccagccttcccaccatgaaccaggggagcctgtgcacatgaagctgccttggactggaggatgggggtggaggaggcatcctgggctccttgctacccccagctttctggtttcaggggctccacgtatccccagcttcacctggttgctggcctgggactcaaccaggattatgggagactggaaaactccaaggcccccttaggagggcagctgcattttcaaatgggggctgagtcagaggatggggcaggaagtgagctggaaaggactagtggtgagagggcagagaggtgaggggctcccgagcgaagggcatggaagccaggctgggcccagaggagtggggctgcagttgtactgaaagcgagattacctgcgtggcagcagagaaggttataactgacgactgtaacagcaggaccatcgtttgctgaataatcaccatgcgacaggacccctgcatacacgaatccattttgtcctcctgagactccatgcgcttggaattattgttcccattttacaggcgaggaggctgaggtgcagagagtttgaacaggttgcctaagggcacattagaagaggcagatcctggattgaaaccctggcctctccatctctagagcccacgtgcctctcggatgtccatttcaagagagcccttcgtcttcatccatgtctcacaaaggctcttgtattttcagggtgagccaggggagtgctcctgcccctctcaaggagacctcatcttctctggcatgccggtaagtggcgctgtgagagccttcccccaactgggggagaggaccagcttcagcctcgtctggtgcccagtgtgcaaaggccccgcagggccacgcaccccagccagccgcctccccacgcagccccgcgcttggtgtagacgttgcctataacctctccccttcttttgcgacccccactcccacccagggtgctccgggactttggatgggcagctcctggcagccgggcccgcaggtgtgtcgcttgtctcctcttgtccgccagcgccccgcggcttgtccaccctaaacagctgctctcggccatggggcagagctctctgctggctctgactcttttctctctccctcagggtccaccaggtattcccggaccaccaggcccccctggagtacctgggctgcaggtaaagggggagaagagaatgaggagcttgggtggcagagctcatgggtcaggatggctgctcccggctggaccccaaggatgctgctcccccaccccaaaaacacagacatgccatttctcactcctctgtttacctgcctcccagggtggcaaggagggcccactgagcctctaggccaggctctgcactcccagcactgtttcaagcaatgcactgttgcgtcagctgtcaggcacccacaatctgggtcagataaaaatcccttaccctggtacagagcccggcccactgttttggagtagcattcaacactcattcatgcaacatgtgtttttgcacatttgctattttctggcactgctttaactgctgtgaatacagtagtggctaaaaataaaagtccctgccctcttggagcttatattctagtaagagagacagacaataagcaagataaataaataaaatatagtgtgttagaaagtgatacatactaaggagaatggtaaagcagggagtgagtatagaaaatgggatgagggcaggagaagtatttgcaaaatgtactgaaaagaaggtgatgtttgaatcaaaacttaaaagagatgagaagctgtgagggatagcctttgtggcagagaaaacagccggtgcaaaggcccagaggtgggatgtgtttggggaattgcaaggaagccagagatagtgagggaagagcattaggagccaagatctgtgtgacactgtgaataaagggtacattccagaggcaggcagcctgaacttgaatcccggctctgccatgtgctagctgtgtgacggtaggcaagttccttaacctctctgtgtctcactgccctcttctgctaagtgcgcctaactcatagggcttttgtgagtattaaacaagttaatgcatgtgaagggtatagaattgtacccatgactattatatattatttatgtgacaaatgcttagaaggcattagctatcattattatgatgatgagtactattattattttacgtccattcttttattcatttgagccttacataaaagccccaaaaggaaggcagtattattattcctaagtcacagctggacaagctgaggctctgagcgatggagtatcttgtctaaggccgcccgactaggaattgacaatgctagactggggcttccccatgcaaagcactttttaccttcttctgatgcctttcaggacagttcccagtggtttgcctagcaagccacgttttccagaggttctaggtggcatagacaccactgtccgtgtgtctggctcccagctcctaagagagtgattctcacctgaagaagcagggcagcatcacatggaagctttttacaagctactcctccttgccccaatgatttgatagattttgtatcttccctccccacccccgccaccctggcacacctcccctgccaccgtgggctgggagtctgctctagtgagccactgttgccgatgggagtctctgccaggatcccaattctctctaccctattggaagtgctgaactagagcccacgccacatatttgcagccacacatttgccgagtgtctggggcttttggggcttcctgccacactgccaggaaacaggaatctgtctgcagagggcttgcagtttgcttggggaagcgtaagagtcatttcaaagtgacccattaataagcgagagctgatgtagtgtaaaccctgccaagacatgctggggaatgaggcagaaaagagtgactgctgagtctggtcccaggcaccagagtccttacctagtgccagtgcttgagaccaagccgaggctgctgctcacaggtacctgccccatgccaggtgggatgcaggagggccaagcagctcctttattcaggtatagaaacaggctcagggatgtacagcacttactcatccaaggctgtattgtcccagtgcttagttatctcatttcatctcagtccattccacagaggaggaagctgaggcactgaggttaagaaagatgcctgaggcaactagtaggtcattgagcccagctttcaattctggctgcacttcgcttccgcagtaggacaacaggtagaacatttagttctgagaggtcaggaaaacaattacaaagtatcaggcttgaactatcacactggccctggagaggggagcaagggatgaataatgatttaaggcataataattaacatgttcgggccaggcgtggtggctcacgcctgtaatcccagcactttgggaggccaaggtcggcagatcacttgaggtcaggagttcgagaccagcctggccagcatggcgaaaccccgtctctactaaaaatacaaaaagaattaaccgggttttgtggtgcatgcctgtaatcccagctactcaggaggctgaggcaggagaatcgcttgaacccaggaagcggaggtttcgatgagctgagattgcaccactgcactccagcctgggcgacagagtgatacatctcaaaaataataataataataataaataaaaaataataattgacatgttcaaggcattttccctgtgccaggcactgctctaagccctgatggtgcacagaggtgccagggggcctggatggtggctggctccgggtctgacccaggcctggtagagcctgcctggaaattgctcgggggctggtgatatgttccattgctgggagctgggacttgaaggaaggccagatctcagagtgcgccaaggaaatcctgtgcagggaggagcaggctgagcagcggtgcattcactcaacacgtacttactgcacatctcctccatgttgggtgctggggattcaaaatggaacatactccctgcctccatggagtatttaatatgcaaatgtgcctcacgaatctgcaaggggaacattgtccgggtggcatggatttaatgtaaacatcgttgcagccattgtctccttgaagcctcaccataaactatccctgttttatagataaggcaactgaggcatagaatttttttcccccaaataaattgccaaaagttatacaggtagtcagaattttgtatctagatgaatctgactggcaagtacccacccttgctgtgtacatgaatgttctggggatgtctgttgaggaatgatgctagaattgtggttaagagaggggttagaagccagtgatccttgctctggacctcagctctgtgccttgctcaacttgtgacctttggcaagttacttactcctctgggttcttttttttttttttttttgagacggagtctccctctgttgcctagactaaagtgtagtggcgtaatcttggctcactgcaacctccatctcccaggttcaagtgattctcctgtctcagcctcccgtgtatctgggaccacaggcacacaccaccatgccctgctaacttttatatttttagaagagacggggtttcgccatgttggccaggctggtctcgaattcccggcctcaggtgatccgcccacctcggcctcccaaagtgctacgattgcaggtgtgagtgaccgtgcccagcctcctctgggttctttgtgctatttttaagatggagataacagcacctagttcaacaagatagctgtgatgattaaacgagaaaataggctgggtgtggtggttcacgcctataatttcaacattttgagaggctgagcggggaggatcacttaagcccagaagtttgagaccagcctaccagcgagacctggtctctataataaacacaaaagaattagccaggcatggtggtgagcgcctctagtcccagctactcaggaggctgaggtgggagaatcgcttgagctgagtttgaggctacagtgagctataattatgccattgcactccagcctgggtgacagagtgagaccccgtctctacaaagaaaaaaagaaaaaagaaaaggaaaggaaaaagaaagagagaaaatatagaaaaacgacttagcacagaaataaacagtagttccatggaagaccctctgctcaatttctgaccttccctctgatgtggggggaaaacacttgctgttggacggtttggggggtcgctcttctgggcctccctggctttccctataagggtcgagaggcttttgagctaagaatagatgtcagccttgtgccagccagggctctcagctctgcaggacaaggggaagaggaggcggggatgatgagaaggaaacaggctgaccagcaggctagagagatggagcccactcactcgtgtctcttcttggctacagggagtgcctggaaacaacggtttgccaggacagcctgggctcactgcagaactggtgggtactggccaggactccctgtgcatgccccttccctgcccttcccagggctgctcaggctatgaagctggcccggtagctgcagtgggggtccctcttctctcccacttctgaggctggaaggtgcatgacgtgtcccaaggctctccctgatcccataagtctccatgttccttcccctcacctgcttgagcccacacatctgtctcttgcagggatccttaccaattgaacagcacctccttaaggtaagagggtacccaggagggaagtgtgagctggcgggggtgtctcctaaggggattctcttagtaagtgctcagctgtgtggcacctcgcagagagagcagcagtttgcagggaatacgcattccaagcatctgtctaagagggcctagctgatgcctggcttgtaacaggcccccaggcaacatttgctgaatgagtgcttaaaggaatcctgtgaaggtgcccacatggcagatgctgtcggcagaacccagccctgaagcctgcccgcagcagctggcaatgagaccccgtagcacccgggtcaccctgcggcagagcccagcagcttccaaagcaaagcagagggggtgaaagtgcagtggtggggggctgtgagattgggtgtggcctggaagaaagcttcagctgttctctagtcaatccagaaagaatccagggaggagatggatttgagaagcacttctggtagtctaagaaaggggacttcggacctggtcagagggtcggcctgtgccagggcctgtacacagccttaatgctctaccagagggctgtggcctgggccggcttcccaaactgagcagaagttcctattggaatcaagagtcacatagcccatctttgcttagtcacctctagaaacgagagcacagtaattccccaggttgccttcaggtttttgaaggaggcccttatgttcctggactttctctcctctagcccagcatcctcaggggtctttcccatgtgttggcctccagagccccccctcatcctggccaccctcttctgacactggctaattagtgccctggacatcccatgaccccgatgggccttggtcagggcagagcatgggggctgtctaccccttccctgctctgaacggcagatttctccagaagcagccagaggaggtcggggtaacctcttggcatcagttacatgttggatcacagtgaggttgtggcaacgaaacccccagctcttctcccctctgcttctgtcaatgactgggcagtgatcgtgtgactccaaatccaggatttgacatttctcctgtaacatttcatctgttggcttcttcatcaagtgctcttcagaggattccaaatagaaagtgcgcatagtgtggagaaggggtcagatggcaccccggggcatgctgacccagagccccagccaccacctgcacccatagtccaggaagcctggggagagagcactggctgtggcctaggacaggcccacgccaatccaggctcccactttccttagacaagtcacgccgcctctcttgagtgggctttcccatctccacaatgcttataagattccctgtctcactgcgccgtcaagatggcatgtgataatgtgcagggcttattatgtacaatgcccagcgtcatgggtgctgagtaaatgccagtcgttattactgggcttggtggtgagcagtgaaagtgagcaggggctcctgcctgggcatctgtggacacgacactggccacaaacaggctccgggctcctgagtcctcagaaattgcaggctggttttcactagtgggtttgatttttctgagaaaaggacccatagcttccatcaaactctcagaggggtctgtgacccaaagaaggttaaagcccttcctgtggggaagacaattctggtggcgcgatccgagccaggagcctgtgagcaatctgagatctgtcccaggggctcctgggaagggcctggctcctcccgcagctgttcctttgctcccttgggcagagaagctggcgttcggagccagcctttccagcctcactcctcgtggcttgtcctcgcagtgggtgcaggttgcaggaacagccgggacagatggtccctctgcgggcccctcgcctccacccacatgcctgtctggaaagtggctttggcttagctgtaccagagcttcttcctggaggaaactcaaagccaattgttgggagtgggtcccccgaggatggagcaaagctgccgcagggatgcggctggggagggagggagtgtgggaggagggaagacggcagggcagggagccctggctctgggttctcactggggctccccagttggcccatcctgcccatctctaacccaggccccactcctctccccactccctgatcagagtatctgcggggactgtgtccaggggcagagggcccacccagggtacctcgtggagaagggagagaagggagaccagggcatccctggtgtgccaggcctcgacaactgcgcccaggtaagggactgggcttggggctgccctatgcaggagggttccctggctgcctcatcagacaatgtgcctctcattgtcccttgcagtgctttttgtcactggagcgcccaagagccgaggaggcccgggtgagtgcctcgccttatctcccccgatcatgccccatgccccacagggacaggccctgactgctcactatcaccgtctccatccttctccagggtgacaacagtgagggagatcctggctgtgttgggagcccaggcctacctggtcctccgggattgccaggccagagaggagaagaggtaagaccagggatggggattcatcctcaagggagctggggccctgtctgcctttgagacctcttgggggcctccgaggcctcacctgactgatgccctttaccactctgggctcatctgctctcctggcacgtggcttctctgggatacacaggacccagcgtaggacacactctttctccccagtgcccagctgcatcctctgcctgcaacgctcttctccagggcttattcctgcactccttcagctcggctcaaatgtctccttctcagagagacctcccctgaccaccctctttaaaattgaactccacaccaaccccagagcctccagtccccttggcctgcatcatactcatcaccatccaacatcctgcctatttacttcattcaggaacattctacaggtgtcagctcaacaccaactatgtgccagctcctgttctatttgttagtgtccgtctctcccctagaatgtaactgctttgaggcaggggtttttatttattttgtttatgctgtgatcctagcccctggactaatgcctggtacgtaatagttgcttgttaaatgtttgtaggatgaccgaatgggccaaatgaaagattgttcgaacatcagctaagtggtcctgcttggacagcagccaccctctgttgaccttggccctggcaagctgggaggaaggctgctggaatcccaggggctctatggggcctgggcctcttcatccatttcccttggcttcctttgcagggtccgcctggcatgaggggctccccgggtcctccaggccctatcgtaagtatcagtggtgccctggtctgcttgagaagctctcaaaggggtcattacactcagacaccatcccgcggccttgtccccaaaaggctgggcaaggcaggaggagggaacttccactgccctccccatccctccgcagagcatctgcagggactgtgctctcccaccaccggatgccctggaaccgccctgctctgcctactgcctgcggtcctgcttaggggaggtcctcagaggcacctctttgcttccctgtccccaccctctgctgcgctttccacagtggccccaggccgccctcggcagggggcctaggcttcaggctcacagcctcccaaccagggaagcatgcggcatgctggccagacctctccatgcccctgtgactccagtccccacaagggctcggggctaagatggagctgtcctccattgctctgtagggccatctctagggtaaatctacaaaaaccagaccagggtatctactctggagtcctctgtgatgttgacatggcaggaaaatagaagtgactaggaaagattgaaagaactgaaaatgctttctctggagaagaaaatggctggtgggagctgtcttacagccagggagccccccactcgggggacaggtggaggtcgggtggcaggcatggtgggcaaggctgaaagaaatgggcttctgctgcaaccggatcttcagttagactccggaagactcaggaagccctctgactctggagccattccgcatctccgtcaacggaggagccattcttcctggagccaaggggaggaacagttgtcttttgagccaagactttcaaggagtctcttttccagctgccttgaaaatactcccatgacctcctctccccatgacccccaagccccagactgtgccctccaggctgtcccagggttactgtgcctgtgagatgtgacctgcctgtttctcccaccagggccccccaggttttcctggtgctgttggctcccccggattgcctgtaagaacctagcgctgctcgacctcccctcccccccgtcagccaggtctctgtggcttttgcttgtctccctcctgtcgtgccttcacctccgtcctccgtgtttgttgtcccccttcaggcacggtagctaacgacacgggttctctgaggtcccggcagcttggacatcctcccagtctctgactcctttccgttttctcctctccctcctctcctgcgttctttctctcctcttctctctcttaccccgttctgtcttccttctccatttctcgcaccatcttgcagcactcccccaagtcctcctgagctcgtgaaccttcctcttaagctggtgcctctagggggcccctccattcctgccttctcgctctgcctcctgcttctcaccaccttcggcgttgcctgaagatttgctgaaagtagttcttggggccctgccaggcacctggctcagagcccagcagagatgccaaagctttagggcttcacattgcaggctggcacaggtttgctgccctgctgcttggcagggctgtccagaggcacccagggatttaaaggcagcccttcctgcgccttttccgtcgtcctagaggaaactctcagctgcctcctcttcgcttcctcttccttggctccagtcccagtctgctccaaggcggggcatgtgatatcagccagttgggtttctgggtgtcgtgcggccctgcccctctgtgcccggcaccttggccggctccttctgccaggtgtcgttaattgctctgccttcgtcatcgtcacaggtgtgtttacatcacccccagcctcattgttgctccctcctgggtcacggaaactaacctcctgtttgtcaggtttcgtgttcctggggcctggctcctctcctcccaggcctggtgatggaggctcagggagcagggcccctcctcgtcacagttccatctgtccccacgtcctcatctgtggccgggccttgtctgtttctgcttgcttgggtgaaggggccatctgtccgtctagccatctgtcttatgtcatggaaaggtttgggcgtcatctcttgaggggatgagggagaagggggcaggaaaggtgcccttaatggcatggcacctgcaaaggctggggtaaggaattaggggtgggggctgtagctctcgtggaaagtgacatgccctctcaccctacaaagtgacagggactgctctggaggcagccttcctgtgtctctcccctgcctccctccaagaaagtgatttttgcttggggtgggggacttggacaggtaagtgttgggtatctgatgatatgatacactttggtggcagcatccatctggggtacctctcctgacagttgcccctcagaataagcacacatctgatccatcaccttcctaaaggtgtacgccagtcagttaccatggcagggcataccagcgacgggcacctgagagataccctcccagagtcacctctgctggagggcatatctctatagttatctatcttgaagggtatcctcctgagaggcacccatatgtggggttcacacctccaccagtcatcctgctggagcacacccattacgggtcaccttctagggacactacgagagccactatggcctccatatttgcctggagtgggaacagaaggcagtggggcagggggaaggagtcaggggctgggtggggaccgccggctcctgcagtttctcatgatttttctctccaagggccttcaaggagagcgaggtctcacgggcctgactggagacaagggggagccggtaagaagaagctggcaggggctggaaagggctggaaagggaggaagagctggggaggcagagcttgagctctgaagggtggctgctgagtggaagctgggaggtggactccttgagactctctgcccttctgccgggattccctcagtgtgaggtttccacactcccccaggagcaaaggaggccgatctccatgtgccctgactccctgccagaagcatgcacagcccctgtcctccagcagcgtccctgggggctcccctccctccctcggctgttgtcactcagcatcccagcccaccccctcttccctggtcctcatgcctgctctgggctccctgctccggctcagctctcagggtctgggccaggctggggttcgcctccccagcccaggtctgtggtggtggtcacgaccgaggggacctggggcttggggagatggcccagtgtgcaatgctggggcaggctggcacctgctagatggcagccccagaggttttagctttggccatcctcttacccagcgaggggagaacagaaatgttggggggctatccatcatgtctgcctttctttgcagggtcctccagggcaaccaggttacccaggtgccacgggccccccaggactgcctgtgagtaaggggacccttgctggggagtgggtgccaggtaccagaggtttgggctggtggtcaggacacagccaggctgggcaaccctcggcgggctccccattaccgggcatttcagcctcctcctttgcctaaagtccatgcagccccctctccccactgtaggcccccttggcagtgtggattggtcccaccactctgctcaggcctgactctcagagcactctgccaggcccagacacagcaagaactgagatctgcctcctgggggtgaggggtttgggagattggagagacagcttagaggtgccacccccacagaagctgctgggtgggtgtgtcctcctttccactgggggcttggggggcacggtggcagatgggaggcacggcagctttggagcacccagcggtcctcccagtgccattcccccagagccagtctgggtgccagctgcagtctccgctcctcgcattagtgccgtgacggactaattctgtggggctaattccactgtctctttgccacttgtcagggcatcaagggggagcgtggctacaccgggtcagcgggagagaaaggagagccggtgagtcccagcggcgtggggctggatgcagggctgcacgtggagccacacagtctcgggctggagacttggcagcagcctgtgaaggggaggatcgtgacccctgctgcccccctgcccccaagcctgcagcacaggctgggtgctgtggaggtggaggctgtgaggagaatccccgcagggctgccaaggggagggtgccaggaggcagccgcagaagcactcctccgcctcctacaaaggaggacctgggattatagacccccagtggaccccagctccccagagccaccctccagagccaaggcctgccaggccccacgttgagcacaggagttgggctgtgaccagatgaggacactggggcccccagagtgacaaagctgagactcacccaggctcctgaagctagtgagtgaggtagtggtggaacctgggcttgaacacacatctatctggtgacaaacctcacaaacctcagatctaggatcagccaaactgggactgcagccttacagattcaccagtttcagtgaggccccagtgggattcagcaaactccatcaggcatttactcagtaatagatatttctcaggggcctgtggggtgccaggctcccctctgaggatgtctccatgaacagagcgcagttgccctcttgccctgccgtgggggagggagctgccagatgaataaacaagtgcctaggaacgatgaggactgggactcatggaggaaatgggacaggggaaggggctggagaggtgtttgggcaccatcgaagcggaggggcaggaaggcctctctgagcaggtggcatatgagctgagagctgactagcaggagggagggatctctgtggctgtctgtactggggaattccagagggagaggctgggtggggcactgcaggaacagcttccagccatcagatgatttggcaagggttcaggggacctaggaaggggggaagggggcattctaggtagaagagaaagctgtgctaagggtgcaaaggcctgggggtgtgagggtatagagtgtgtcagagaacagcagtctgactgagcaaggcggaagatgagaaggagagagggaggagaagtgggaaagggtggctggtgccagatcacaggctgcctcaaagaccagcgttggtggaaagtgtgcgccccactcagaggcagagggagccgcataaggtgtttgagcaagagagtgacataatcagagctatgctggaggagaagagggcagccatttgctggctggcttgcagtgagccaggaggtggcaggacgagttaggaggctggttcagtagctcgggcaagagcagggaagcctgagcagatcaggcagagggggcctgccagcccaggggcctcccagcacatgccacctctgttctgggcagtcccctgtcacatccccctacctcatccttcacctccccaggaggagtgactgattctgttcctttgtatccttagggccccccaggatctgaaggcctcccaggccccccaggcccagcggtgagtgaaggagggcatggggagatgtggtcctggtcttgtcctggggtctgagggcaggaagattaggtttcggctgcattgttctctgtgggtgacagggtcccagaggagagcgaggaccccaaggtaactccggtgagaagggcgaccaggtgagtgacgactgggacctggctgcagggaggcagggaaggagctgggtccctggtgatcaccagctctagtctccccaccctacctgtccttgggttgtgacctacctcatgcccagagcctcacctgccagccatggtgggcagaggggagggcaaagcccatgggtttgagggtgccccccccgtcactctttccacctgggcagccaggcaggagagagggggtggcacagcacactgccccttgcttctcaccctagggatttcaaggccagccaggctttccgggcccaccggtgagtgaagaagacacaaagccagctctgtctgatgtggtctcatcgggaggggcaggcctgaccaggccaggctggggtaggatggtcctggggagaagaggggagaggcaggggagaacggcctgggtggccaggcctgattccaggaaccaggacctggagagcccagcctcttgtgtgggccccagcccagcaggccaggcagacgtaatgctcccaagtggtgcttctaggaagtcaaaatgaattgcattaacaacagtgcatcatgcacaggaagaataaagaaggggagctccccctccagccccactttcattcctgcctgcccctttgttgatacagggtccccctggattcccaggcaaagttggatcacctggcccacctggccctcaagcagagaaggtgagcaggaccctgggttggcaaagtcacagatctgagccatgcagctcccatgcccctgtcccacccctagcatcaggctttcaggaaattccaagactgacccagttgcactgaggctgggaaaagaggcctccaggatgggcccagtgactactggaggccgacagggcttgcagtggaccagtgggctcctcgggatgtctgcttggcccaggatgcctgcggcctctgtgcagcccaggcccttgtctgctgtgatggggggaaaggcagggaggtaggtggggaggaggcagggggtctgatggaggagtagaatgtgataggcagcccaggccaccttcgtctcctgggcgggaggatgagcgaggagctgagagaagggggaagcacgtcctgaaggaggacaccaacgtggaaggggaatgggctcctcctgggtagccgtgctccagttgtccccaagggcccagagagggcaggggtggcccgtgtcctgcctggtgacaagggttgggggagcagcagttggcggagctcctatgctggctgctcttgactttggcttgataaatgctggagacatggctctgccttggcttggggctgacatccctgtctcggcccaacctctgggctccctagatgtgctgagtgggtggtgtaagaagcccgaagattgacttctgagcttggggtcgggggacctgggttcagagggacaggtgggagcctctttcccctgagccttgtggagagcctctttcccctgagagcacacgcatgaacgtctcactgtgcaggtgaggaaactgacacccacaaggcttggggcagcccagaggcacacagtggtgttagcagcagagctgagacttccttcccagctccaggaggacccgggcacctcactacctccccagagcccatgctgatcagccatgcttgggacagtggtggttgctagcccccttccccttccccttccccttccccttccccttccttcccctccccaggacctgagtggcagcccctgctctccttaggctggtcattgcagagaatcccaaacctctggccagtggttcttcatcccaactgccagtgggggccaacattggttggggctctgctgacccctcctggtggctggtggcattacagagcccccgagttcattttcccctttgctgggtctctctagcgggattccttcccttgaccaccctacagccactgatccagggcagccaccctctccacactgggagaatgcagccaccttccccgctatgctgcttgcctccccccgccttttctggtaaacattccaatccatgcatcagttctcatcactcttctgctttgaacattcaatggctccccagtgcctgtagcaggggttttcagactttattttgtagtcccagagtctttttatcacataaaagcaaatgtaaaaacctcaatctataaaacaaatacaagcggagattccctggctaagacaacggtgggggtcctagagtccctctcttcagtccccacttcatgcccccagcttctaggctcccccagaagccccagtgctctgagaagtacagcttaaaaaccactgactgttcgataaagtttagcacagcgttcagggcccccactcatcatggtgactcttccagcctcttctgcctgccagcccatcccacaggctcccccagatgccctggccaggccaggcatgtgcccacttgcaagtctttatccttctcttaggttccctctggcatgcacttttctcctccacctgcccaatcccagacatcctcagagtctagcatctggtgacacttctgtgacactttccctgatccccagccagagggaactgctccccgctcctgagctccctgagcccctttccacacagaacacttagactgttgtattgcccctggttgtgttgggcccatgaccctcactggactgtgagctccttgaggacaggggcacccactttttcatcttggggaatcagagcccacatggtgctgcgtgcgctgttgaggcctctgtgcagcccgggcccatgtctgctgggatggggggaaaggtagggaggtaggtggggaggaggcagggggtctgatggagtagaatacaacaggcagctttcacagtggattgaagctgtgctttcagttcagcacatgctactgagcccctgccatgccagcccctgggtcagcactggagaagatgccctgtcccttcctcatggggcagcaaggaaaggggatgctttgcagatgaagacagatcctcctggggaggcgacgtgtggcacatatgcagttagacagggacagattgggcccagaagccagctgtcctgtttccagcagtcaccaggacccttgacccagggcctggtctccatgggtggggcaaagccctgctgactttattgtggggcggggggggggggcggcgctggtttccagggcagcgaagggattcgaggcccatcaggcctgcctggctcccctgggccaccgggacctcctgggattcaggtgagtgtgtgccctttcagcgtggcagacgtgtgcgatgcatgcgcatgtgtgtggtgcatgtgtgtgtgtgcacctgtgtgtgtgtgctgaggtgggagtcaggggaggggtggagagaattgaggggttgggccaggcctcccacctcctagggctcccgcaccagcatgtagaaatgcctctttcctgtttccagggccccgccggtctggatggtttggatgggaaggacggcaagcctggcttgagggtgagatgatgggctgggagggcgggcaccccttcctctcctttttgccagaggagccaaagtcaagggaaccctgatggaaagaaccgaagtatccccgtctttgtcagggggcacccatgccctccctcggtctgtctccctctaccccagctccccgatggcaccacagccccttggcttcccagttctcctagtggccttaagcaggttaggcgagctaggtctcaccaaaggcaggatggtgaaggcatgatgtatgcagaaactcaagacagctgaggaaaccaggctgggcttcaggaagaatgagggtgtggacatggaaggacttgagcaagccctggctcctggggttttgctggggaatctgaaagggctggggccacaggacagggtagaacatcaaagtcaacccccttatatatcccaaagaaggaaagctaaggcccggagaggggctggaagtcactgaggatccacagccagtcagaggctgagccaggcttggattcttccctccatcttaggatagctggggagggctggagagaggggaggacagaggtatgagttggatacaagctgggcaaaactcttgtctcaatcctcctcgtctctttccctagggggaccctggtcctgctggcccccctggactcatgggaccaccggtaagttgagctgcaggaaggagttggaagctgcgaagttgcagcttctgcctgggtggctgcaacagctcaaatccagatcctccgtggaccgtgttatgactttggattggtttgaattgtttgaactgaggaaggaggagtgggaagaggcccccagctgacatgagggacatgagaactccctgctttttctttcagggctttaaggggaaaacaggacatcctggcctcccaggacctaaggtaagggctggtgacctctgccaagcaggttatctctgctctcctgaaggcttgcccccaggcatacatggcagcctatcctgggcagagaggccatcccagcatcagagcctcctggggccactggtgcctggcagactgggtcagggcttctctgtctaccagctggagggcatcagagggcctctggccaaagctggggcaggtggcagggtccctctgatgtgaggttgacttggggtagggatgtcaagtgaaggtctggtaagctccagctgctcctctctcttctagggtgactgtggcaaaccaggtccccctggcagcactggccggcctggcgcagaggtgagggccagggatccacatggctgccttcagtttgccttcagactctgcagagtctgggatgcagccgcttcttcctgctcactggcaaagtggctgctttctgtcctcagccttctgggaggggtgtcacccaacactgcacgtcttgaactttctccctcctattaagggttgtaactggttctgctccctggaggttactgggtcaccaacctaaaaaggcagggcctggcctgctcaggctgaggatccgccttctctacctaactctccgggaaacttgggtctggaggctgggaattggcccagctcctttggccattggcattaccatgtattctgcccagccccctcccatccgacagccacatggtgcaagcaagtcagtttcagtgtcattttttcctttttctggctcctgcagggtgaacctggtgccatgggaccccagggaagacccggtcccccgggacacgttgtgagttgaaccacttttgtctctgtctccataagagttagcattttggcggggtggttggtggtgcataggctgtcatgacctgagagaacttgccataggggctgccccagccgtgggagcacgggggccactccttctgtggtttccaggcttttcgttattttcttattttctgggcacattcaagttcacttatcagatggaggtcattcagtcaacaaataattgtggagcccctgtgccatgccaggcttgggggacttgctgatgagctggattggggttggggagacagagtgacagaaagagaagaaccaggggtgactcctgcatttgacttgggcaactgggtaaataggtggtgtgtttcccaagatggggtgacttggagaggacatttatcaagcaacaatgaatttcctgtctactttactcatcactaacatagatgactgccaggcagtgcctttgatcagtgtgacggcactgagctgatgggactccagagaaaagcgaagatactggcattttgttgcagccctgttgtggctggctgcataataatttccaggaggctttcggaaatgttaaaaatagttcatgaccaaaaaaaaaaaaaaaaaaaaagaactctcaggcccccatcactatttttatgcatctcaaggggtccagaggccctggattgggaatgccatatcaagcctggttccccctcacattacagatgacacggggaggtgcactcagaagcgtggccccattggagactcagtagggctgaggttgagggggtgcagggttccgcctctctcttccgtgtgtccagccccttcgtcttgcagtgtggcagtctctgtgctggacacttccaccccaggagactggagatgaatagaacagaggctatggctctggaacgtgccacctgggggtgttgagggaagcactataagagagacccaagtgccccgggggttcagagaaggtgtcactctgatcagggaggtgatcttttgcaccacagaggcatggatgtaggcatcagagctagggaagggcatttcagacgcagccctagtgcagcagcagggactgtctgggtgttggagtcccgtgcgctccagtgttggccagcaagtgttagctccttgtcactatggatgtcggggtcagtgccaagcccctgcccctcaccccctgctacacggacccccagcttctggtcttccctcctccatagaacagcaggaagtagactgcctttagggaagcaagggtctcagtagccacctaggccagggagtaactcccccaggcctttgtcctctgcacttggcctctggccacggctttcagatcatccccctcagcacagccccagatgctccactcagcctgggttggagggagggtcctgtgtgcccaggacccccaggcctcagctctgggcgcaaatcttgtccgaagctcaagtgcaagaccagagcgaaggaaggtttccagaggaaatggagctgctgaagtttagagcttgtttctgctgtcaggccctgtgcctcccaggggtcttactattagaacctgtttctatcccactgactcatctctctttaggggccaccagggcctccaggccagccaggaccagctgggatctctgcagtggtgagtaacatgctccactccttcctccctcccaggagttttgccctgcttgactgtgggctccattcagaggaagctggggggatggagaacagtttgtctcatcccctccttccctggtgtcagcctctcctgcctccaaagatctcgccttccaggatgtggcagagggctttggagagggctggaggtcatctcagagtcctgctgcaagttcaggcagtgccacctctccctgtagtccctggcacacgatggggtgtctgtctctggctatatgggagtccactttgcctgctttcctcccctctcactgtcccccttcctattctctagggtctgaaaggagaccgaggagccaccggagaaaggggccttgcaggcctcccaggccagcccggcccccctggacaccctggccccccagtaagatcccacattctacagcatagcccagggggaaagagtcaattggctcaaggcctgttgagcacagcacaacatatctggggtctctaaggaaggagaggctgtcagcatggcaggatggcagcgtggcgttcgggcctgaggatcatgctgaatttggaaggataggccctgcagtgctgtgccaggctgcacatgaggtcactgcccatgacggtgcctcagcatcaaccttctgcagaccccttggctacgtgtccctgttctgcctcttccccttccccaggggagcttgtcagtaaccacagaaaatcttgctaaatgtcaggaaccagaaatgcagtgctgttactgtaacttcctgaggtcctcggaaaccaggacttggtctcagctcacgtttaacactaagagcgctgatatatcggtcaccgatgtgtgccgaatggtggactaagtgcttgctgtgcattttatcttaatctgtgccgcagccccatttagtggatctgattgtccccattttacagatgaggaaacgggggctccgcaaggttaggcaggttgctcggagtcacatagctagtgagtggaagagctctgacttgatcccagcctgcctgattccagaactcatgtccttagccactctgcaaatctacctctctcaaaagttccagacaggtgaaccctaacaggtgcaactgattgccagggtcagggatgaaaagtctcctgggagagcagaggcagggacccaggtctcctgggacccatcaggatgctttccatcaacgcagactttttctggggggcagcagcagtgaccgtggggctggtggcctgggctggggtgtttgactccagtcagcccatctgccaggcgggcccagtctcaccacgcctattcgctctgattcctgccaaggaccctgcctccctccttgcaggctcaggagcctccatggcccctggatgaatctcccacttgcctagcaatcagagtcctcttccccagcagccaccagaagagaggctgccttgctggtctcagggagggggccggctcaggctgttcatgtgttcattcagcaaacgtttaacatagattcagagccagggagtgtgcaaggtgccaggatccaagcacacagcaaggcaggcacggtctgttcttcccttgtaaagctcttgtagacgggggctgggagctgttggggctctgggatcacgctggagtatggggtgggggtctaagtttccacggcctgtgcccagattgtcagagggtgagggctggaggatcgtggcctctgggtggaacagggggctgggcttgccccatgtacaaagtgaggcatctgacaccaaactgggttggagctcctcatgtctccattgctctctactccccagggcgaacctggtacggatggtgcagctggcaaagaggtacagttgtactggtcttctctgtttccttgggggtgcttcttgctcctcgccttgccctgacccctcttcatttttttcagtaaacattccttctatgtacgggctgtctctggaaattgttaaccctgttgtcctggggagaggaattagagacttgaggccaaggatgggagtgagatttgttttacctttttttttttttttttaaaccctgtacctggtcaaaaagaaacaacaacaacaacaataataatgataataataaattccaaacaaacatctcctgggtaccaggtctttccaggccccccagtatgccacagactggccctctcattctgacttctcgcctctcttcatctgtgatgggggcccagccaacatgcttaaacaaggccatgccccagaggacattattttcccttccagctgggcagggaggctgcgctcctttctcacacagagctgggctggacacacctgggggcctcaggctgtggaaggggcctcttcactgcacctgcctccccagggagcctcagagatgctgcccggacttcacctctgacttttgctttcctctagggaccccctggaaagcagggattctatggacctcctggtcccaaggtgagtgggcactggctgggcttgagaggagaagctcacgagtggatgaagcccagctgcaagttacggctttagccacagagaggagacacaggaaggccagtgggcagggggcaaaaatgcagaacttggagcaggatagtgtctgaaaatttctcacatggggtcattagctgtggttggggggaaggaaatctccagttcatttactcactgattgactgattgattcattcattgtttccatttcccgagcactcccttgctcctgctcacattccaggcccttgtcctggcctcaggtaaacagaggtccctgaacaataggtgctcacaatagaccagtcacacttacactagggattggcaagttttccagaagacatgagacatagcgctgtgggatgagagggaggagcacccaacccagcctggggagtcggagaggctgcggagagaacaggaacacttcagctcaggaggggtgcactggatagagagagatgaggggaagggcattcaggaccataacaacatggcagaatcagagaatcatcaccagtgaggtctggtgggaggcagagggtggggagaggaggctgaggaaggaacgatcaggaccacataatgaatggccttgcatgcccggccaacgaatgagtgctttatcctgaggacatttgggagccatcagaatttctaagcagggagtaacaccaggagaactgtcttctagaaggaccactctggggcagtgaggtggagtgacctgtcaggatgctgtggccacagtctagagggagacgctgggggcctggtgggagggtggagagaaaagagcagattggtgagacatcatgatgtaaatttgacagcactaagtatctatctttgtagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatggtaagggggaaggctggcagctgtgggcactgtcccatagagcaggcatgtggggtggagctcggatcatcttccaagctcctgctgacattctgtgggaaagagcctggctcccatagagggcagctcttaactgtgtgcggaagggtggggatgataggaccctctccccagaaaaatgcacttaagaacaaaatgttttgtatcatatctgggtggttaggactttggattgagaatctacggaggttgctgtgagccaagatcgcgccactgcactccagtctgggtgacaaagtgagactctgtctcagaaaaaaaaaaaaaaaaaaaaaaaaaaaagaatctgtgggaggctcctgggacctttgccttcctccccatcctttatttccataggggaaaatgccaggcttggaagtataattgaggcaggttttcttctctttcttcagggagacatggtgaattatgatgaaatcaagaggttcatcagacaagagatcattaaaatgtttgatggtaactggcagccagctgggtggcagtgggtgctgtctgcccttccttgtgacttctctgccctgccttggcctctttctccttaacgctcaatgtcctcctgctctcaccctccacacactcacaggcctggggttgacaggcagatgttcaattatccttcagaccttccttgtcacctgttctgttcagagataaaatgattccctcctgcattccccgagcccccacttgagcaaaggagacagacaagaaaattggtattaaacgagtctgcctgaagtgagctctaaatacaggggcgagcggcactgtaagatggctggggtggtttatttgaagtgtttttttctgttcatttgttcatccaacattgatgtgccagggactggggaaaacacaggccctgtcctgaaagggctggacgtcttgcttgggaagcagaccttgaatgccaagcaaggaatgcggactttattctgaagccagcggtgaactaatgaggggtgttggagcagagatgccatagtcagatctgtgctttggaaggatctccatggggagcgacgtggaggccaggacgtgggaacccccttgcgagacccacccccatactccttgccctgacatccctgtgaaggaaggctgctgtggacttcatgctggtggcctatatgcagcatctgcagtcattctgagtccctgggggaccctctgacctgtccctgtccttgtcctttttttacagagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggtagctctgccctacagttcccaagggacacatgtaattctttggggcaggcctaagtattccatgaggtctgttgtgaatatgggatgtatgtgtgtgtgtgtgtgtgtgtgtgtgtgtttcaagtaatctgactggctgtgtcatttttctgctcagggataggacttatttatttcttttgttccaggattgcctggtaccaaaggtgaaaaaggggacattggtattggcattgcaggagaaaatggtcttcccggccccccaggtaggaaataccaccatttgagaccatgaatccagagcagcagagaccccttttctttctgtttcttctatgacacagctgtgtcaaactccaaataacgacaggccagtcaaccacatttataggaatgccactgtgtgcaagacactctgccagggcctgtggggatgtgggggcggaagactcagtacctgtccttaagtcctaaactgggctagcatgatgcagtaggagagagctgcatggaggtggggatgaggaactcgagttcaagttctactcagcacctcactggctgtacaccttgaagaggccacttaagccctttggaagtgctctctacgatgaatgtttggctatatagcctgaaagaggatggccaaagcctgatgacctggctctgagacccagcatcacaacttaccagaggtgcaacctctctgagcctgtgtcctcatctacaaaattagacaatagcttctttctcaggaaattgtgcagattcaatgaataatgcatcaaaagcactcagccctgtgcctggcacatggaagttctaaataaaacttgccagcagtattgttattgttaaatcaacgtgaggatcagactaggtcttcatgaaaacatgtggtaacttgagaaacagtcatcaaatgtaaggtattatttgatgccattatggcttcttttcccttatgatctgggtcttctgattttccctctgtggcccttccctccctaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctccttgcctgtggtcagccagtggtgctgtgagattctgctggatgggggcagctgatgaccctttgctcctcaggatcttgtgccctgttcttcatgcctacgtctcttgagttagagaaggagcatcactcagcctcttctctcaagtgaaccaaagcacgttggaaggtcccacttcctgctttaaaggtccctccctatttgattccctaaagaaacccgtgttcagtaccccacccactctttgcccatccacttcaccttgtcagtgtgacccagagccggtccgggttgcaccctgggaaaatgccacccggtgctgaggtgtgttcatctgcctggaagcccttccaagcatgcaggcacttcttgatgctccagtaattctgtgattagaatacctgtgcaaacaggagagaagacaggctccagctctgtcctaggcatccagggaatgcttctctgggaaatgagatggaaccttctgcctgtaccaatgcatggtcactagctctctataagtgcttccagcaatgactttctggagggcaaataacatctcctgtttttctttattattctaatatacgtggtacttttcctgtacatcttagcctaggcctttagaaacagccaggttgtatcagtacaaagagttcatgggcaagccacgagcagatctaagctcacggtcctcaaagtccactgggagtttggtgatctatctgttgtgtccttctccctatgtaaaaaaggctaggaaggggaaaaaagacagtgaattgaatattatagaaacattctctcttgagcttcttccttctctactttttagatctcttgtcctgatgggctggctgccctgtgagaaagcaacaaggcacttccagggggatttccaaagaaagctttttcactggccccagctatctggaaggtttattcaagttggatacacttcaaaggactcacagagcaggctcagaaatgtacccaaagtctagatgcttatccaaactgcctgaagccttcaaaccggctgtcaaatctctgcagagctggtatttctagcacatttctgaaaactcccttctctagttgggtcccaaataccaggagaccagcctattgatggcttttcagaacctttgccctatttttttttttcctgccaggagcaaaggtgtgctggtggccagaagaatgaaatcagactcctgagcatgcccgagtgtctcatgtgatgtttttagataaaggaggcgctgattcttttttcatccctccccagctattctcagttaaccctggttctaacataaaacattaaaaagcaaaggcatcatttttgtactgaagtagcagccaggttttggacagtggaagaggacagatgttaaagcactcccattggaaggccagcttcctctttcagcctagtctgccgagtactagctgatgataggccttctcatgaggagcatgttggcgctggcagaaagaaagagacgcaaggaccagctgtggaattgagcaggttggctttgaaggccagaggggaaaaactgctatgaggaaacatccaactcatcccctttaagggtcaccagggaattgatccttatagagtaaatgatgccttcttcacttttcttcctgagtcaaattcatgctactcttaagggattctacgacaggctaggtttaagctttcatgatttgaatgcatgtctccccggagtttgaaattgctgtattttcttggaccatgaagaaccagatggaaagctgaattttatagtctcttctgttactgtggtcagcaagaaatccatggatcttgctcatcagttcaggagctgggtaagctgaagagaaagcaaggaggggcatgtgtcgtccattcctcttaggcagcttttgcacgttccaaccccattatccttctgtcttcatttcttaacctactccaggctttccaggcagcacacagatcattcaga

SEQ ID NO: 12008 - DNA, 331814 bp, Human
  misc_feature (1)...(331814): n = A,T,C or G
ttatagaaaacatgacatcaattaagccaaaatatgtaaaactaatattcagaaggaaaaacagacttgtgaataatataattatattttaataatatgaatcattgtatattatacaatgcaaaaagcataggcaacttaaacaactggattaaaaaaatgggcaaaggaggctgggcatggtggctcatgcctgtaatcccagcactttgggaggccaaggtgggcagatcacgaggtcaggagttcaagaccatcctggccccatctctactaaaaatacaaaaattagctgggcatagtggcaagtgcctgtaatcccagctactcgagagactgaggcaggagaattgcttgaaccaggacctgggaagtggaggttgcagtgagccgagatcgcgccactgcactctagcctgggctacagagcaaaactctgtctccaaaataaataaataaataaaagggcaaagggcaaaggagttgaatagacatgtctccaaagaagatacacaaatgattggtaagcacctgaaaagatgttcaacatcactaatacttagggagatgcaaatcaaatgcacagtgagataccatctgacacccattaggatagtaattatatatatatatatttatttcttttatttatttatttatttttgagatggagtgttgctctgtcacccaggctggagttcagtggcacaatctcagctcactgcaacctccacctcccaggttcaagtgattctcctgcctcagccttccgagtagctgggactacaggtgcccgccaccgtgcctgactaatttttttatatttttagtagagaaggggtttctccatattggccaggatggtctcaatctctttacctcgtgatcgcccgcctcggccttccaaagtgctgggattacaggcatgagccaccacgctcggcctatatatatattttttaaaagacaaaatagcaagcattatctaggatatggagaaattggagcccttgtgcattgttagtaagaatgaaaatcgtgcagctgttatagaaaacagtagtctggtttctcagaaaattaaaaatagaattattgtattgtattgtattgttagcaattttacttctgattctatatacccaaaagaattgaaagcagggactcaaacagatatttgtatatccatgttcatagtagtagtattcacaatagccaaaagatgggagcaacccaaatgtccattgatggatgaacagacaaaatgtggtatatacatacaatgaaatattattcagctttaaaagaggaggaagttctgaaacaatgtacaaaatgatgaacctttaggacatatgttaagtgaaataaagtcatacagatacaaatactgaatgattccacttatatgaagtacctagattagtcaaaatcatagagaaagaaagtagaatgaaggctgcttggagttgggggagaggaaaatgggaaattattttttaatgagcacagagtttcagttttgcaaaatgaaaaaagttctgcagatggcggggatggttgcacagcaatataaatttatttaattccactgaactttgtatttaaaaatggttatgaacataaattttatattgtgtgtatttgaccacaatgtttaaaaataaaaaagtgtcagtttaagtgtagttgcttaaaaaaatttaaaagcagagaaaatttaactgataagaagctgtatcaacatcaataactaactagaaactaatctgaaaatcttttcagagcccttatcatacagattaaggtatatattgagatacaccattgcatatataatcatatttcctgttatatgatgatatatgatgtaacgttgattggttttgctttggtaacattttctggagatgttgaaaggagctgcatacaataaactttattcaaatttttttttttctgttgcagatccgtggccgttcacatggtttcaaggcacaatgagactcactggcccttggaaactttggctttggatgtcaatatttctgcttcctgcttccacttccgtgaccgttagggacaagacaggtatccaggccaactctttgcctaatcaccaaatgttatttatagcctttaagtcattaaaacaaatcttgttaagattgaaaaggccatagattaatgtactataacagaataaattacaattcattgctttcttccattgatcttcccatgatgcacaataggaattcctaaaattacctcatttttttcatacgcatagtatattagtctatgtttcctttcatcttcaatatttacaagtatacatacatgcatgtgtgcctctgtgtgtatatatgacattatgtatctttccctttcctcttcaataattattcaagttataagtatggaaactcattactaattaggattaacaaggacatatctaatcttaattaggaaaaagtgaaaaatcggataggaggtataaaaggaaatgtagtttaattatatgttcattttgtagtatctcagatgaggcaaacaaaaggttgacagatctttagagcaccttttgaactaaatagacaatatttgcaattattaaatgtatcagtcttttcataaatatttccaaaaggcttaagggcaatttgaaatatttaccttcatctctgcttttttaaattgattatgtggttaatttggaagacttttcttgaacattgagtgtgtataagttacttagctaaatgcaattcatattacaaggttgaattaggcacattggagaagccatttgctagggaaagagaaacttcatctctcctatgcaaacgatcacatataatgtattctgatgataatcacatatgattatgtactctgagactgtattattgtgcctattgttttgaatattttttcaataatttttgctaaacaagtataaacccactctagagagacttttgagtttgaggcacacataaaatataattactcataaagatctaacacatcgtagtctttcagagtgttatgtaagtctttatgattttttattatttggcagaaggtgcatttcctaaaataattcacatgaaagtttgaatattctgttattgtacaaaagacatcctgtggctgtcatacaatttgggggggaaactctttcttcagtgagaaattaatcagctgtgactcatggcaactacaactatgtaaaaaaggaaaagagatgttagagcagcggagtttattctgatacgatttctactcttctgaatttgtcttttttgtaaagaaatatagtaggtaatgtgctttgcaatttaatctgatatgacaggacttttttagttagaaggaagaatgaatctttggttgaatagggacagtttttaggcacatgctagtgggtagtaaatgttcttgatgatagcaaggatttgaaggacctaaataaatggttctccaattttaacatgaaaaagaatcacctgacgtatttgattcctgagacctcctatcgcatattcccattttgcaggtcgtactggggtgggatttggtaatttacatctttaacaagctccacagatgaatctaatgcaggattatctgaggaaaactcttagagaaacacttacctttgggataattaacagacattttggttttcttttttcttttcacctggttaccttgcattttatgcaccattttatgccaaggttacctttttttgttattttattttattgtttgcttttagtaactttttaaaattgtgataagaacacttaacatgaagtctgccctcttaacaaatttttaagtgtataacacagtactgttaattataaacacggtactatacagcagatgtctagaacgtaatcatcttgcataactaacacttccccatcttgggattcccctgaatgtttgcttttgtagctctagtatctcaactctttaatcaggttacatgatgtataggactaccaaaatgcatatattctgatccaatttacttcgctgaattaatcttttgaaagattttcccaacaatgtgaattcaaaattaatctgaaccctaacaagattcacttaacatgaagcattaagggaaattaataaaagaaaaaattacgtttgtttttatcatgctatttggtagagggtgttcgtaaagcaacacgtactgaatgtgtgatggaaattgcttaacttcaagtatcatttgcattaattgaaaatgtcagcacagcactatcaaagggattgttgaagaagatgacaagctgggcatggcctggaaggagacccttcttgtgtcttgtgtatctggttcacagcgcaaggttccctttttagtttcctcatgtgcagacctgcgcgtgtggtcactaaccatttaccggagggaagtgattacatctaaaaataaaatataacaaatctgagagagagtctagggtttcagggctggagtctgtgaagttgtcaacagtttactattaaacctaaatatatgacagatagattggaccttttaattgctgtaccttaactctatggtatgttaaatagttacctggaattgtcacagttgggacagaatttaagagtaatatggagagattcaataataacttgaattttaaaattttgaaggtattaggaattcagtcatttcatattctttcgtcaatttgcctattgagatcatgggataagatatatttgtttattttcccactgcaaatgaacttccatttgaatgtggcagtttcagctcagttacttgtcaaaagaaggtggggaagagaattgtgttaaaatatatacaatgctagaaaatctcaaaacttgctttaattagttgcttaaaactctttcctctaatatagactatgtatcaaataattaaagtttcatctactttctttaatctgttctaaggcaaaagtactatatcatcataaaaagcaataagaaacagaaaaccagagtttaaaaaaacaggctaaataaatagaaatgacagaatgctttttaaataacacattttcctttcattatgataaatcttcagtttaagtgtccagattgacttgattataaatttaaatttaggcctgtaactattcatataagcccttctaaggtagttttctattaattacaaggaattacaaggaaaaaaacctattattccaaaatgtggcttttactagttggcaaacacttcacgcttaaactcagagtaaaatgtatgctgttatatagagaattttattttgtgtttttaagaaattcttgtgttcaacattggtaccatgtaaaaatccttcattgacaaatgtactttgtaactcctaaattttgaaagtggaggaaagcttcacaatgattagataaataatgtagcttctaactaggtattttcctttggaagaattggacatttaagcagaggcatgaaggcagtgtgagggcaaggcacgtgaacacctggaaagcagtcacttggtccccaggctctgaggcggcggcatgcttggcatgtggaagaaatagcaagaaaaactgggggactggagccaagtgaatgagggggaggaggtgtgagggtacatgctcctgagaaatgcatctgtgctttctgtgttgtcaaaatctgatttctaagcctgcaaggtcaaaggctagaccttggacactggtaaattcaccaaagcaataaatcctgtcctatgagacctcttggaagatggtcaacctttgccatgtaggacccttcccggatatcaggtggacaggcaggcttctgaatgtatgcccctcattacctcttggtagccttatgtcacagttaattgaatattgtcatattgtattattcataatacattgttattaaagtacagatgtgtggagatatgtgcattttagcaaagttaaaatataagttataacttgaccagacaaattatgttttctttccctgcaatcagcaaactggtgtataagtaatacaagaaccctcactaaactgcaaagagtataacagaactcgtttacatttattttgcacgatgactgtaactttgattttcccatttgtttttgtattacccaaggaatgacctcatcccctggcttttcctaaggccagaagcctctgtgtccagagagcaactagtccattttcagtctgagtattagcagtatacacagatctttcaggtattaaatcagttgaaaaaacaaaacattaaaataacggattttagctgatctgagcttcttagccattcgagaggagaaaaaaggaattcaacatactttcagggaataataataaaaaaaaagtgtaaaagagggatttcaacatacctatgattaatactgtattaaactgaagatttatatgaatgggtatagaaagtatcagacctggccgggctcggtggctcacacctgtaatcccagcactttgggaggccgaggcaggcggattgcctgaggtcaggagttcaagaccagcctggccagcatggtgaaatcctgtgtctactaaaaatataaaaattagctgtgcgtggtggcaggcacctataatcccagctacttgggaggctgaggcaggagaatcacttgaacccaggaggcagaggttgcagtgagccaagacaagatcacgccattgcactccagcctgggcgacagagcaagactttgtctcaaaaaaaaaaaaaaaagtatcagaccaatgagaggaaaaatgtttaacaaaagatgtgatgttatcttaagattagaatgcctagcaatacaataggaggtcaaaccagtaggataaaacagagattaaggggaaaagtgattttctgtgtgtgtgtgtttaagcacatgtttaaaactgagggtgggagcataatgcacttctactaaagaatgaagataatttcttaggtatgctattattttgtttaaaatatgtatttaagaagcaatgttcaatacagagggggaaaagttggttataggacacttgtgttttctttccactctaccattgagtggctggctttgtgatcttaactcctcttggatgactatgttcttaggttctcaggattctaatttttggaaggagaaggggtaaacatcttttttaaagtatgtattttctttgtaggtaatctagataaaataatgatatacccaaatatgatctagctgccttcctttggctcttttctctttttttttttttccagactgagtctcgctctgttgcccaagctggagtgcagtggcgcgatcttggctcactgcaacctccacctctgcctcccaggttcaagcgattctcctgcctcagcctcccaagtggatgggactataggcatgtgccaccacacctggctaattttttgtattttcagtagagatggggtttcaccatgttggtcaggctggtctcgaactcctgacctcaaatgatccacccaccttggcctcccaaagtgctgggattataggcgtgagccaccgcgctgggcccctttggctcttttcagtaccccccaccacctctgtaagttgcccaggtccttcaagccaaatcaggaggaaagtggggctgatagttattaacatcttagtatgaatttgttaaaaacatttgcctttgcttttgaaaaagatctgttaaggttctctaagcagtgcttcttttaaaaaaattataaatatttaaaaaataaattttattgtgtatatttgaggtctatagcatattatgggatggatataattaaatgactactgtagtgaacagaataacacacctatcacctcacgtagttacttatttttgtaatgagtggctaaatcttatttaatgaaaatctcaaatgcaatacaattttattgtattttgttagtccttatgttgcacattccatctctagatacatttatcctacatatctgctattttgtaccctttgaagtgcatttctccatttcctccctacctcacaccagtgataaatattcttttattctctatctctgtgtatttaagctcttttaaaaaatattccacatgtgagatcacacaatattttttttcctgtgtctggcttattttacttagcatactgtccttaaggtctatctatgctgtggaaaatggaaggattttctttttttaaggctgaataatattccattggataaaatgtctaaatgtaatcacaaaaaccgtaaaactcccagaagcgatcatgggggaatagttccccaacattgaccttggcaatcatttttggatatcacatgaaaaatctcaggctacaaaagtggaagtaaataaatgggactaagtcaaactaaaacacttatacacagtgaaggaagcaatcaacaaaatgaaaagacaacctatgggctgggaaaaaataattgcaaactacttatctcatggttaatatacaaaatttataacgtatttttaaaactcaatatcagtaaaacaaataatctgatttaaaaatggacaaaggatcaaaatgcatatttctacaaaaaagagataaaaatgtccaacaggtatatgaaaaagtgatcaacattactaatcataaaggaaatgcaaattaaaccaccatgagacattaccttgtacctataaggatagctattatcaaaagacaagagataacacaaacgtggcaaggatatggagaaaagagaactctagcacactgttggtgggaatgtggattggtatagccattatggaaaacagtatggcggttctgaagaaattaaaaatagaaccaccatatgatccagcaacccctcttttgggtctacatccaaaaaagatgaaatccctaccttgtgaagatatatctgcacccccatattcattgcaacgttattcacaatagctaagacatggaaacaacctaaatgctcatggatggatgaatggaaaaagcagtgcgttttttttttgtgtgtggtgaaattttagtcattacttttgctatagtccagagagcctttgaaatgacacggtgctttgcctctgtctacttgacataatatttggatatttgagtcttttctgtagttcttcaaaatacatgcacatttactcaaaagtgctctttactttatattaaagtatgtattttaatacttaaagaaatgaacatatccaccttgtgatagctatttccactgccttgccatttttgtgtaatgaatccataatattcatgtattcagattattgtgccttaaatcttacacctaaataattaacatttagttttattttttttcagcttttcaccacaaagcacgtatgctaaagatatgaaatggcatttgatttttataaaggcttttagtgtagaaagactttcataaatgttgctagaaatgttgaattccattcatttcaaatgataggtttattactttgaaatcatcatatatttgctaagtcctcagaagaatttaaataagatatatactgtttccaacttggcaataagccaaccaaagtgtcataatggaaagcccctttctactatcttgagacttgttttgctaatcacctactggggcttccctacatacattgtgagtaatttaatcttatttattatggttacatagtcactcgtagtcattataaaaatataataagaatggagtttttttgagtttttcaagagtcatttttagcttaaattattttctcacagagatgctattttcctccttttgttgagatattacacacaccaaagttgacaaatcttagtgcacagtgcagtgaatttctatggatatatttatacccctgtgtaactactactcagacctaaatacacattctcaaaacccagaagccttctgtgtacctgctcctagttaacatttcaccaaggtagccactacactgacacagattagttgtataatctctagaatttcgtataaatggaattacacagtatgtattaatgttgcaggacttttccttagttcagctaaagatgagttccttgtcccatggccatgaaaattcaggctcacagacaacttgaatagtgagtaagacagggttttattgggtgaaaaggaaggaaagggggaaacaggaactctcactaggccagagtccctgctagagcacttcccaccaggctgattgaatcccaggttccacacaggaaagaggatgggccaggctcctcccgctaaaaagggtgtgaagttcccaaggctccatctcagtgggcagcctggttggaatttctccaaggaccccctctcacctggctgtctcattcctccctctaaagaagtacatctaattgctcttagattaaggataaggatgaagaccaatcttaacttcttcctgctgacagggtgtgctgttttggggaaatggcaggtggagctccctcagaggcctatctaaggtttcccagcagaaagggccattgtcagaggttccagttgcattaccgtttagagtttgatggcctgaaggcaagaacagacaaagccggttattagaaaacacgtatcaaaatgaaacaaggggagggataaggcagctcaaaaattccaaggccttttaccagtttgcacagggagacggaggccaaacacccaactagcaaaaaaaaactttactcttttgccagcatgttgggcttctgggtttccttccccagagtccaatcctaagccaactagtttaaggtttgggaaattaactctttctagtttgaaggatgcatttaaggggactgtcctctagtacaaagacacaattacctatcagtgaagagaggacagaggagaagaaaggaaaaaaaaaaagagagagcacctgtaatcccatcactttgggaggctgagatgggcagattgcctgagggtcaggagttggagaccagtctggccaacatggtgaaacccatgtatactaaaattacaaaaaaattagccgggcgtggtggcttgtgcctgtaatcccagctactcaggaggctgagtcaggggaattgcttgagttgcagtaagctgagatagcgccactgcactccatcctggtcgacagagtgagactctagctcaaaaaaaaaaaaaaaaaagcagtgttcccattttttcttgtttattcacacttctgtattatttttgttttattcttgtccagtgttactttacctttttttgttaactggtgttctttttcccaacctgatatacttgatattcctttgtcagatgtattggcaaagtaggatgtgtacaggggggctgaggggaactagtaacaaggaaacaaagagcctttatttttttaagaagccttttttaaaaaatgcaaaatgcctaaaggctcttgttttgattcgtttatgaaaggaaaacaaaccagttctgtatctatggtatattgttgctctttatcttccccaactctaaccttgaggaaagaactgccatgagctttgtcactatttgtaaagaaaattatttttcttaacgtatgttggagaagactgctaaatagaacttgtatcagactagacagattttaatcgtgactttacatgcaataatgataataatttcatgtatgataattctgaagatatgaagaaataggaaaaccaaagcaggaaaaatggacaagtgatatgttacaatttctcaggagacaccacttgctcccgttctctttttatctcactcactatgtgatctcatctctcctgtggttttgagaggtgaagccaactggacttcctgggtcaagtggggacttggagaacttttctgtctagctaaaggatgataaatgcaccaatcagcactctgtaaaaatgcactaatctgcgctctatgtctagctaaaggattgtaaacgcaccaatcagcactctgtaaaaatgtaccaatcagcgctgtgtctagctaaaggactgtaaatgcaccaatcagcgctctgtgtctagctaaaggattgtaaatacaccaatcagctatctgtaaaaacgcaccaatcagcgctctgtgtctaaaggattgtaaacacaccaatcagcactctgtaaaatggaccaatcagcactctgtaaaatggaccaatcagcaggatgtgggtggggaaaaataagggaataaaagctggccaccccagccagcagtggcaacctggtggggtccccttccacactgtggaagctttgttcttttactcttcacagtaaatctcgctgctgctcactctttgggtccacaccacctttaagagctgtaacacttgccgcgaaggtccacggcttcattcttgaagtcaacgagaccacaaacccaccagaaggaagaaaccctggacacatcggaaggaacaaactccagacacaccatctttaagagctgtaacactcactgtgaaggtctgcagcttcattcttgaagtcagcgagaccaagaacccactggaaggaaccaactccggacacagttttacataggatttatatgtcagtcactcccaaatgtacttcacagccctcacctctcttttgaattccattcctaactgtctatttgataactccattgtttcaatttcttaatggcatgtcagatttaacacttctaatttctcctctttcccactacagattaacttacgccttgccaagttttcttttatttttctagtgggatttatttcagtcaactaatctccctcctccctacattcaatcccttatcatctcctgttggttcttgtatctctcaattccttcccatgaaattgaagatgttttccattttcagtgtcatctctagtccaagctaccatcatatctggcatcacagagtatggcagtatgactaagtttaccaggtaaaatacagatgcccagttaaatttgaagtttaaacaataaataattttttagtataagtatgttccaaatattgcgtgggacatacttgtactaaaaatatttttatttatctgacattcacatttaactgggaatcctgtattttattagctatgtttggtaattttatatatgtgagggagaagaggttatttattacacagagtggtcagggaaggctgccctccaacctcactgggcaggctggttggagtttctccaaggaccccctcccacctggctgactcattcctccctctaaaaaagtacatctaattgccattacattaaggataaggatgaagactgatctcaacttcttcctgctgacaggggttgctgttttggggaaacggaagtcggagctccttcagaggcctatctaagggttcctagcagaaggggccattgtcagaggctccagttgcatgaccatttggagtttgatggcctgaaggcaagaacagacaaacccatttgttagaaaacacatatcaacatgaaacaaggggagggataaggacagctcaaaaattccaaggccttttaccagtttgcacagggagagggaggccaaacacccagctagcaaaaaaaaaaaaaaaaactttacccttttgctagtatgttgggcttctgggttccttttccctgagcccaatcctaaaccaactagttttaaggtttgggaaattaactctttctagtttgaaggatgcatctgaggggaccttcccatagtacagagacacaattacctatcagtgaagagaggacagatgagaagaaaggaaaataagagggcaccttttaaaggagtcccagggattcaggatgcatttgaaaggggtacagactaaagatgaatggctacccatctagaatgaggggagcaggcatgcctggttttcttctcttcctagcagatacgtggggtacatgagggagagagggaagaatgtcctctttccctcttccatccttgcatccccaagtcacagcgaccttggcagctgccgccatgagtgccaaagtgactttcacccataaaacaggaaggacctagagaataggaattatccactctcacctatgcctctatcctccaaactgtcagtagctttggagttccctacacctcatttatgccatggatattaatgtggccttcatccatgaaacaggaagctaggggttggcttaatcagcaggaatcagccacacatgctcacctgcactgtaccttttaacttccattattgtctgcctctggatccctaagatccatttttctatcctagggctttgaccagaagcttagaattgagtctgggatgaaaatttgtcttgagggagttgcatggactccttatcataagctgaatgctaagttaaaactgtggaactgagtcctcctccaacaagggaggggaaaggatgtcttgtgagacacccagataactggtagctatagttatgcttgctaagatttgggtgcatggtacttggctttggttagctttcttggtcttactttcccaaaaaggaaacctccgagtggtgggtatcctatttatcccaactgcctggcaggatttgcaggataattgctcagaactagaatattgatccagatttctacattacccatcccttttgttctttctgagctgcagctggagactgctggttggttcacaggaacaagcagggttagcctaaaatgtaagcgaaaacttaaaaacaactagtgagtttagaatttaatgacaaatatatgatacgttttgaaacatgatttctctctctccagtcctcatttttattaaaaaacaaatcatcataggactgagtggtttgcaaaatagactttacttttatacttggcctgattatttgcaaaaatacagcaagtataattatttttacataggttttttggattggctttgatggaactctgttccccaaggaatctcagataagatcttttaaagctgagcccagccatgggtttatcctcaaatacctgtaagttgagtgatcctctcctcttaaggtcccataataaacttggagctcctagatctgttagaaagtgacattctttactgaccacaggtcaggaaccctgtacaggaactgtgtagacaagggtatgaggcaactgggcttctatcatccctgcaagttgagattgactccttaaagggaagcatacccttccagtctaagccttggtaaaacaaccactttctccaattgtgtcctgccacaaaagaaaaatggattcttattccactgatgcaaacggctatattaccataagttgaggatactcactgagagtttccaaattctataggaaccaggaagagagaaacaaacgtgctacaaattttgttcataggagtataccttactcaattattaaaggccgtaaaaggttcaaaataaatttcttcgactatgaaaacccaaacaaggatcagcaatattccaaccaaaagtcaaataagttgcttcagctttctgagttcagtccatttagttaactcttgttttgcttgatattcgtgaatgtttcagcttttcatgagtcctgtactattttcctttattccaaaggttacaatttctaaagctatcataaacctatatttcagagcacctgttacagttctatagcttattagaaaccatcttttgaaaaggattaaaataggacaacaattgtctgtgaatagcaaaatgtccagggtaattacagttagaaacacaattgacaaaaaagtttggttatctccctaatggtttacagtaacttaaaatagcaactaaggactaagctctgatttttatcttgcccagattcctttctaaggagtctggggagtcatgccctacaaaccataaattctcatcagatgggttttatttaaccctgtatattgtgacttactttccaatctgactgtggcataacaaggaagaaaattacaatgttttaccccaaagtatatttccttgccataccttgaaattgccctgcaaaatctcttgtgggaaaagtccacattctatagaaaattctttctcctttgttttctttcctttgtttccagatccaagagataatcaactaacagccaggtacccttttaggtctgataaacattttacaactctgcaatctgagagattcctctgcacaataaaacttggtctccacaatcctttatcttagcctgaacattcttttccattgatcccaggtcttcagataaactcaaccaattgtcaaccagaaaatgtttaaatttacctatagtctggaagcaccacccccgccccccactttaagttgtcccacctttctgaaccaaaccaatgtatttcttaaatgtatttgattgatgtctcatgcctctctaaaaatatataaaaccaagctgtacccctaccaccttgggcacatgttctcaagacctcctgagggctgtgtcacaggccacggtcactcatatttggctgagaataaatctctgaaaatattttatggaatttgactcttttcatcgacagtagtttcaattatgtgttataatagtaattcctagcatctttaactttaagataaaacttggtaagttgctttgtgtgctaactgcagccaaggtttgctttcttcattaagggcctggttattccatatgtccccaggccttaatagttgtgaagccagcaagtcaaatagttctcaaaacccaaaaagcagtttgtaaccttaaaacacttagcaaaccttgcatctgatctgcagtttaccaataatctctaaggcttttttaatttctcaaagattaaagtcatgtgaactaaaaggtactacagattttatattccctttaaaaaatatttgatctaagcacttgtctttctttaggccaaattaattagagctcttttgacaggcattaaacacagtacatagacatgcagaagaaaacccagtcgctgggtggggccctttaaaggacaggcctgggaaaacatgcagatatcaaaccagaaagaaacttattccctaaggcaggattgctaaacaaagccttgccaagcagttacaggccatgcccccaggatgtaaaacaagatgaggcttgcagcacaaaccacacagacatgcaaagcacaccagattggccacagcccaagactagccccacaaatcctgtttcacaattaagctttacagaaaaaataaacagtgatggttgggggatctggcctagcaaagggggaaaatatctttaaggcttaactgctgatggagtggagaggaggaaagaaaaaacattttttaatgcttgaggaagaacctcttattcttatacaactgattcctccaccagggagaaaagattaagcttaattactgtccaaaagagttaaacccgttagccagggaagaggaaggctgtggcagcagtctgtggctgggaaccagtcagctggctgtgggggacttttgagccatgcgtcctagcactgcgtagggtgtggggatcggcatggagctgctgctcaccagtctgtcctgaaaaaggaaaaaaaaggccatgaaaagtctcccgaccccaaggagcgacagagggtggtggggtggtttcccataagctcagaagtccaaggacgaaaaggcttagaaagccacagtgagaggttttgtgttctcatttcactcaccacttcttgagctcccacattgaacaccaaaaatgtcgcaggacttttccttagtgcagctaaagatggtgttctttgtcccatggccatgaaaattcaggcttgcagacaatttgaatggtgagtaagacagggttttattgggtgaaaaggaaggaaaggcagaaacagggactctgtctaggccagagtccctgctagagcacttcccgccagactgttcaaatctcatgttccacacaggaagaggaagggccagggtcctccccactgcaaagagtgtgagcttcccaaggctccacctcagtgggcgggctggttggagtttctccagggaccccctcccacttggctgtctcgttaatattttttgggtgaatgacatttttctatttaatattatatctgtgagatttatctagttgttgcatgtatcaatagttcattcttttttatggctatacagtttttcattgtatatgccacaatttaattatcttgctccttcttgttgataaacattttggttgtttctggttttagactattatgtgtaacgctgccattaatattcttgtctaaaagggccatctacacttattttttggtactcctttctcctggttcattgaattttcaagtcatacagttcatatatatttagctttagtaaatactgccaaacagttttctaaagtgtactaatttccattctcataagcaatgtagaagaggttttgttgctccacatcctcatcaacgcttgactgccatgaatattcttgcctaaaagggccattacacccattttggggcactcctttctcttgcttcattgaattttcaagtcatacagttcatatatatttagctttagtaaatactgccaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggtgcctgtagtcccagctactctggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaaatactgccaaacagttttctgaagtgtactaatttccactcctacaagcaatgtagaatagtttttgttgctccatatcctcatcaacacttggcatcttcagtgctttaattttagccatttagtgatatctcactgtggtttcactttgcatttccttgataactaatgatgttgagcaccttctcatatgtgggttgaacatttggatattctcttttttgaagtgtttaaatctttttgcacatttttagaataagattttcaagctttttttgttattgatttctgagagttcattgtatattctagaaatgatactttattgcatatttggactggaggtaacttctcctaatttatggcttgactttttactcttttagtgttgccttttgagtaaagatgttaattttaatgaagttcaacttagcaatctcttcttttgtgattaatggtttctgtgttcttttcaagacatctttgctatcccaagttcatgaagactttgttgtcttgtggatgctttactgttttacctttcatatttatttctatgattatctttagttagtttttgtgcatggtgtgaaataaggttcaacattcagtgtttttctgtatggatattctgttgacccagcaccgtttagtaaaatgaccatccatttcccactgaatcaagtggcctttctgtggtaaataaggagaccatacgttttgggttatgtttgtgtttttccatatgtgtaccaaccccacagtataaaaaaatttatatctgatagtttaaagttctctagcttattcttctttaattttgccttttactattttagcttgttttctgtagtttcatgtaaatttgagaatcagcttgtcagttttacacacacacacacacacacacacacacaccccatactgttgggattttaattggcattgctctgaatctagagataaaaccaagaactaacatcttaacaattttaagtcttgcattctaagcattttgtttatcccttcagttatttaggtctttaatttctctcaggcatgttttatagattttagtgttcagatcttgaatgaggtgcttgggttttataaaagtgactattaatccgaatcattaattggtaatgtttacaaaatctctaataattttactattatttagagcctgcaattgtattaagagttctgagatagcaattttccatattagctaagtaatatctaaaagtactcagtgctataatttcacttactttacaaattgtgttcaaaatgttttttgcagtatatttgcttcttatttttaaatttgattaagtggtagcattatttagaatctgatttattttctggttaaatatattaagatgataccctctcaccatgcctgaggtctgtgatatatttgttaaatgaagggggaactggtgaatcggcaatttcaatttggttttaagtagtttatctcctctctatattaaaaacttcttagttattaaacccaaacatcaattttagacatagagaattaaagttgtgattgcatgatgccaaaatatttaatcaatttagtttaaaatgttaaactaatggtcttaactgtccagttgtacagttatcttggcacaattcaaaaattggctgtaattttgtctgaattaactgaattagcctgattcaatttaaacatgtcctaagacgttgaaaaattggtgtgtgcatatccattactgtattagtgtgtagtggtagtattaaacatgtacattcactgagttgagactatcttttatttctttgaatatcactaagtgctgtagcacataagtacactttctcaatgattttatttctttttttaaaattataggccacttttgtatggtagagatctttgctttttaaattttattttagtaacttccatatatgttgcctttagtttttaaagtttcatatcagccaacaccaaaacttgaattaaagttgtgataaaatatagtagtagttcacttgttttactattgtactttgaatacgaaagtttaacgatgttaaaactagcttatttccaaatgtcaaggatacataaagtgttcaaataatagttataataataatggctaacactaacaagtattcactgtgaaccaagcagtgttcttagcactctacataagtaaccacatgtaaccctcacaaaaacactgaggtggttaatgttcttatcctcattttacagaaatttaataaatggtttaatttatttccattttatcttaagtttctgattgtactgtgtaattaaaattcatacataatgcaaatcctctatgctttttttctttttaaatagaagagtcatgccctatcctgagaatagagggacatcagctgacatatgacaacataaacaaacttgaagtttcaggtaggcaatataatcctttgcaaagtaatattttatgtaaaattatcaccaaatgctagatatggaatacattataggtgaatctttgatactgcaatttaagatcatagcattaacgtgaaaattttaagaattctttttaatttttttttttttttttgagacagggtctcactctgtcactcaggctggagtgcagtggtgtgatctcagcttgctgcaacctccacctcctgggtacgagcaattctcctgcctcagcctcccaagtagctgggactacaggcacatggctattttttgtatttttggtagagatggggttttaccatgttagccaggctggtctcgagctcctggcctcaagtgatccatctgccttggcctcccacagtgctgggattgcaggcgtgagccaccatgcccgacccataaaaatttaaggtagatgatgtagaaaaaattccgaaagcagggttctatatgtttaatctgtgatcaacaatacctcaacctcttggagaaaaaaaaacttatttaaaattataaaagtgtccattgtagaaattttggaagaagaaaaaaaaatttgtgagaaggaagatgtcaccacccagataaagacaagattaccattttggtaatccttgttatctttccttttggtaatctttcttatctttctttctccttcttttcctcctccttctcttctctctctcccacataaatgctaatgagtgtgtgacacacacacagttataattcttatattacatttcatgtgtatgcatttcctgtcatcaatacacatttctttaaagcataattttgtaaaaggctgcttagatttaaactgaatggctgtactatttttaatctaattttctaactttagacatgagagctgctgcaatgagttactctaatttttacttaagataattcctaggtcaaaggaaattaaaattgagtttttttgaaatatattcatgatttttttctagaaaaatggctacacgttctatatgcaaagtgaatttcattctcttttaccctaaaaggagaaaaataaaatcaagaaattttgctgatcccaagcagcaagatttcgtttgaagtgaatcaattaatagataagggcaacacaaaattctgtttagaaattaacatttctattagtttattaaattgaatcatctgttacattttacaggttttgatctaggagacagcttttctctaagacgtgcattttgtgaaagtgataaaacctgtttcaaattgggaagtgcacttcttattagagacactatgtaagtaaaaaattattttctttatgtttaataatacttcataaattattttctaaagagatttcaaataatttgttttaaaaataaagtttctcaatagcatcatcctcactggaatgcagtggtaaacgtgttgttaatgtatttgttgtttataaaaatcattgcaatctaatcttggctctacagtgtaaatatcatttatatgtacagaaaaaggcacgatcattagagaacagtaattaaatccatttctgaagaaatattgtttatgtttaaagtagacataaccaatattaggtttttcaaggtaaacattaaaacataaggcactatatagattcagagccaaaagactgatatttattgtataaatttttagattttctatgcttcttaagttaaaataaaagaatttagctcttaggtgttcatcttatctattgtatagagtacatagtaaataaaaagctgttttgtgcttttatttttggtcttgatactcatttaattttaaaatagatttaccaaagttttcccttactttttctttcttttttctacagatacacttagagttacaaaaaaaaaatcactttccattcaaatagtgacaattggtcagcaaccatacagggcaacaatgatttaccatatagttggcaataattaaaggatgacttcatagtaattcagaaagctgagttatcaggcaggcaggtagcacatatggtcaggataattattcctggagtccaagatgaatattcgcatgtatgaatataccgcaataaaaaccctcaaaattctacttagcttcatatgcaacacaaatgtttttgtgtgaaaatatgtatgtatgttttcccttcctgggcagtagcctaatatttaagacagacaagattgtggagaatctcaaaatttgaattcttaaagggaaatagcattaatcatctcattgcccttgctcagacgttctgtgtaaatgaggttcataacctacactttttccctgagaaaagtttcttttaaacctattttgtgatacttttggtaattttcatttaatgactgaaatggctccttaaaagtaaactgctcaatacttggtaagaaacaagaatattaaggaaggaatttcaaatcaggggatataatgggtggttgttaggtgggacacttcagcagatgtaactgtatggacccacgctacagctgccgctgtttgggtggtctcataagtaggcattaaattctcagggtacagcagttccatgcttaggtatgcataagccataaagaaaagatgagaggcgcaatatttctcacatgtatatatttagatgtttcttaactaggagtagataactttaattaataaatttaagaaaggcaatacattctgtttaaaaattaagatgcattttctctccccatcttctttcggatttaaacccctgtaatgctggccagatggcaaaaggattttggcaaaaggagtgaaaccttttaaaattcattggattacatgtgagaagacttagctaattttacgtagctacactggaaaacttgctgcgacatttagacaatgctatttctttttaaatttatgtgattataaatattaggcaagacttggaatttgttttctgaattttgggttctaaatcactgcccaatccatgggtaatcaatgtaagtgaattctctggttctgtggagcagaacctggtacctccactataggaaaccgggggtatctggttgagctgcccagtgagtatcaagtagcttggctcatttccacttacatttcacttgttgagccaagtatgctaggatgcttctcttgcatgatgccattttgatttttcaatgagactggagtaaagttgtagctatttatatatttgtaaataagctgctttgcagagtcagcatgggaaaaggcagattctattttatatggaaaatggggatgctttctgtgcctgagcttccttttattgttctggcatatcccaggtgaggttcgtgagaggagagacctaatgagtatgttggtctgatacctgttaggcatattcaatgccttgagccttgcttaatgtaaaactcccaaagaccgcttttgcaggggccttccagatagacatctgtcaggtccacaacccaggtactaacaagggtaaatcgtgagtctcaggcaaaatacaagtcaccttttatctctggataacaacgcagtaaccaagagcttctgccctgggcaatagtatcacaccttatcagttgcccatggttcttttgggtcctgtacctgtgctaaagttatagggaagcttatgagaggccacacagacagcatatatgttccctggaggagggtcccttccctggccattcccctaccaacggttaattgtggaggccacactttaaatttccaaggagtaacttggaaattatactgcactctcacgccagggggccacaatagccaaccatctacggtgaggggcttggagggtccatggccaacaccaggtttttttgttattgttcccctacttttaggggtgttggggcaggcaataacagattactgttcatccccgtacctggctggagaaggtcatccttcctgtcatagatctggccacatggcctggccctacatgggtcagtgactaactagctaattctataactttcaggtaatgaaccacaaggtttagccttgataaactgcccagcatcggttcagattaccacaggtgtcacctctttggtgatcactatctacactgccttgagttcaacttattaactactttatctacacctggttttaaaccatatgttgtcagtgttaggctggactgcggcagcaatcaaggcagcagcagtcctctggctagacctatctgtataccatgccccatcaggagtggtgggggtgcctcaggctccatggccttatcttgcattaggcctataggcttcaagacctcttgtaaatctgtgctaagggacttgtactcagcatacttcactgctgcaagtaggggccccacttcgctaaagtggatgtctgcaccttccctatccagggggttgttacccatgaatgtacctaccacactgttgggtacactctgcatgatgactatatcccaatctgccatgcttttatgagcctgaagggcagcatacgcacttactaactgcttcccagtccggggggttgttatccataaatgcacccatcctgctattactaactgcttttctatcaaggaataccagagctcagctcccttccatagctgggaccaaaagcctactgatattctcaggtgctccgtgcactgccataggccctaactgaaactatctgtggtcacatgcacatctagcttaaatgggcacctcttgtcaactacctgtagggcttatgcctgctaattagcctgcttggctaccaggaagactgtctcagcagcatcataccaatcctaggcaaggggagcattgccgcttctaaatctgcaagagaatcagaggttaacataacatcattaataagatcatgacacatggtggggctatgtatatagccccgcagcaacactgtgaaagtccattgtcaacctcccatcaaggcaaactgatggccttctgcctccttgagggctgccatagcagtagtcacttcatgtaggcagtgccccacatatggggtgagaacagcagctagagagccaaaatcactcgggggcactgagcccagcacaagatccctcatgtgggagggaaagcgttcatcatctggcccccaggtattcagatcaaatggtctgctctatacccatcttccagagtatttgcacaaaatgagtatatgatcgccatttactcacagtttctagtatctctccagcatcattccaaacagtccatattgctgccattagccactcgattaatgtgtgttcaccatgcccttgtgccaaccatcggcacagatacagccactgacgaagggaggggtgagttgtgataaaagccagcttttccatctcagaggtggagcaagaaatgctgccagcctccttgtcccaaagacagagtggccaggcagggaggggcactgggtgctgctgacactgttacctaactctcacaactcagtgggtgtataagcactataagaggtgtgttccactactgtggggggttccagggctctccactgggttcccatcagatggtcatgttgtaccttttgacagatcatagggtgagcctgcagtggtggagccccctcctcctcaggatcagaccaaatgggactgtccagcctggaggacaggctcaaggtcacacttacagctgttgctaactcttgttccaggctgtttatctgggcctccaagtgccctgcttgcacctgaaggtccctcacccccggttctgctacaagctgtgcacttgggtccctaggcacacggcttgtgctgggatgtcccttacctgtggcactgagcatgtatttcacacagtgcagtcagaaatgcccatccaactctgctggtggaggtgcgttccttctcggtgctgcgtgcttccagctgcctcggtgctttctccacactcacaggagacctatccactgcctcccacatttccattggggcccatccaagcagcaccactgacaccaggtaccacagcccatgctgcagccacagagccaacccgggagccttcaggggccaaagacccactcaccttatcctgccaactatgccaattgtcaggtccatgactacgccagatgttatgctggggtcaggttccagctcatgctgagatctgaagggagtgggtgggtgagcagagagctaaaagaacacttggagggctgtaggcaggtgaaaggtagttttattcagcagctctctcaacagcagcttacacacactaggtctctcaaactgttcgctctgtcttggctgcttcatccggtggctcccacacacagctacatggacagctctcccttcagggtcagcagcttaactgtttctctctctgggcatgagtgagctgagccgtgtcctggctccccgctgttcatctgcaaagatggacagctttgactctctgtttctctgggcgcaagtgcacttgtacagtgtcagcagggcaattatacctttcacagacaatagtggcgtagggccaagggatggccttcccatgttatggctacatggttttgataacaagaggagttatacgcctgtgctctaaactcactgagtcactctggatgtttacctcggcctatccttgaccaaagcacagccgtgttccttacaacatcattgtacacttagaggtggcacaggctcaggggatatttgaggggctttatgtgttttgttggctttaaattcatgtccattcttcagtatttatgggatagcaaatggtaagtatttgggggctttagaagattctgggtggcatgctacctagttctctagaattatttgtttagaggaaattttcttggcttcttatatctccaagtatccctagttatttaaaagagataattcattatttgtatacatattgagagctatagcaaagaagattatattttgattattttaaaattgtgttttggcagttatcaggggaaattggtaaaatactgagtaaaaacagataaaaacacacacaaacacacatactatagagtaccttattttcttggcataatgtagtctctatctagcttccattagttgcttcaatagaaaattcaaataaaatgtcttagtattgaatattttagatgaatgttgaatttctacatgctgttggttctgaaggagcaacacactcagcttgactggccgatgaagaaattgatttcaaatgtaccaaggaagtgagttttctgattcattgtttaattcaagtatggtaaagagccttatcccttaggctcttgatagctactggctgtctggaatgctatgttgagaaggattctggagccatagtgggtttaaagtgctgtgacccattaaaaaaaagagggagggaggagtgagcatatgtgttccatatctatagcctctctgaattaggatgatttctgtaagctggtggcttttgcaattgaagcagtgtctaagaatgaggggaaatgaggctacgtgtgaaaaaataacacagattaaatttaatacgatttatgagcttgaataatatagctagacacagtgacataaatgacatatatgatccccttagtatttgttacaaataaataaatctctagtgaaagggagtcttctttatctgtgtctctgtatctctctcattcaattggtgtctactttatgaaagtaaagataatttagtttcatagctttatgtgaaaataagaggtagctggtaggagctattctaaattatgtttatggatttacaaacataataatctttagcaagtaggaaacccaaactacaaatttggaagatgtgtaatgtttttcagaaatatttgaactctggactttaacagttcccttgaaaataatccaaaatatggacaaaactgtcatatgtgttgtaacatgatgtttaccttgtcttttctattgttgaatgatttatcccatgggactaccttttctacacggacctttacactatcttcagattattattattattatttttttttttttttttttttgagacggagtctccaaaaaaacagagtctccagctctgttgcccaggctggagtgcagtggcaccatctcggctcactgcaacctccacctcccggtttcaaacgattctcctgcctcagcctcctgagtagctgggattacaggtgcgtgccaccactcctggctaatttttgtatttttagtagagacagggtttcaccatgtcagccaggctggtctcaaactcctgacctcaggtgatccacccgcctcggccccccaaagtgctgggattacaggcatgagccactgcgcccggctgatttttatcattataaataacactacaacatacaagaaagttgtttttttctgtatttaggattattttcatacaattgacttttagaaataaaattacttgttcatatttagggatcttgatatatactactaattatgttcaatcattgttttctccatgtattctgcatattttccaatatcttctgtagcactaggaattatcatgttaagattttgtgttttatttaacttaaaacttgtgcagttacaaatagaagctgtagtttactgtataattttcacagaagttcctaaaatgtttctgttttgctaaagggtgaataagaggtagcattcggtaagtcactgaaatgaatgcagtctagtctagagcttatccttttactcagcaagcatttgttgagtgtcaccatgggccaggcactttgctaggttctgagcttacattgataaaagaatgtggatctagtctttccttcctggaacctgctagaaagatacacagtgcaaggaaaagctacacttcccccttgctttgccttcatagaaggcaactgagatgtattgccttctattgttcaagcttagactgcatgactcaaatttcaccccttataaaggctaaacttccttaagcatcatgcacaaggctaattttcaatgttttcattccttgcctcttaagggactattttgagggactattttgtaatgcatagttctcctttgagtcctctccaagttctcaaaacaaattcagaggctgaaaacttgttcagaactctgatatcgaagtgtctccttgctgagtgttttagaaggattactttacaattccattaagctctagagaatgcctatttatgcatcccttgggttttcatttggggcattccttcattgtgtagataggaattttcctatataaggataggtgacttagttacaaagttgtccagctgtttttatgagattgtatgactgttatacatgattatgtcatcactgtatttccttcattgcagtttggcataccaagaatctgaggttagtcattaagtcatactttttttaaatggaaagaacatatacaaatatttactactcaatagtcaaaagcacctattttattttttctagaaaattcagaattgttaataggcagcaataaatttcttagtatagaaatagctattaagatgtaatgtaatatgaaatattattagttcagtattgttatttactgattttggaaacatttgatgttatcattatcaaatttaagtaagttgtgattttgctctttcagatttcatataactcagtattgggaaaagtagaacatatcagtaattaatcatatgtgtataaattctacaacattcatatgacttaaagttttttcttggacttgaccattcatttattagccagagagaaataagtttgtttaaaaggtacagaaatgttttaagtttaatgtctatttgtggacattagtagataaaatcttataaaattaaaatatttttgtgtttcacatgagttaaaatggaaaaaccataaatctatttatacatttaagaaactaaagttcctatagtaagaaacaataatgtcactattattgccttcaaagaatgtattcttaacaattaaattacccaaaaaagcctcacataaaatggaatgaaagtgagaagctgcaattcatttacaaacttatccattttctagcctcaaatgtacataaactttctaaggaaaagagggtaggttctcatttctgaggaaaaaaggagtagtttttcacttgtcttgttgaaacacaggacagaacattagtaaagagtttgcagaaagaggtataagatacggttcttgcctctagggagtgtgtgatatctctcctcttaggggcaagaaatgaagacagacttaattataattataattataagcatacagttaatgctttaaatgttcaacggaacaaatataaagacaaaatctcttatatttgggatgataaaaaaatatcttgaagactatgggatttaaactaggctttgaaaactgaagagactactgagagtcagagatgaatcaagttctggggagaagaaagacatctaaggtgagggaaggccctaggaggttaagacatggaaaaatacaataaatataattacatgagataatttctatatgagtaaaacattgacaacccaatttatccatatccaaggtggcaggcagtttgattttctctgatgctcacaaacattacataagcccctggcaaaaattttgaagaactgatatacgattttccccaccacatccagatggcttaagttctaatgaaagtctacggtcattcaaaataggtaataggcctctcatatggtatcatataatcggaaaggtattatttttctttagactccattgctcacatcagaactcccattctttggccaggcaggaaattgttcagatatataagccttacagggtagagattacatccaactgattcatgtttgtgtccctcgtggtacctgacacacagtggtgtttagtgctagttgaattggtatgatcttaagtttaaattgaagggatatttgaaatttattggtacagctacttgcatattttaggcaaccaataatttcttttcaccagcacctcaaaaaataaggcaccttacttctaattcttgtactagatcttttcaccaaagaagacttaagaacaaggcacatgtgactacccagtttccaacaatgataatgattcttataataccaccttacatttatgaatgttatatgatttacaaagtaattttgccttcttgtatcaatggtaccacaatgacttctgtgatgtagtactttatcaccattttatagatgaaaaatgaggttgaatgacattaaggaattcacctaaaatttcaaaaataataaacagttgtgtctagaactcagttcttctgtctccaaatccagaattaatttctactttattatgactaattacatgtaaattatcttgttatgtctatatgccatttactttgatagtagtgaggtactagctaaatgtactacttaggagtcataataaagcaaatgttctcataaagtaatgaaactaaagtgttctattttgataattacttgggccagtctaataggcattgattaatctacctctattgttggattatatattagatttttttctttttccagtcattcttttatcctatgaatcaatcttgtaagggacagcagagcttttcgcctggtagggttgtgtgaatgtatctgtgcagtgtacactgcagattttcagagtgtacaaaagaaaggcatgtaagcatgtacttcagtcttatctttaatcttaatttggctcataaaaatgctatttgaggactaattagttattatccttaggtggttgcaaatgcgttgatttataatggttgtaaacctacaaataagcatggtcttaaatttatgaattagagaattgacctttaatagtgcttgatgctttgttatactagtgcttcagcatagctttataacaactctaaagatttttctgtaggctgattggactctgtgtatcacaaaatagcatcaaatagtctaatcctccttctcagacacagtcagactgtaggatataattataatttcaataataaactttgaaatctatgtcaaccaaggaagaataattgtgccaactgataaatcattactttattgtcatttcaattctttcaacttagccacaaatgctaattagaaaataaacatggtagcagaaaaactatgcttatgttattttatgtgattcctgtaagtttcctacatcttgttcattatctcatttaggtcagcacttatgtttcctaagacacttttttttcccccaaattaggtgacattttaataattttagactaaagtaataaaatattcaaataattgacttgattaattcctttcaccctggctatatctaagtaatttggaaacatcataagttcagtgaaaatgttaatatgaacacatgtggtgatgccatgcagaattaacatctggctggttgaatttgagactgagttgaccagatgttttgtgttcaagttatttttcttatttgaacaatctcaacttcttctctctacttcataatttcttaatttcagctgttctccctggaggcaaccccccttctttcaaaggttaaccccttcacttgtgctcttaatcctctcctagccagcctcctctaagaccttgatccacccatgatccccctgctcttgggtcttcagtgctcctctccacagtatcctggcctcttactctacaaatatatacttaatccttccctattacagaaacattttccctgggcagtcccctttactcacagacttcttaaaggaacaatgttactgtccacttttacttcttcacacatcccttagcccattaaaatctgactaggacttcttgaacactatggaaatttctgcctcatagttgccggtgacagctgtcctaattccaatgccagcgttgacctaggtgttgcactaaacttcctttgttaacccatttctgtctctctctgtcataccatgcccaccttttctgcccattggaatcctacatatcctagaaagcttagtacacatgctacattctacactaagccctcactaatgtccttcaagtttccttctttttttggtggtccaataccactttttccataattcttacataattctgatctcattctgacttgtgtaatctaaatgttctcaggcctcgttaatatgtggatttaaatgatattatattaacatcaatgcgtaaattgatattacttctactttctacatacatcactgcttaaaacctactgttgttatttctgggagcccgaaaagtgatgcacatgtgttcatgttcaaaagcagatatgcttttcttcttgttttctaattttcttatcaatgcgtgttgctattgccattgctgggagctctctccatgcaaatgctactctgtgagacccaaccaacctctgctcatggctgctcattcttggcccacaggtgccagaattaccctgtggcttatgactgtgtgaggtgtgcatgtgtgctttggaaggtggtggcagagatctaaagaccccttctctaactgtcccctgggccctgaggcagtgtatcttgggcacagagcctcacagagtgtttaataaatatagtcctatcaactcctggctcaccatcatttgtgagtctcaaaagccagtagaggccaggcacggtggctcacaccagtaatcctagcactttgggaggccaaggcaggcagatcgcttgagcccaggagttcgagatcagcttgagtaacatagcaaaaccctgtctctacaaaatacaaaaaagttagccaggtatggtggtgtatgcctgtagtcatagctactcaggagcctcaggtgggaggattgcttgagcccagggaggttgaggctgcagtgagccctgatcatgccactacactccagcctgagtgacagagtgagaccctgtctcaaaaaattaaaaaataaaaagtatgaatacgaggcaattctctctgttatcctcaagtttgcctctctcttctgatttacccacaataagaatgtaaagtttcttttggttaagagggctatattgagaaaaaatattttatgttatattgtcattattatttctaccttcagctttgatgccagtgaaagaataaatactaacaaagtatttcattcaattcccaaatgatagtaaatattatatgctaaaccctgagaatttaagggtgaatagaaacagtcccctccattgaattatttctgtttggaaggacaggccaaaaataagctgttatggcatataatagcaatttttagatatatgtatgataaactctgagagaacagatgaagccaggaaaagcttcatagaggaagtgaaaagttgagccttgaagtgtgaatttaccaggtgagccaaggggtcaatgtatgttgtggtagttagagggagcatcatggtagttttaaaggtcaaagcaatttgaggaatagtgagaaatcccatgtggttaatgaacacaggtgagaagaatgtctggaggtagagaagacttgaaagtgtgggctgttctgaaaggtcttacttgctggcatgaggggtttgaactttattcatattttaaaaaaaagtggaggtgtagtagcaatagcactacatgctagaaaaaaacagctgagcgcatatgccattgggaaaatctcagctttcaattaggtctaggacctcccaggctgatcctaaagcaacagttgagctctcggacccaaggatacttcagaatttagaggaccttttgcgggcagggttgggtttaatccagggttaaaaaaaaaaaaaccctttcctggctgagggacaccagaaaaaactaaccttcaatgtatcctcatttctaaagagcagactgtctaatttatccttggtttttgttatctggatggcatccagtagggggacttgttttcaatgggaagtcgtttacaatgccacattgaactagtgctaatcagatcaggcgtgagattgttagagggtcatccaagctttgttttcccattaacaacctatctgcctgaatcccctcagcaaacacaaaagggctaagatttcagagtctctgtggctgtggaactccaacatcatcaaccagcctgggaggaaggcatttcagacaaaccctctaggccctgctagccaaattgcttgtaactgacaggtgatggtgggtgtcagctgggaaagaaatgacttactataaactccaagcatctctcacttcactctcaggaaatgtaacttgtatcatatttctcttcctggaagatattcagcaagtcagaggcctcactgatacttgtaaatacggaagttcttcctaaaccctgcctcacacttactcggaatggcagaattaatttggaagccagttcttgatatttaaaaatcgatttttttccatttagccatttaattttataagcaaaattaaataaataaagcttggtcttgttaaacaaataaataaagcttagtcttttaaatatgatctggaaaattcactctagctctatcaaaatagcactttgctttcaaggcttatgctttgagctggttgaagaattacctccggaaccactgtaatcagtaattaaactttttaaacactttgctatgtgaatgtatctcacactcaatttttagaacatcatttatgaaatgaaatttctctagaataacaatgtcatcttgcttttcagttcatgagcactgaaattataaaagtttcttcatcttttttttatattttagttcttgtctcacattccttattatttatttaagcaaaagatcaaacaggaaactggtaatcatgaattttcttcctaatcctttcttgttctgtagcttggtttatcctttcctttttgtatatttgaaaccgaactgttactacacagagacgtaaccatattacaaactgtggttcttttaggaacactgaacaaaaacatcaaatttggacttgctatacaatgaaattgctaattacttaatatactaataagtaaacaaatttatgagcttcattattgtctttaagtttcttgacaacaacccaccagggcctagtcatggagaacaaatgcaacctactgtctgcttctatctccccataaaacaactgtcaataaatatgagcatgtactttaaaatagtgaattaattttaaaattttctgcttttccccaactttgtcatacttacaatgctaaccattggaagggagtctgaaaagcaaagtttatcctcttaaggcagtttttattggcttctcattaattggacagccgggaatgctcattatttgttcagttgataccctctgttgctgggagaccagatacttcaccttcattaagttaactttgtagataacaatggcaggccctgatttcacaattcagggaatgaatagaatgaaagtttactgtgtgccaggaaaaccataatgtaggattggtgcaaaagtttctctttctttccatcatcatttgagatagtcacatgatcattattttcacgtttgaataaattacttatcttttagttacgttaccattctactgttgttcttcccaaagtatgaaaatcccaatgtattacttttcattaggaaaataaatacagaggtactatttatcagaacacgttttacctttcttcacattacctagttactagtatacatactgttctcatgattttcactactacttcctgaaaattacactcatctcatctttttttttttttttttttttttagacagagtcttgctgtcgcccaggctggagtgcagtggcgcgatctcagctcactgcaagctctgcctcccaggttcacgccattctcctgcctcagcctcccaagtagctgggactacaggcatctgccaccatgcctggctaattttttgtattattagtagagatggggtttcaccgtgttagccaggatggtcttgatctcctgaccttgtgatctgcccgcctcggcctcccaaagtgcagggattacaggcgggagccaccgcgcccagctttaaattacactcatctttaaggaaatgcttggtgaaccatggcacatgtttacctatgtaacaaaactgtgcatgctgcacatgtaccccaggacttaaaataaaaatgaaaattaaaaagaaaagaaatgtttggtgaaaacttctaagttttctagaaaatgatctaaggaattagagagaaaatattcctgattttttttcatcttgtttagcatggctatcttttccaaaatccaataggcagtaatttctattttgaagtcataactgtgtgttttgtgatacttcctgatctatgctcaaaatatcattagaggaaggaactataataatttacctttcagggctactagccacgtaggatgtgcaaatgtcagaataaatactttgcttggagcccaaaatatgattcattgttgttgttaatattatagtgtgattgtaaacattttatttattcatttcttgaaattaatatatttacttatatccctccttaatacttatgaaaatagagacatttttcccctcatagtgccaaaatattacttttaagtcaggttggtaatgatgaggggaattttattcttaaccaaaaaagaaagctcaaaaagatacaagcaacttgatacattggaagaaactaaccttggaattaaaagtcataagttcaagttccaacctgacctctggcagagtaaaggtgaggtagttatttaacgtctgcagctttaatttctcatttatgaagtgagatgattgatctaaattactatcaaagtccctttcagctttaggagtatagaactacaggaaactatgatgtgtggtttcttatgaccaacacatttccaaggacttgaagacttctatgaagacacttttggtgaaatattggagcagctattatattttgcttcagcctgtagagattttaaacttctttttgaaattaagaaactgatgtgtttgttaaggacttctttttctatcaaagtttttgattaacctgctttagaatcacataggatttgacttttccatctgttgttttcctgatgaatgtgatatagcacagtctcataaggcctccacgttaaggccttatgcaagataacatagattttatgctgagcaacgtaagtgttaagcacttactaggactggttataggcatcattgtggattttcatgaatggaacaaatctttatggatgcttcctatatgcaaggtactagtctagatgcttgatttacagccacaagtcttacaggaccctgtttttgtggaaatcacattccacaaaacgggcaataaatatgtaaaccaataattcttaaaaagtcaggtaggcacaaacctatgaagaaaacagaacaaggtaatgtgttagatggtgactagggtgaggacaatcttagaccgttcaagggaagtgatatttgagctgagacctgaacagtaaggaaaagccatctaaatcaagggtgtcgaatcttttggcttccctgagccactttggaagaagaagaattgtcttggaccacacatgaaatatactaacagtaatgatagctgatgagctaaaaaaaaatcacaaaaaaatctcataatgttttaagaaagtttacaactttgtgtttgggctgcttcaaagccatcctgagctgcatgtggccagtgggcggtgagttgagtaatcttgatgtaaatgaagacctctgggaaagactgtcccaggagaggaaacaggaagtacaaaggcccaaggtctcaatgagcctagtgtgttcaaggaacaaaactcaagtcattgtgcctggagcctgggtgccacacagagactggaataggagatgatgtgtcagaggaaggcaggagtcagatcacatcataccttatgagtcatggtcagagaaatgcatcttattctaggaaccatgcaacacttttagaaggttataagtaagggagggacctggtctgattttaaaagctcattctagctgctatgtgcaggccagactgtaaggaaaggcaaagaaggaggacaatcaggacactataacaggagtcctggggagagatggtggccgcttgggatagcatggtgatagtggagatggagagaagtagccagagtcaagatctgttttggtgataaaaacagtaagggcttggggtggtggctcatgcctgtaatcccagaacttggggaggccaatgcagatgtatcgcttgaggccaggagtttgagacccgcctaggaaacatggcgaaattccatctctacaaaaaaataaaaaatacaaaaaattagccaggtatggctgcacgtgcctatggtcccagctacataggaggctgaagtgggaggatcacttgagcctgggaggttgaggctgcaatgaaccatgaccacacctctgcactcctgcctgggtgacagagtgagaccctgccgcaaaaaaataaacccataaaataaaacacaaaaaccagtaagacttgctgatgggttagataggatgggggataataaaggaaaggcaggaaaaaataataacttgcagggatttgggtggggcacctgagtgaatagccatgtcttttattgagatgtggaatccttgtggagggatgttctgacgcagcaatataaaacgttcaatttcagttatttaattacaatgcctttcccctccacgtggagatgcctactaaggacttaggtatgtaagtccagagcacaggagagagaaatagacaaggtttatcttggttgcatctcacatcccctcctttttggaactttcctcccaaactcccactgccttaaggtgacacatttgctgcccaagactcagcatctcatctctgtctgtctaactcaggagagcttccttctctggatttgttctctctctgtgtcttccctcttagaactttgcttcatagcagtccccacagatctctgctctgtgctttccaaggtgagaattaattattacatagtttgttagtaatgtgtgaccgactttttgggactatcttaatattaacagagcttgtgttttataaacacgaggattttccagacaggaagaaagctctaaaagtagataattaggtgttttggcttgttaatgaaagcacttcatagttaggaagaatgttgaatgtacaatctatttaataacaattatacaaatatagagtgatcaaatgcttcctctatctcatgccaagatcttttctgtaatacagaaaacttttaggttttattctgtttgtatttcctaatggttttaagtaaattttgaccagaaaaaaaattttcattaatcagataggaaaaaatctagagaatgaagttaatatggaatttggacaaatataattcattcttaaagtcctatacagtggaattgcttcagagttaataaaatgttattttttatccaactccatgtatattactactagtaactttgtaattagatattccattttaagtaaatgggtgaaatattgtcataggtatgtttttatttgaaagttttttgttttgctttttctcctaatgcttcagtgatttacttattataaaggctataggttgggagttctagacttttgcaacttaatttttacctaccaaaatagaaaaaataatatttgttagtgcccttttaggtgtgtgagggggtgcagtatgtgccaattctccctcatctctgtccttgaagaatatagggataatttataggtcacatcagaggttagggttatttttcccaagatgggaatagttgtaatttttaaaaacctgatcatcagcacaattcatgccccttgcaaaaactgagaaagtagagaaaatataaagaaaaaaataaaaatctttcttaatcttaacaccaagaaagaaacattttaatgttaagatttttatgaaataaatgttttattagggtcaaagcctcactggcagtggttctgacacctggacactgcttgtactatagttagtcatttttaaggagcgctatttctgatcccctggtcacttccccgaagtttcatatggttttcttccattttatgattaaacagggggctgctgtacatagagaatgtcagagagcagatgcaagctacattttatatttctgcaacattgaagtgaattacaagtttaaaggaatccaagatatatgaattacaaggcttcagagatactccagattacatctagagctggctccctccctcagaggccagtgtgaagtggactcccaggcagcaattttcccttgacatgcctggagcacttcgaccaactttagtttgactgtatgatgtttagttagccatattttgaaaatattgattttatattgaacattttgttaatctgatatacttgtgccctcataggcccatgaatatctagatgaccttaattaatgtgtagaaaagtagacaatttaaaaaaaggataaattacacttaaatttcactgagtctaggctcttcaaatgtaggttagtattaatttatgtggataaaatttttatttatgacattgaactacatacaacatgtataaaatggagggaaggcaggaaacatcccattgagaatttctagtcatatatatatattcatctatatattcatatgtatattcatatgtatattcatatatatattcatatgtatattcatatgtatattcatatatatattcatatgtatattcatatatatgatatatatcatatatacatatgatatatacatgatatatatgatatatatgatatattcatgatatatcatatattcatatatatcatatatactcatatatatcatatattcatatatatcatatatattcggatatatatcatatatattcatatatatatcatatatattcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatatattcatcatacatatatatcacatatgtatcacatatatatcacatatgtatcacgtatatattcatatacgtatcacatatattcatatatatatcacatatattcatatataatatatccatatgtattatatatccatatatgtcatatatcatatcatatatcatatatatcatatatcatatatcatatatatcatatatcatatatcatataatcatatatcatatatctatatatatcatatatcataatcatatatatcatatatatcatatatatcatatatatcatatatcatatatatcatatatcatatatatcatatatatcatatatatcatatatcatatatatcatatatattcatatattcatatatattcatatatattcatatattcatatatattcatatatattcatatgtatattcatatatattcatgtatattcatatatattcatatatatattcgtatatattcatatatattcgcacatagattcgtatatgtatatagattcgtatacgtatatagattcgtatatattcgtatatagattcgtatatattcgtatgtagattcgtatatattcgtatgtagattcgtatatattcgtatgtagattcgtatatattcgtatgtagattcgtatatgtatattcgtatgtagattcgtatatgtatattcgtatgtagattcgtatatgtatattcgtatgtagattcgtatatatattcgtatgtagattcgtatatatatttatatgaatgaacttagcaagtaaggatcagcgatatttttcttactgggagtatcactgaataagcaatggataggatttcttataggaaattacactccattcaaaatattcaagcatggatatcttagacatagcaagctgtcattatatctctctggtaacccaatatggcctcttttataacagaaattttggcaagacccagagaaactattctgtgtcacgttaagtgtttgtgcttgtgtggtataaacaacaagcatagtttgtaagagtagatttttttttaatattttatttttaaaatgcagaagtttttcttcaaatagcataatcttggcaagcaaaatcatatttggtcttgaaagcacaatataaatttctgaaagggaaatatagtaattataaagattttcattcattataaacttagattaaaatcaattattccttaaatatagctaaatttatttcaatgtatattttaaaatataattgttatatataaatattgataatactcttatttttttgtcacagcagaaactactcatgagatgcaaaaatattttcagcttttgaactagattataaattatcgaaaaataattctatttaggttttttttttttttttttttgatatggagtcttactctgtcacccaggctggaatgcagtggtgcaatctcggctcactgcaaccttcacctcctgggttcaaacaattctcctgcctcagccaactgagtagctgggattacaggcgcgtgccaccatgcctgactaatttttgtatttttagtagaaatggggtttcactatgttggccaggcaggtctcaaactcctgacctcaagtgatctgcccgcctcggcctcccaaagtgctggaattactggtgtgagccaccacacccgacctctatttagtttttgtttattaaacatcaaagtatcatatcaaaattcagtacatctctgtctttcatttgctggatcactcactcattcaacagataaagtgccctgttgggactgcacttaggctttgtgagtgatacaaagtatgttaaatgctgtgcttgctttcaaagagctttcagtcttaacaacagatggactggtgactgcatgactatcatcctaagtagaaaatgaagagaaaaaatgtttttattatcttttgctttgtaagaaaccactacaaaacttagtggctaaaaataacaatttgttatttctgaaggatttcagaaaacctactcctcaaaaaaagcaataagaacacaggcaaaatttgtcaaaatcaatatattcagaactttttaaggggctttcacaatctaatgagtgattattcaagaaaaactttgaatctcagtaagactagcaggctttatggcattttaacttgtcctattcatatccctctctctccaacacatggtaggcttgaaaaccagtagcttcagaatcacagtgaaaactagctgcctagcagctgctggaaagggaagaaagagtgtgaagttcattaaaagctccattttcagggaattgccattatttttcctgcctggtagttccctaaaaaccccaattcttagttggtctttatttgacctgatcagagcttgtaagaatagccctttcctgtggacattaattgaaaataatcagtggcaattgtttaatattgcagctgcctgaggcaggagttataactggaataaacaagaagctgatcaaaaaaatttttaaagaaaaaactggggaagaagacatccatagagggcactagaaagctccaacatatttgtaggactccagacacatatttctatgttacagggctgtgtgaaaactccggaaaggcctgaaaaggccttaaaatctttggcaaaactccaagctctgaacaagcagaacatgaaggctaaggtgatttataaactaccagcctgaacatttaaggtattttctgtcacacacataggccttcagcaaaggctgggatgcttttgggtaagggtgtttaactattcaatcattagttgactactaagctaaatgagcagaaacttcaggagtcaaacactttacagaatttgtccagaaaagtgactaagcaaataaaaagcagcaacaataaagacaacagacagcaccaacggcaaaccattgacaggtagagtctaatttccaatgttaccatattatattattttaaatgtcttcttttctttcttcttttaaattatactttaagttctagggtacatgtgcacaatgtgcaggtttgttacatatgtatacatgtgccatgttggtgagctgcacccattaactcgtcatttacattaggtacatctcctaatgctatccctcccccttccccccaccccatgacaggccccggtgtgtgatgttctccttcctgtgtccaagtgttctcattgttcaattcccgcctatgagtgagaatatgcagtgtttttgttttttgttcttgtgatagttgggctgggaatggtggtttccagcttcatccatgtccctacaaaggacatgaactcgtcattttttatggctgcatagtattccatggtgtatatgtgccacattttcttaatccagtctatcattgatggacacgtgggttggttccaagtctttgctattgtgaatagtgccgcaataaacatatgtgtgcatgtgactttatagcagaatgatttataatcctttgggtatatctgggtcaaatggtatttctagttctagatccctgaggaatcgccacactctcttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggccgcataaatgtcttcttttgagaagtgtctgttcacatcctttgcccactttttgatggggttgtttgctttttcttgtaaatttgtttgagttctttgtagattctggatattagccctttgttagatgagtagattgcaaaaattttctctgattctgtaggttgcctgttcactctgatggtagtttcttttgctgtgcagaagttctttagtttaattagatcccatttgtcaattttggcttttgttgccattgcttttggtgttttagacatgaagtctttgcccaagcctatgtcctgaatggtattgcctaggtttttttctagggtttttatggtttgaggtctaacatttaagtctttaatccatcttgaattaatttttgtataaggtgtaaggaagggatccagtttcagctttctacatatggcaagccagtattcccagcaccatttgttaaatagggtatcctttccccattgcttgtttttgtcaggtttctcaaagatcagatgtttgtagatgtgtggtattatttctgagggctctgttctgttccattggtctatatctctgttttgataccagtaccatgctgttttggttactgtagccttgtagtatagtttgaagtcaggtagtgtgatgcctccagcttttttcttttggcttaggattgacttggcaatgcgggctcttttttggttccatatgaactttaaagtagttttttccaattctgtgaagaaagtcattggtagcttgataaggatggcattgaatctataaattatcttgggcagtatggccattttcatgatattggttcttcctatccatgggcatggaatgttcttccatttgtttgtatcctcttttatttcattgagcagtggtttgtagttctccttgaagaggtccttcacatcccttgtaagttggatttctaggtattttattctctttgaagtaattgcaaatgggagttcactcatgatttggctctctgtttgtttgttattggtgtataagaatgcttgtgatttttgcacattgattttgtatcctgagactttgctgaagttgcttatcagctgaaggagattttgggctgagacgatggggttttctaaatatacaatcatgtcatctgcaaacagggacaatttgacttcctcttttcctaattgaataccctttatttctttctcctgcatgattgccctggccagaacttccaacactatgttgaataggagtggtgagagagggcatccctgtcttgtgccagttttcaaagggaatgcctccagtttttgccccttcagtattttattggctgtggtcttttcaattaacaattagaagatatgcaaaaagaaggtatgcaaaactatgtacagataaaagagtggccaatagaaactgtttctgaggaaacctagacattaaacttacttaacaataactttgtctgctattttaaatatacttaagtaactaaaggaaactgtaatgaactaaagaaaagtatgagaatgatgtcttaccaaatagagaatatcaataagtagaaattattaagaagcagcaaatcaaatttttgaatagaaaagtataaaacagaaatgaaaaatttacaggaggggttcaagaactgatctgaggtaggagaagaaagaatccaggaacttgaagatagttcaattagtctgcagatcgggggaaaaagaatgaagaaaaatgaacagttccaagactgtgtgataccagcaagcatgcataataggaattctaggagtggagagagagtaaagaaagactatttgaagaaataagcaatgcaaattcctcaaatttggtaaaaggtattaacttatacattcaggaagctcaacagactctaagaaggacaaactgaaagagatccacacttagtcacatgataaccaaactgccaaaagtcaaagagagaatttttacagcagcaagagagaagtagttaaccaaaacagaaaacaagaagttctcaatatgagtaagctgacttctcatcagaaaccatggagaccagaaggcagtgggatgacatagtcaacgttttgaaggaaaaagactgtaaatcaagaattctatatccagcaaaactatccttcaaaactgaaggtgaaattaaggattaaaaaaacccagaatttgagactagcacatctgccctataagaaataggaaggaaattcctttaggctgaatgaaaggaaactagacagtaactcaaatccaaacaatgacataaaaagcactggaatagttaattacatagataaatataaaagccagaataaatgtacttagtttgtgtttcttttattttcttatcagatttaaaatacagttgtataaatacatacatacataaagcaatattagaaatcttcattgatgggaatataaaatataaagatgtgatttatttgtatgacaatagcacaaagcaagaaaaagctaacaggtatatagaagcaaagtgaaaaataaagctaaaatatccatgttatatttagcatggtcttcagttgggactaagaaatcagtattaggaactcatttgcaagaatttaatatgaaaaagtttctttggaaaatatttgtttacttattactggtgttctttaaaattctctgtacctctctctactaacaaaatcaagtcataccattttatttccttgataaatctctactgtttgtcagactgcagtgaattctgagattttcttctgttcaatatcttgttgaataaggaaatgtcacaatttaatactgtaatctcttcactcatttttatacactccaaactttaacaacactgtaccagaagattttttaaaaggaaagagaaaagtgcataagttacacatttactgagaaaaatatgactgagatattgtgttacacagaactttatacctagattttattttcttgcaatctccagtttccccacaaaagttctttgttttcctcccacagtaagatatttcccaaaggccttcctgaggagtactcagtagctgccatgtttcgagtacgaagaaacgccaaaaaggaacggtggtttctgtggcaggttttaaaccagcagaatattccacaggtaaagtaccattagagttgtgctcattagttttccttgtgtaattaagccaggtgaattatttgaactggtgcacaaatttgcgagtagatctagtatccaaatgttctatcctttagagggatcatcaacaagaaaatgcaagtattctcgtagttaggatggccttgctgagatccataatatgagagtatagtggtaaacatagtgttagtttttgtttttattttacttctaggtccatattttgtttaaagatgtaaaactgccttctctttacaactgcttcattaactaattctttctaagtaacacattcttcatcttccttctgtcgtctctaatgttatatattatttttaaagcagtttatcatttcattggacaactcttggtgaataaagagttgagacttaaatatttatcccatcaataaaaatttatggaacacatactatatactaggtagtgacaagaaaagagatctgaaaaacagaatttgtattatcagggagcataaggcgtaaggagatgacatctaggagaacaacataatatagcataattatgttgaacaagtgcagtggtagagttaagcttagtgttgggtgtggacaatgggagcaccgaaagggcagctcatcggaattgggggatggagagagcaggaatctaggagagcatatagaagagatggcgtttgggctgcaaagaaggaatgctggcactccagcgaggggagaggaacctcaaaattacttgttggcaccatacattagtttttacttgtgtacatatccgttgaaatgttttaaatcatcactgatcttttaatctgttaatacagctacaattttatgatgagtagatcaaccaagagtatgtcctctataaaatgtgttttctctgtaccttgcaaagtatcaatggtgaaagaattgatcttagcttccctacttagggaaatgatcacattcttagtcttcttaaattggtaaccttaaattcctgtgttactaatacagagcaataatttatatatcttataaaattttatctatagtgtatataaattatgtatatataaacttataaatggtttatataaacatttaaaataactacacacacacacacacacacacacactcttagatgttctcttaggaaggagcatattacattcaccagaatgccccatttctaaaccatttttgtagtggtgtttgctgttcttttattttaacaaacctggtggacacaagtgtcatctaaaatattttactaagtgcctcagttatactaatatgcatcttgagcttttctttgtgtgctttaataattttgaacattgatttttaaaacatttaaagatactttacatttttgcagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatgtaagttgtgatgttagttgtgaaagagaactaaaatttctaagtaaaaaaaaaatcttattaaaaacattcttcttttattactgtgtaatagattcccttctcatcaattttattaatttaattaatttgccgtcagatgtgtgaagaacagctatgttatttccaattgtattttcacatgtattattttcactccattttatacccattttctccagcctgggaatttaaaataattaggtcatgccttaaaaaattagattattaaaagtaaaaattgaaaatatgatacaaaatataaacttggtctaagttcatatgttttaaatagaaagggctggaaaaagctgaagttcaaattaaatggttccaggttatctgctattttcattcaagaacaatagactattcatccttacaatagcaattactttgtattgcagactattttttataagcgtataatggtttttcagggttctattgtacagaaaaattcactaaatgtattagtaggtcatttgaaagagaaaaattgcctagtaaaacccttttggataaaaagttactttaaatattacatttgaagctaacatgatatagatttattattgatttccctagagaacaaggtctgtaatcttaaaaaagttagatatatctaaatttgatggctgcacgttttcttagtttattatgtataaacagtttatagtttatttcttagagtttttgcaagaatgagatccagtcttggacctcaatctaagaagattgagtgttctatgtcctgtgtctcattaacttctcacccaaggatagaattgatcccgggctaggcgcagtggctcatgcctgtaatcccagcactttgggaggccgaggtgggcagatgacgaggtcaggagatcgagaccatcctggctaacatggtgaaaccctgtctctactaaaaatacaaaaaattagccagatgtggtggcacacgcctgtaatcccagctactcgggaggctgaggcaggagggggaggttacaatgagccaagatcatgccactgcactccagcttgagcgacagagcaagactttgtctcaaaaaacaaaaaacaaacaaacaaacaaaagaattgatcccacaatttgaggctaaagaatatcacgtgaatccttataaaaaggatataggtaaaaaccgtggtattacagtggtttcataatttcatgtggattcttggttcatttgaggataaacttgaaggcatgtcacaatgatgcaatatttttggagatagtcactgtttgagttaaacaaacaaaatacatatttttataaaagattcttggttctactgaaactttgaatggattaatttttcatcatctctgtacaagctctgtgattcataagatctgttatggtgtgaaaatgtgtttatttgggctgtgtgttattgaaaaaaattatcatgatttagttttatttcacctatcccacctgtgtatttttgtgagaaagtgacaaaactgatatgaagatttttttttaaatcaactcagcattttgacaagcatcagtacagatttagccttaagcattctccttctaaagcactatatcagtgaagcattctaaagtaatgaatgaataaacaaagcataaactattctgactgtcatttcaatgtcatggaactcaatcaggttgtaatcctttgaaaattgatcatctatctttagttaagtaaaacaattcataagcaggacctggtacaatggatggtacataataggatttcaatatttattgactattttgataacagtgataataaaaaagtttagttaagaacaatattaattaactagagttctcattcttcattctaaataattcatatgttactgctggtatttcattatactatgtaagacggtgtatttaaattttataaataaaaattaaccttaataaccttgcaaaaagttacagaacataaatcattacatttcatttagtctcatgattttgcattttctgcaaatcttaggctgctcatgaatctgtaagatgtctggagttgttaacgcattctatgaactgcattgattttgttcatctgaggcgaaaagtaaaagttatagatttttcccccctttttgcttttaaagttggagtagagattcacctctaatcacaaatgcctgctttctattattataagattaattattataagattagagttgggtctttctgtataaagtacttattgacctcaaaataatgcattatttaatacatttcagtgcttaaagaattcaaacagcctatttaagaatttattatattgctattttatcaataatcagtactatttactttttcttaggtgttgatttcatcttgcatttaaaggcatgattttactttccttgaactacagttaatttcatgtccaaatgccaaaaaaagagaaatctgctaagcaaatagaaggaatcaattatttttgtaaaaaggttgttagccctgcttagattataccaatataatataaaatcaataggttttaggcagaattcgtgaaatatagataaaaaattttttttccttgttggtaagtgaacacctatttcagtgcctcaaataggagtctggaagtacaaataaagcctttctcatcatgtgctcatatctttgattttaccttttctccaattttttttttattttgaaatggcctcattttgtgggcattctttactgtagtgtaaaacaatagcttttttaaaattaagtacttctattttattgtttgaaacagctagccaaggtttgcaattgctttcattacctgatttcctttatctatagatccatctctatatccaactctatgtctctcaagtagtccacaaaacaatgaatcctacatttaataaaaacattaaaatatccaccagtaatttatttatattagcttcctttttctttctgattaaattactgtagttcttaactgcctgaatgtgattccaaaaaactaaagatgtttcttattactaattttttcatagattgaacttcaccaacttaaaatctactgcagtgcaaacctcatagctcaagaaacatgttgtgaaatatcagatactaaggtaagttaattttctttgcatatgaagaatgaagaacgccaattatcttttagtggcatagtttgtagagtccaaatgtagggtagcactgagtgtgttctgttgaagccaggtgggtaatttattcctagtaaggaagcattcatagtgctttctcatggttactttcaacagttttaatcccagcatttcacccttaattttgagggtaatatatactcactttgaactcagtataacttaaagttatgcctttcttcctaaactatgttctgacagcagcatcatttccagttacagaagttttaaatctgtgatcatactttattctcactcattttccttttctaccctgtcacccatcctggctagctttcctttgacatagacttttcatccttatcttccattttcctgttactgccaaagtgtacatttacctcgtgtctgggatatcaatcattattggatcaactgccttccctatgtcctgcccctttgctttgcagcataaccagaataagtctgagtcactgctttgtatattcattcactctcttccagcaaacactttattcagaaacactgaccttctaaacactgtgctaaggaacagggctaacaaacatgattaaggcacattccctgccctctcttcatgtctttctcttaagtgactcctgttggaagtgaaatataaatgcagtttctcagcctctcattctaaatattcccaacctaaccatacaactgttacttacttataccaatctttcattacaagaaaaatactaaattcaatactttctgtatctctcagtgtaatggccgtgtgtgctatcttatattactaggtgtaactatatttgtttttaaattgatttaagtacaattcagactcagtaagggaagttttaccttgataaacttttttattcctaatgcttcatttggaaaaagtagacaatcattgtttgatttattgacttaccaattactaaaaaagataaatgggacagaaagatattcaaaggggactggttctaaaaaaaagtacagaaagagcatatgaaaagtgcaagtaaaaggtgaaaatgtcttttctttggatcttagatttcataaatgttctatacttgccatagaaaattatatgaaaattttatcaacaatttatgattcaaaaatatttttgacttttgtagctcactttgggtagtgaaataagaatgtgaccaaagcatagcttaaagcatagctttagtgacttaaagcatagctaagtctttcaagtattatatgttttgcttttgtaacttggctttataaagcatatctccaatccacttcatgtatctcattccaagtaaaatgccagccagccaaatatctttctataaatatctgaaaagataatttagaatgccaatctacagacttgaaatacctagacttcctggagctacacatttaaatcttaaagatgttaattcccccaaaattttgtttttaattatgcttttttgatgtcagagtttttaaagtaataactttctctggttgtaaagtaatataatgatattttgatatatctgaatattatataattagccagtaatcactgccctttatcattatattaatgtaatagaaactttccacctgatttatgaggaaattgtttaagaagtataggtgatgaattgggtggaatggttggtaattcaaagcagtgacatgatctcacacattatgaacaaaagatttttaaatcatattttgaaaagattatttgggagttagttttaaagaatagaacacaaggtaggaatttatctctgactatggaaaaaataaggaaagactgtatttttgctgacaattatttggaggggatatcaccattcatttaatgactaacaaaaaatagaaacatactacattttatgaataggaatgtacagttggaaggataaataattatataaaagccatttaaatgcatctgctctacttccaatacgaattgtatttattttcttttttgttgcaaaatgttttgaactcagaaatttttaatgtagttgcttaaatatctaattttgtcctggaatttcaaatcacacatgttttctggttgtcaatattttataaagcatttcaaaggcaacattttttaaagatcacctataaagatgcttctttgtttctattggattttcagtttctaaagtagttaagtttcatgactctagatataaaaagaatgaagaacaaatattaagagaaggatgaaatcagtaacatttgttgaaaataaatgagaaatgtggttaaatttttaagggctaatactgaatatgtgtcaaatcaaaaccagaggttttacgaggagaagagtccttacttgtatgtttggtgttgcctctaggcactttttgtggagtgtggacaggtttatggtgaagcctgagacatacttttaaagttatttaaatcctcaatttaatatagtgactcagttatccagagcagaattgtgaattctaagtgggtcttggttatctgactggaaagccatgaggtaagaactggctgaaacatcatatcaaatcaaatgagatgaatgaactgttttggtaataaccttgttccattcaaatatacaatagtttttagactttcaaatttgggaacttgttaggataaataatcctgaaatctggagagagtagatttgaaagaactagtggtggatacagtaaactagttgctgtatttctgggtgttggttttgttacagtttttattgtaattatcaaagaattcaactactaccaagtttttttttttatttcttatttccaacttttattttaagttcaggggtacatttgcaggatgtgcaggtttgttacataggtaaacgtgtgccatgatggtttcctgcacagatcatcaaaatgaatttttgttacaaaacttatctatgtttactggaaaatatagccaaatccataaaagaaaataaatatcaatcatgatttcaaccacagtagaaaaccacagataatattttagttttgtatcctgaaaatactttaccatgcatttataatttgtggtatacaaagtaatgtattaactctctcctagtgctttctcttcgtgaaattgcaaattcagagtggaaaactatggtgagaagtctggtacatgatgttgagaaaaaacaatgtgtttatcctcctcagattctccatttgggttaattttttaaaaaatgttcgttgctttgtaaccaaattgcacttcactttgtccagcatgctctgaacccactggataagtataaaatgcactacttgtctgttgtagtggagacctttttaatatctttaaggaacagtagactagaacaaagtatactttgatttaataaatgttgtctaagagtgtaaaaagaatttattttctactttatatgctttaataatcatcttgttgaaggaaaccatattttataggttcaaattacatgtttcaactttaatttttgttcccaaaagatgtattcacatgttgtttgtacaaattattttattgcaacaatacaattattataaatgtatgaaatttctgtacttatcaaaaagttacctaatgtaactttgtaattccttaccaagaccattattttaaatatttttcttgcatgttgtcagtataagaaaacccatgggctcaggcggaaagtgcaaaagtgtgataaacattctcacactggtgttaacttttggttagtaagaagcagttcttgcaggcaacctcagcaatccctagtttagtgggagccagtgtttggaacatgagaatgtttggaattgaccccatttcctaaagcctctttttggattttagtgcccagagcaggatggctttggaaatattgcatcatcatgggtaactgctcatgccagtaaaatgtcttcatatctgccagcaaagcaggaacttaaagaccagtgccagtgcattccaaacaaggtatgctagttttaattggtgcacactgaaagccactccagactatgagcccagctccttgaatgtggcctctgttcacagaatgtgtcttgccattcagtgtttgttgaagtaaatacctcagttactggggtgggttaagaaaaaggcattgaagataggacttcctggattcttacctggatagtttcaagcccatctgaacttccttccagggtgtgaactagaatgaatagaaaagtgaagggaggaactacctgtacaacaggcaagtactgagtacttagcatgtgccaggaataggctgaagttctgggaattcacagttgaagaaaacacagtgcctgctcttcaaaaacatacacaaaaatactctacattgtatttctttttctgtatagactgtgtttttccagcatccctaaattttcaactggctgtctccatccaccataagttattaggggaatatacagaggggctctgttgttactcaaataatttgtttcatctgcaccaatatgatcccctggtcaagaaggctgtgccatggacctttatgaacttcctttatggatgttaatggcagtaataaagcctgtgctaaaaggctgagtggtgtcttggtggctttttccagtgcccatacctgaggaaaggagaacttgccccagtttctagagcagagtgtgccctagcactgtgacttaaaacatgtcatcgacttactcatccaccaccacttcaactcctggctgagccagatggggatggggtgaaagtttaagggaaactttcattttttctagtggccaatattgcatagtaagctctacgagaaaggcaaggttcgggggtccatagagaaacagcttgtgttccagctcatggaaggtctggaggagatgatgctaaatggtgtttggaagagtgaggaacagtgaatggaattccattggcatgccctttttcccttgttcacgtggctcactattcctcactctaagcatcagctcagaggagaacaaagcgttatcttgctagtgccagcttcacatttataaaccatttggctttagatcaatgtgacagaatgtttgctaacacagatatgcatttttgctcagggagaagcaggattaccaggagctccgggttcacctgggcagaaagggcataaaggagagccggtaagaaaaaaacaaatactgatggagaaaacagggttttgttaaaaaatgacttaaaaatgtgttcatctcatttttctttattctgtacaaatatatgtttctataaaaggctatcaaagactatattaaaatgctgattactgaaatagagactatcagcattctagtcagcttttgaattcatattggtaggctggtgtgaactttggaaagatctggaactgcaagtctttgtacctataagctctagcaaaactgtgaagcagaaaagtctattttctagctgtgccctagccttctttagcattcccttccccaaatccctgttgaattcttgcttctcttgtcttttgatacatccccaccagagatttttctgtagctctctaccttttttttttaaacggccaactttttttgaatactttctgtgtatgaggtatgttgcttggtgttgtagagcacataaagacaaataggatatattccctgttctcaatgattttacatctagaaagagatcgtggaaaattacaaggccatatgtgttaggtgctgtaggagagttgcaagtgtcctggagaaatgatctggggagctagggaggatttaatggaggaatggccagtggactggacctctaagtgtgtaattctaggctatatcccatgcttagagatttgtctttcccttctcccatgactcaaaacttaactgtaatgtttctgactcttttgagtatatcttttgtcagctaatcaggtaaatgaatgagcactgttagaagttgattctgtttttattatctctccaaggtaaaatagattttaattcctttcctgccttaacttgggaagtccatgattctaaattatttgtataatctattgctccccccgctttaaaaagacaggagacggaagtctgagaaatgactgatccctcaaagcttcaacaaagctaaagtcatttgattcctgaaggaatgtattcccatgtaccttgcatgggaacttctgacaactcagcaggtgtttgaaaaagatttttgaggagggacaggccatttattattgctctttaaaatgcattgcttggggtacctttactttcaatatcattttatgaaaattcaaaataattgaacaatatctgattctaaagaccacttcaatcaaactaaacatacaaatcattataccaatagcaagtatttgtttcatggttacatgtaccagacactgagaagaatgttttagatatgttatcatacttgatccttacactcactcttcatgttagggattagtattagcattttacagatggaaaaactgaagcttaggggggttaaattattgcccagtgccacatagcttgtggccaaactgggatctgaaaccagtaggtctgttgactactcatgaccagtatccatttttaaggctgccactatgttctaaaagcaattcagtattatgtatctgtgttctttgatcaggtacttccacttgcgatattttactcttaaaacatcatttaaagatgccagcctagtgtctctatcctcattttacagctgagagccacacataggtaaattgatgtgcccaaggtaacacaattaagaggactcagaaagtggaaagatctctgagttaatcccaactcttctctggttagagggtgaatttggccaagccactcagactctccatacataagttttcttatctgcaacggaaggtgttctcacttatctgttatacctatactataaagtgacaccaaaatgccttgaaaaaaatgcatgtggcttaatttttggtgactgtgatttatacacgttcacatacacatttcttaacttgtcttttcacttctttgatttatcagttccttcatatttaagattgctggcacaggaagaaatttcatgtgttgcttttaggaaaaataccctgcccactgaaaaaaaaaaatctatgtcataagtacagtcctatttgaataattattttaaaaatcgttaaatctactttaaattcttttttaaagattaagtgcttagtcactgttgttagagcctataccttttaaggatgcattttccccctcgattccctttaatcataaatagacatctctcactttaacatttaaatatttatttttctttattcattcatccatcaacacctatttattgagctcctgctattataataaaaaatgtgccagactttggagccttagcagtaataataaaatacagggcctgctctcaccgagtttacaatcttgtgacagtttgttcacagaacattctctccttctatagaaactaaaaccagtagaaaagaactaggaaaaattaataaaaatggataaatattagccaatttattgtatgtcaaatctataaaatatacaaaaatgtatcttagagtaacaatgcattatatgacttctcatctgcagtatgttttaagaatattaacatttgttttaaattccatgataattcataatggcaagagattttagtggcaacgtaaaaacagctgcaataaaggaaatttataatctacacaacgaataactaatctgtgtatttcccttatcttttcaatacatgcacccacatttgcttaaaccaacatatgctctgccttgtaaaaatgacattagatgaccatgaccatgaatgcattcaaccttcctggcacttgaaataaacatggatgtattgtttcattttaaggaatggagggtgggtttatttctgctcctattgcactatgtgatcttgcaactttaatgtgcaataaataaagaaggctttccttcatttttgattctggcatgtaattgtcattattagagcaggtgcacaaaataatgcctacataacttgaagatcgaaagtcatttttgctctaaggcatattcagtagtaaattttgtgaaatgatcagaagtgcaatgttactaagggaatcagatgttgttctaaaggttttctttttgatctgtaagcccaagaaggaatatttagaggaggtagaacagtatgttggaaagagtaccactttggagcctgaaccacttaggattgaatcctctccacctcttacttgctttgaaaattatccttaataatacctagccagtggttgattgtgaagaaggaatacaatacaatatatacacagcacttagaaactggcatattatagatattcaacaaatatatgtttcccctgctttcttatccaccatataattgtccatatattgaaggagaggtggagataactattttaggttgagtttaatttcatttgtggcttgatgaagaacaaaggaatcttcatttgtgagatactgccttagaattttcaatttattagatgtaaaaatgttgagttatcatcacatgctacttgtggtaaatagtaataattgatcaatagttgatttcttcaaaagattactcaataagttgactatttcattcaactctgtatcttttatttccaatattatctgtatctgaccttctctggatacaatgtgctagttgctttttttttttttttttagacagagacttgctctgtcacccaggctggagtgcaatggtgcaatccctgttccctgcaacatccgcctcccgggttcaagcgattctcctgcctcagcctcctgagtagttgagattacaggcacccgccatcatgcctggctaatttttgtattttttggtagagatggggtttcaccatgttgaccaggctggtctcgaactcctgacctcaggtcatccacccacctcagcctcccaaagggctaggattacaggtgtgagccactgctctcagcacaatgtgctagtttttcaaatatgttccttgcattgttttacttagataatgtcgattagaagccatccagacacaattataacttactttttctcattaactgtataatattagtcttttggtgcattttacttttggcccaatgtaataaagtgagaaaagatttgagaatacaacttccacatctctttcaaattatatgtcactacattacagtatttctaaaggtgttaagatttttattaatatgttaattgacataacaattatacgtatttatggagtaaagtgtgatattttcattcatttatacaatctgtactaatcaaattgggataattaacatgtccatcacctcaaatattcattatttctttgtattgggaacattcaagattttctcttttagctatttgaaaatattcaataaattattgttaaccatagtcaccctacagtgctattgaacagaagagcttatttattctttatagctgtaattttgtatctgttaaccaacttctccctatccccactcccacccttcccagccccagtaaccattattctactctctacttctatgagattaactttttaaacttctacatataaaggagaacatgcagtatttatccttctgtgcctggcttatttcacttacaacaatgtcattctgactcatccatgttgctgcaaatgatgggattttactcttttttatggcttaatgtcattccattgtgtgtatgtgtgtgtgtgtgtgtgtgtgtgtgtgtgtgataaaacattttctttatccatttattaattgatagacacccattttgattccatgtattagcgattgtgagtagtgctgtaataaacacaggctttcagttatcttttcaccatacttatttcctttcctttggatacatatccccagtgggatttctggatcacatggtagttccatttttagttttttgaggcatttccatactgttctccataatagctatactaatttacattcccactaaaagggtgcaaaagttcccctttctccacaactttggtagcattttttttggtcatttagataatagccattctaaactagggtaagatgatatctcattttgattccaatttgctcctccctcatgattaatgttgagcattttttgatgtatttcttggccatttgtatgtcttcttttgagaagtgtctattcagatcattcacccattttaaaatcagattattggggtttttgtttgtttgttgctgttgagttgcttgagctccttgtatattgtggatattaatcccttgtcagatgaataccttgcaaacgtttactcccattctgcaggttgtctcttcattctcttgatggtttcctttgctgtacaaaagctttttattgcaatatggtcccatttgtctatttttgctttggttgcctgtgctcttgaggttgtagccacaaaatctttgcctagactaatgtaccaaagcattttccatacattttcccccagaagattcatagttttgggctctacatttaagttttcaatccattttgggttgatttttgcatatggtgagagataaggatctagtttattcttttgaatatagtttttccaacactgtttaacaaaaagactgtcctttcctcaatgcacgttcctggcacctctgtcaaaaatcagttggttgtaaatacatggatttatttatgggttctctagtgtgttccattggtctgtgtgactgttgatgacaatctaaggtgttatgctttgagcatccttactttaatgcagcaaattcatagagaaaaatgttactcttatttatacacatacattatgagttagacaattattccgaatagtcatgtaagcaaatcctgtcccacctgagccaaaacccactaatgacttcttgtctctcttaaggtaaaccccaaagctctaaccatgggctatgaggcttcacataatgtgtagagctctcccctacctgactcctcaatcccagattgtctcgtaccctcttcccttgttcacttttgctccaagtcctttgtaccagttatgtatgcctgaagtgtccttgtccacatccacttggctcgctctcttcttcacatcatttaggcccttgctcaaaaataactttaaaataaaaaggccttctggcatctctatataaaaagcatccttactcccacctctatcctcttactttgcttagcacttttactgccacctgacacattgtcatcacgcatctatttctttccctgttggaaaatgagttctgtgagcctatacatagaacaacacataaataataggagctaaaaatatgctgaatgcatgaatgaacactatacctcaaggaaagtttaaataatcaactcagctatttctagaaactgtaagttctccttcctaattgcccaggagactctgctgagcaaggcaaagattcaatttgcaaggaaagaattaaataatattatattgttaactattgttctactacagttttttcttttaaaaaacaaaaattcttttcacattgatttaatcaggtttagcttagtattgtctaggtaatgaagcatcaaaaatattttgcaaaaagccagaagttttggcaaaacttaatatgtatttttatttgcctattttcttatctactatgatggtttattaatatgatttactactttttctttttttataaaggtgatggtcacctctcatggaataatgcagttttaagtactactgcttgtatttaattatctagttgtgatcagcattctatatcagaacacctaatcaagcgattttaaccatgctctttaacactaaactctgtataacattatttgaagtaataattaatacttttctttcatttagactcaattgtaataattttctgaattttttaattcccttttgttagcaaatgtagttagcaacctaattccttagcaactgcattactttctcagttctttaagacccttgttaataccctcacccatttcagagctgaaattctctcagagttttataaaatattagctcaattttaatgttcttgaacctgaggggaagtgttatctgagctccattttgggaataattttccagtttatttttctattattatcttccatatctccagttaatttgccaaaatgtgttgactttatgaaatgattgctttgctgatatgctttgacagaaaatcaaaactgtttaaaatggaataagttagcttatttgacttcttagtcagaaactggtattgatttatttcaacttctcctgccctccaatcccactatagaggttttcattttgagtagtctaatatgctaacccagagatgatgagtaagtttcccctcattttctttccaatctgacattactcatatgcccattctgtaaccataccacaacaataaaaattaattaaaccaaaatacgttcataatttttaaaaataaggataccttctcttagtaataactttacagaagtaggatttaatattattcttttgacttcttttaatatgtcaatataagaaataataatgtttctttatcctttctaatcccatattgaatatattgaagtaattgacaagtcctttttttggatcagttttacccaatttgatataatctcatgtaatctacaggaattcacttgaaggtgaaatttacttgtgggtcttcatctgaaattaacagatagtatcattataataatggtattacatattcataaaattacaatatatttcttaatttctaccaagtgttagtgacagagaaactcattcaaaaagtgtatattattttccactgtttcgaggataaatttattagactgaatttgtgatagtgcttttaaggaagccatagatgatccatagacttccttgcacctgtttttccatccctgcttggcagttagacagaagagcaaggaagctgatcattggattgacccagctttggggtttttcctggaggatgtaaaggaaagtcaggcatactaaatgaaacaaataggaatatcttagaatctgaaatttcctgacctacttgaattgaaagcatcggataggatgtagcttttaactcatttaaactcatttatcatattaattgaagtaacagcaatagtattattccttacatttggtaaatgtacttttggtaaatattaaatcctacttctgtgaggttattactaagagaatgtatccttatttttaaaaattatgaacatattttggtttaactaatttttattgttgtggtatggctacagaatgggcatatgagtaatgtcagattggaaagaaaatgaggggaaacttacccatcatatctggattagcatattagactactcaaaatttggtaaattacaaagctgaattacatatttctgtgtgaatatgtctagttttagttatgattagcacttagatatttacgaattactgattttttacaatttattattttggcttgtgggcaatatgaggaaggaacttgaagcacaaactttggtgcaagcaaaagcaactcatctaggaagaggtagattcactttgacaacattagtaattaacgcaccccttaaaagtaatctcctaataagcatttctgtattttagggtgcagttggtaataaaggtgaatttggtgctcctggaattcctggggaaaagatatgatggtttactctttgatcaaaatttatggttattttataaagctgtatcagataggataggaaaatatacagaacaagtcctatagtttagaggtaatcaaactgtggccctatagtagggctgccagaaactctcactgtaggattttgtacataaagttttactggaacacagccacactcatttgtttttgtattacctaaggctgcctttgtgcttcatggccaagttaagtaattgtggcagagactgtatggcccacaaaatctaaaatatttactctctggccctttgttgaaaaagcttgctgatccctgctccggaacattggctgctattcttttagccccagggcttctcaaattcaccattttatatataatatggtgtcttaatatgtatttcactgcagacaaaaattaggcagtttatgtaaacattttataatatagactataagacatactataattaaaaatataagaaatatatttcagtgtatcaataaaatgctatactgtaggctatagctcataaaatgattgatttttatgtttttcctgtaataccacaaagatgattccaaacaataaattcactcacgagaagttactgttgcagtttagcatcttattcaacttcagtttttgtagaatatttaaaaaattgttgtatttgtatattaaactgcaatcaccttgtcgtatttttccctatatatgcctatattaatattaataactttgctaaatttttaaagttctcatatgttgatgctaagaaaattctcttctttatgaaaatatgcttagtataagtttttgtggcattctagctgcactgattatcaagtgagtccattgtgtcattatctagaaggccatgaccattgtggttttattcacctaaagttagcacagcaataactgaagctgaagcagtaggaggttcagaggttttcagacagatattttttcagaccttcataaatgtgtctctggtatctgatggcttcattgatgctactttttcctttcataaattattcagtctgatatgcaaattctttactcctataggaatgtaactgttaaactcagtaaagtccaacaaactctattgaaaaacaataccttgctgcaagttgatgtttatttgggctgctatcttcttgtataagcttactgatgacattaattgacgattcttcatcataaataaaagcttctttaaatacttgttcaaagttctaattctttaaaaatatcttttctctagagaatattacttgatcacctaaagagatgccccaatctaaatttaccttgtacccttattctaccaatctttttctaaaatgcatcacaataatctgattgtttagatttcagatcattaggagtttttgaattattctgaacatgggaatcttttttaaaacatttgcagaatcaccgaagcgcttgagctataaaatagattgtttgactttattgtgggatgtaacgtgagacttacgtacatttacacaataaattatggcatagcaggatagaattccctttgaatgctttaaaacagaatttatcaaggttggtataaaatagcattaattttaacactccaaaatgacagcccttggatccttatgtatgacaaccaggtgcaaactgctacttattggttgtggaacaggttctcaactcctgaaaaggtgatgtccacagactgacaatataaggactagatgaagcattcagtagaatcaatcctgtcaaaagctgatcaaatgaattgccatccagggccatgatagtaagaaaacaagtctagaaagttaagtatgcaagccaagaaattctctagaagaagagagagtttcttagaaaagagagggcatttagggcaacgtgaaggaactggagcaagtcagtatttcagagacaggcactactcagaactaaaaattttgtttcttttcccagaagtccacttttgtagaaagaatcttgtgtggtgattcatcctatatttcacttaaagtaaaacttcagtgaatataaaggaaaatactgataatctagttagatgaagtcattctgaaaaccaaaatcctcagcccttggtgcccatttggtcaaaatggtgactgagagagtcttgcaaaatcagttaatgagtgtgtctgtgtgaagacactgttcccagagaacttaagaagctaatatcataaagaagcagctgtttttatggtgttctaaaaccatggcaaaattgtcctggcaaatactctttcatgtttcctcaagcagttttcttctgggtctaatttacttgagttactcttaaagggtctcacagacagttagagaattcatgtaacttccagtggtgctaaatatggtaacagattacgtttaactcttggttcccggattcacacatcatcagagaccgtacttagtggttaatatccttccaatacctatagaagcactgagtctttgaccactttctcttcccaaggactcagtccctggtggtgccagctatgattctaacttgtcacttcatttagctgttaaaggggtgtgacactcttgagtgaaaaaatgccgcctcaatagtgttttctcgcttctataatccacaggttaccacttattgaaaataattctaaagaatgtatacaaaatgaaaacaagaaagttactagcgtattatctaacagtaggttaataaattgtaaaattttttttaaatttcaaaattttaaaatcatcctcatgaggtttatgtttggggtgaaatatttctgttattttacaagaaaaatggtttgttagatttttctaagtaaatttccagagaaaaattatcagttcttaacatgtgtgtcacctcagggctttgtatcccacatttgcttcaacgtgaaatatgtgcatcttccagagtaacttatccagcatccccttaactttgactctgcttgtcagcagttataattctttgttttgttttgctttgctttacatagaatcaggagtacttaagagtactgttaaaaaataaataactaggttgaattgtttaactgtttcacttggagcaaaaacatatgtacaataccatagaatatgtatctcaggtctaatattctcaaagtgaagatttttttctaaagttaacatttaagctaggaaactgatttatattaatggagtgaagcatattctgagcagtatgaagtattaatttgtacattaactatactttacacttacatcaatgtcatacttcaataaattaagtgatttgcatataaatcacattattctaaaataaacctacactttgaaatttagctaggtaatagcagtaaattcttttaagtcaagactctgaacaatgtattaatatactgtggtggcatttttcctctgacaccaaggataaaaatagtacactaaacaacacaattttataaaatgtatttatggaatgtggagtcatgaggactctaataaggatgaagtatagcatttagttatgttcttttgtaattgtaatacttatcacccagtacagacttgcagtagacattcttaatctaatattagttctaatctaataaagccttactgttaaacattgcataaaaataactgtcccctttacatttattcagaacagctatgattttgcctaagagattcggtaagtgttctgttatgagttcatttaagaaaatcagttctgtgtagcagtattattaggtagctggcgacttctggtaagcttggatggacagaaggctctgtcaatcaaaataagtaaactggatggttccatttccaagagaagtgaatgactcaaagcatgagatcacatgaatgcagccacacacacacacacacacacacacacacacacacacacacatgttcacaccttgcatcctcatggtatgaagtaggaaaatgagatgaggatttggacactatgagcaaattttgcccactttgcccccaaatataacactcaaatcatgtttgttttcattacctgaatacttcaaacaaaaaagtgcctcatttcatacttcacttatgtatttaaacataaaagatatatttctctagaagtggggatttttttctaagtaggaataattattgtccaataatcttatcctaataatgtgatagtaaaaattgaacaaatatagagcctaatttatgctaaaacccatattctatctactaaattactttaaatttgccctaaaatgtttattttaataggaaaacttttactaagttaattttgctccccatggagtaagtatgaagtaaatcatagccatcattactttactatgctaatattaaatactcagagttagactgcctgggtttgaattccagctcaaaatcttactctctaatttagagcatgacacttggtctctctaaatgtcagttttctcttttataaaacaggaattatattgcatctacttctagctttatcttaaggattaaataagattattcataaaagtgtcagcacctggtatgtaaatatttggtaaacaacagatataattttaacaataaacagtttgatgattctattattctagccttactgtgggaccagattagaacttatttgaaggaatgtatacacttcatcttagccaaaaggccaagaagcaaacacttgggggaatttatattagttattgaaaatatatttacaggaaaatgttaaagtcacatatcttatgtaaccttgacctcttaaaacaaactagatgtcagaaaaccagtgaattcctcacttattataaatatgtacaagaatataaacttttacaataataataataacagccatttactcaaaaagtgttatatgctaaatgctatcaggagccttcttcacattatttcattcactccttacaacacccctgtgaggtaagatttattgtcactatttcacagattaggaaacagatctagagagagagagggaaaaaaaattaaaaacttcccctaacttggtacggagaaaatagtagagtcaggatttgaacctctatccatggaaatccatagctcttgcccctttgccatattacctcatctggacagctcctcaaatattcagatttcatttacacaggcaggtctgaattagatcttaaatttgtttgcctgccagtttagtgagtgaactgcagtttgcttcggacatcctgctccaaggagggctgtgtcccttccctttaaatccaaggaccccttttaaactgtatctgaccctagggattctgactcccccaccttcataagattgtgttcacctattaagaatcattatgcatatggtttttcaccaaatgagagggttttgtctagctttaccttccaaaataagtatcatggaaaaaaatttgcttggtttccaagtacaggttacatttgaagtgtgttttcaaacattccgcgcttgactctctggagattcttaatctaccctgcatgcccacgtccaggcagctcaatcatgggcactctccagattaaccttaatgcaacacctaatgtagaaatttttctcttacattctccaccaaataaatatatataatttatttatcaaaaacaaaattgtttaacttagtaccatggctttataaaaatataaaataaatcaaccttctggaagtaaaaaaagctgtatatattaaagcacttaagaagtacatctgataacatgatgagagagtggccaagctgcatgtcttaaaaatagctggactaactatcatcattatatgaggatatgctttgtatgatgggtcttttcaccataaactctgaagccctcagcactgcagtgagatgagactgaatgaggcagatccattgttccctaacagtctttgtatttcttttctgctggaaaatgaaatgactatgatctttgaatcttgattttccctaaaaagacattttatgagaagactgcagcttcagaaaataaaggcagatgctgttacagtttatgtaagtgcagacaaggccaatcactgttgtgaattataatgaactttctaacagtgctggtccagatgtagcattaatgcttcagagactcagaaacttataggcaagtagtataaaagctagagaattttaagccatttggcttcctctctatatttctagcctcacctaatttttctgtgcttaattttagacttcctaagtttaaaacataatttaaaatgcctaatgcatgtgacaatttattatagaaattgaggccattaaatgaggaggaaaaaaaaagacaacttagctttattctatcaatggaatacttcctgcctatgaaattgttaggctttataaaacaagaatgttttccactttagagaaaaatacctcttaagcagagaatcacctgtatatctgtgtaatttagaaaattctctaatgagtgaaggtatagtcaaatctacacacaggattgaatttttaatcataattagtattcatagaaaaaaatgaccacaaagaaaacagttttgtaagcctacttgttggctttacttgttaaaggtaggagaataaaacttgaattatcagtgaaaaactattgctcttacatggaataactgtcatttaattgtcttatctatagacatatattgatacaatatagcactaaaataagcagaaacataagaaggacaaagtaatagaaggacaggaaaaagaaaaagaaacttgctcactctgcagctgattttatttcttaatggtttcttattcccttctaatgccttccactcacaccccaagtagagcagttggcagggaacacaacagatggatgacaagctcaccacatgccatgtatctggcacccaggcacttgacttttatttgctaaacagtcagatttcaagaacctagtctgctaatgttcctgtttggtttaatgtactaccagcttctagcacgtaaatattaaaatattgccataagaaagctcacacactctgtgtttctctgcatagttaagtggctaattattttattcttggtgtagatactgaacagtggatttaaacatataactggtattttataaagacatctatgattttagatattagagtttccttaaagtggctctatctaaaggagcttttagccagacacatcagggactgccaaagccggtgtaaggtattgaatgaacctgttagggaagactagaagatttgagcagatgatcacagatgattggtatctttcttttctatctccatcactgcattttcagattattaaactcaaaacacatgcatttttttcatgaattctcccaggccaccaggcaaaattacagcttatccactcagctcacatagcactttatttatatcaccaatgtagagtgtgtctatacaccctgctaaaatgtgagctcctggagtagaaggacttggggtctgtctcatctctaatcccagcaactgacccagcgtatggtacctggctggttctggataagtgtttgttgagttgttcagaattcgaggacttagccccaagccagaaatagagaagagaaatagagaatgactgttagaaaacttcgctgaggaaagatcggaaaagcaccccaatgccagcaacacttcagtgaaagtccttcgtactttctacagaagcataatttagggaaacaagggaatctcttctttgcacaacaaagtttacaggtattgcttcctagaattaaatataatagaagtgtgtgcatctccagaatttgctttccattttctcttggagaaagtatgctcttccctctctctcaaacacaaatattcaagttatattgctttctttttatccaaactagatttgaaaatctcctaactttcttacaacattgttagggtgtgttccttctccatatcttcataaccatttacttcagggctaaagataagtaaccaatggcttcagtacatttaaggtccagtagaagtaattgatatggaatagaactataaattactcatcacgaggaatactccaggcaggaaatagttttcagttactgctatatcattgtcctcaattaggagctgactgatgacactgtccttctctttatatcttaaatcatctttcacttgttagaattctgtattcagatgtcaatcactatacttcagatatttcagtagatgattcacattaaataagtatttctgtagtatttttatgaagttttaagtttggtttaaagactctcttacagttagtctcataataaagtgaaaagcccaaacatttgtgcctgacactttcaggaaatcatcacagttacataggagcccagattttgtagtgggttctacaacattgactaaggcttaattctctagctttgctatgtgtaggaagaaacttttacctctccaagacatttcaaaattacttgggttttctttttgtttttttatttgaataactcttagtacaacttgtatttaattaatttgaaaaaggattgtaaaataacatccctttgacaggaaaacttaaggattgtagttgactacaaatgtagcatatgtaaacaatttagttttaaaaagaagcacgttgtattaatagaagtacaaaactgtatagtagccacagcaaagtgtgtgtgtgtgtgtgtgtgtgtgtgtgtgtgtgtgtaagagagagaaagagagagagagagatggtcctgttctgtattctatgtgagtaagaccatttctggaatgatgtgctgagttctgagagccacattttaaaagacatgactgacccgtgtgtgcccagagaacagggaccatagtattaagagactccaaactatcatttgaaaaatgagtggtttactgaatagaaggcttgatagtggcacaaagggatgtcatgtataagacctataactttttttctgtgtaattgcagacagaagaaataagactgatgggcaaaatatggggaaggttaatttgggttcagaaagcatttattcagtaaccacacagtgaattttttttctttgctctccacaatgcaaattaagcagcaaaagtatttgactttaagaagctttcaatagagttggtgcctcatcagattctttggtggagttgttatacataaatgcatgaatttatatttgtccttaaatttaagaatgcccatcctgcttgttttctaggcacatgcacctgtatatacatacatacacacatatacatatacactcaggataatagattttaagagagtagatgttgttagctaccactaaccacccatacatacattaccatgatcaagacatgtattgacccataagaataaataataataggatctaattcatttaagattaaagtttcaaattggccttatcctgagcattaatgtgattaaaatatccctatgcattagccgcattaaggatccaaaaaatataaagaattcaaaaagtttgagattttaaattctttgctatatatatatttttaacttggtaatttatttcttagaatgaagtcccaaaatatagaaggaaaaaattctccccttgaaataaaagcattcagattggatatctgaaaaaaatttaaaaatataggtttttaaaaatttcctgaaacgtttaatggactgccaacagtttaagaaccataaaatatttcaatttctaaagattatggctgaataaagcaggactatagtcagtaatgtagaggtcaccttagtaatacacaaaatcaaaatcagatttacttttttctgcctattttattggttttagtcctagaatcctggcattccacttctgatatttcttctagttatttcatgcaatattcaacttaagtaaattttcttttaataaatatgaactaatgaatggggaagtatgatatatttcaagtggacactaaatttatatagaaggttatactcctagaaaaatatgctctaagtaaaatgataggtcaattttttcagtacagaaatgttataataggatctcggacattttaatcaaaggctgaatgtctaactgttaaaaaaaatcaccacaggatagtatgtaactttctactttctggatcaaatgctggttatttgcaatttttttgtttccctgcttgctttatctttatttgcttggtctcatttatactgggtttgcaaactatagccctagggaatgtgattttttttatcaaatgtccttcagacaatatatgtttcctgcacaataagaaatacattacttccaatgtcaaaagaatcaagaaaactaataatttatagtttatgaccagctatgcttactgttgaaaaatatgcagtgattacaaggacgtaaaattaaatccagtgatcagtttttcagaaagcaaccagctgaccctaaacatcacctaactttgtcccaaaaacttctcaaagaggttattttgaattttggaaagggtactttttgattgtcctgtgaagttaaagacatgctatgtgttatagtaataacccaggcaacgatactatcggcagcaacattagattttgcctgctttatattacacatatttattaacttatcttcctgtagtttgaatttgtacctgaaaaggaatacaagtcctttcatagaaaaccccgtaatgaaaaaaaaaccctcagaaataagttttgaaagttatggtttctatgggaatcatttattgtgattttctttcaataatgaactaaagtattgattggaagccaaagaagaagcatcttatttcttcttggactgaaattttgaggaaggagaggcagcaggagttcagaaaagaaaactaatgtgtaccttccagtaattttaggaggatatttattttatgaatagaattaaatttgccctcaaagtgcttgtggcacctagaactataaacctgggtgtcagagggagcataaagaaagacttcttctgttgacataaggtaggttttagataaacacatttcctatgagataatcagtgatgtccactgagttatcgttgagtctagaattatgtttataaaacacattcagtcaagaaagagcagagaccatttaatgctggccacaggaaaacacagtgttttaattacaacaatcataaaacctgtgtccattaaagacatattctcaatatcacagctctagagagttttggtacccaattaacagtgcatctgggtgtaatcctaacctgacatatggcaggctaggactttgggtgccagtacccagagcacctggtgcatgagtgggctgtgagcaaagaaaaaggggagatactatcacaaccttttttcccaaaaaagtatttttggcagtgtataccgtattggcgtactttaatggataatatgccatatctcatgatcgtatgtaactagtaatatgatataaaacattatactggatcaactgatgaaaataatctgctccttatggacaagtggacatacttctgtgatgagtaacaggagctccatttccatagactgtttcctggcaccaaatacttaatgtgttttcactatcactttatcaaatgatattggaagtttctaatagatttgtgtgatgcctgaggtctaaaactataacaatttgtttaatgatagaaatgtatttattatatagataagtagattatattttgttgattctgtaacatttaattacatttagcagcaaagttttactttagtgtttagtatatactgtgatgatagctgttttaccgtagaatactttgataatttaatctaatctaagaaaaacctcaatctttaaaataatatgtgtgcatgtatgtagcagacatctctggtaagaaccactaaaactgtccttaaaatgttttaattaatgaaataatgaaaaatttccttagatttagacagaatattgctattttaaagtttaaagatgtgacttttttcttcatagattttgaattttgcttaaataattcaaataaatgatagctaattgctttctagggaatgtttaaaaactgttatcttataaattaattgtaaatatttgatagaaataaagcagttccatgaaattgttagcgtattttgagctgtctaaacctggaaactcagaagccaaagtaaattcctataagcaggaaaattcctaaaactctattgagaatatgcacatcctctcaagagtatctcattctagcctgtgtgctgtttacaaaccagacttgtcaaagagatgaccccagaattccagcaatggaaactaaaagccatctgtctttttacccaagacagaaaccagatgaacaggaagaactaaaaagtcttccaagtaattgctttatattaaatggcattgggtatgtattcaaaattgatctaatggcaatcaccagatatgggtaataaagtaaacatgcttgtacatatataagaatacacacacacacacacatatatataatatatatagtgagaaaaaattccgattttaggcaagaagtcacttaaagccagaattaaatctttttccaaagacagtgtaggaaggcagctaggtatgcagagttgaagtgtttgggctcaaattccaagtctaccacctattactgtgcaatgacctgtaagaagttcattgaggcagtattatctgcctgatagttttgttgtcaaaacagcagtgcctggcccatagaaagcacgatgtcagacttcaatattattcccagaagtttcaaagagagaaaatgaaatgagatactaaataacatgtggaaaaacataggctgtaggagacctcagtcccaatcaggtaagttactagttaggtgacctttgacatgttaccaaacctctcggagcctccatttccctattttaaaaattgaggtgacagtcctggatttgagaaataaggaacagatggaaagtccctatgcatgatagatattcagtattaggctacctttccccacaacactagagctatttgttaaagaccacaaaaacgtctatgttcatatatctttatggatcataaacattattctgtgtacttcttttagggtgaaaatggtttacatggtgctccaggattccctggtcaaaaggtaaagagttcttgaatgtttcatctgagttaagaattttaacgtgttaaaaataaatttgcacataatattctgaaattgtatttgattaagctgaattcactcaaagacttttagaaagctatggatgtcttttcaaagagaacttgtggaagcaatcccctcttgaagggaccattctaggaggaagctttatcacagagctttagtaacatgctcctccaaagaactaaatggtagtagtgctttctggggtccgtgatagctgctctggaaacgtttctgcttttattagtcagagtctaaaatgtaaaatagaacaaactgtactccctttgactagttttgttacctcttgcttatcttcttttttgtatatcccagatagagctaaacataatagttagaatgacataaaatattatatattacaaagatgctgtagacaactacctcttcaaaaatatttttctttcagaacaagggattcctaataagcaaggagttttgcatgggccaggctgcctcttcctgtgcctagtatctttctctttaacaagatgaacttcctttgtgcccccacttttttttttttttttttttttttgagacggagtctcgctctgtctcccaggctggagtgcagtggcgcgatcttggctcactgcaagctctgcctccgttcacgccattctcctgcctcagcctcccgaggagctgggactacaggtgcccgccaccacagccggctaatttttttttgtatttttttagtagagatggggtttcaccatgttagccaggatggtctcgatctcctgacctcgtgatccacccgcctcggcctcccaaagtgctgggattacaggcgtgagccaccacacccggccagggctgctttcttcttctgggaagaagcatggttatctgtgacaagcattactaaaaacacagagaccattatattccagtttcttggagggacggggagccacttcaggtggggccagctgtcatgataccatccagataatcccgccgcaggagagagcattattgatgtaatattagatgcccaccaaagccaagcatatcatttctgtgctctggagatgttttactggttttggcaacaacatgtcagaagttactatgcatgtaggtttttctctatagctgaaaatatcttttaaaaagatatgcacttatttatagttacagattgtgttaaagaatttatttacttggcccaataaagataataagattgaactggcagcaatgaaacggcaagcttctgaatttcttcacagcagctctagacaaaacccattaatacagcatgtactgcatctgcgagtcaagttgcaagccaagggatgtgcagatttatctgctgggaaatagttttggactttccagcagctgtttgtggtggctgcatcatgctgacattgtggctgatgtactggaggcgtttagcagcttcaatgtcagcttgaattaacagatcaagttaaagtctatattttaggaaaaatggtagaaaaaaatatagaccatgcattcagtggtgaaaaacaatacctaacaactgacatatattctttcctggtaacttttagagggtagatgaagcaaaaataattatttaattacatgcatgtaacacacacacatatattatttaatcatctaattatattatctaattatgtatactatttaattatataatcataaacatatatgcaattatgtgggtatatatatataaaaaacatactcacaaactaaatatgtatgtatacatgcatgcatgtttctatatagttaaaagctggcattccctttcatataattagtataaattttatgtaccaagggtcaccttgttgaggcattacagaaaaaattctagagatcagaaaccctctatctcctgtctctgtgcactcaggaaatgcttgctgaatgcttcttatgctccaggccctccatgggtggagagatgcacatgacctgttcccaacattcacttgctagctatgttgtcatgagtgcctgacatgtaggaggcactcagtcaacttttgttgagtgtatgaatgaaacaccagttaaggggggagataagcttgtcagatcagagagggtgtagatgaagaaagggagatgtacaccttttagtataatcatggtgattgagagccagcagccctccaaccaccaatcttctttctgtgactgagccagcatagtggacaagaagaagcatagcactggtgtcgaaggtagagccagaacccaagggttcaaacctgaactcattcatcataagacacttaccagaatggtatgccatagaagtcagctttctaagaaggctgtttccactgaatctagtaaaataaatagtaattataagaagaatggctaacttagtctttgccatgaactatgaggatgaatcaaactctcaaaacaaaccattgaggaagatagtattatcatacttattttatacctgagaaaattcaggcttatcaagattaaattgccttggaagtggtgaagctgtaacttataccctagaaaattgttcctttagtatttagaaatatttaaatcttatgtaacaatattggtttagagcttacatgttagaaatggttatttacaattactgatttttcattgtttgaaacataatttttattgtaaaaattgcatgtgttataagtatcatttttattactatacacatcatattcctcttctacagggagagcaaggttttgaaggcagcaaaggagaaactggtgaaaaggtaaatatctctttttacattcacatctgtaaaaagaaattgttcttgaaaatgttttgaaataaaatatttaacttgttttgtgcattccctataagcaattcaataattttatagacataactaaaacatttgcttccattgaggtagaataaatatattaatgattgccagaaatctttcaaaacttatttggatggtattaatagttagatatttctagttaaatttgtttcattgacatggaaatgatttaaacatttataaagcattatatttttatattatgaaatcattcactcactaagtatccaattatttaaataaatgtttgtttttatgtacaactggtttatcagtggaatttttttcctgaaggagtaaataagaacaactaactgtaaaagtcaggatcccacagaaaagacttggcatactaaaactcgaataatttcaaagagtttaataaaggcatggtttaaaaagtacggacaaggtataagaaaaccatagggattgtgcagtatcccaggtcaggttacagcagacctcttaaaccccacataattaccagacccagagacagagaaaagtgtgtggccaaggctggagacaggagctgagggtagcagtcagcccaagataagcacataaaggggaaatcagggcaataaacacctccatcccactatcctctagccctcagctctcctactagcccgcaccagccaaaccaagttgagagccagtgagaatggaggaaacctataaggctcagcctcccaaagtccagagcaggtgtataagggtggacagtggatcatgagagaccaatggcagatgccagcccactaatctaagtgctgtcatttaaagtcaccttcttacaaaactaaattctgggtgcttaattttacatgttaatagagtgttttattataataaataactactgaaagtcatttgatagtgaaaatacttaagcaatcattgttttacaaatttacaactttctattgaaagtacagagaatagaatgcttggtcatccaaaattttccttcagataatcatttgaatcctttttcatttcaaaattcttgttttgtttttaaataaaacaaaaacagtaccattcttttgtttaataactcttgtgtacatcaaatgtatgtatggaattggatggccaggagagctagaaaggagaataatctcaaattggacagtcttgcctgtattttgctttcttgccagtgatcagttgtttgctttttcaataagtatttatagagagaatgagcatctattataattataagacaaagtacacatgttacaaactacatgataattacttttcctcacagaactcagaaagaaaaaagaatggccttataataaccatacttttggagatcatttcattaaatgatgactatttttaaggtgaatatcttttcttagaaatcccttgaacatttttgctttagaataacagccatttggaaggccatgtctttaaataaatgctttatttatacatattcctgatttattaagtgggattttacctgtaggaataagtagtgaataagcctgaacagatatattctctgtaatttaaagtcaccaatacactaaagtcttagtagttgttttgatagtttatatacatagctggtatagctcaataataaatagattctcacaggttataaggcattagaaaaccattcaccgtatttggcttcaaggattttccttgtggttccacatatctattaactgttgcattcaaatagtcaatttcaccacaaggtagaaatatgtttgtagaatgatttaaatatattagaaaaaaataaagcatcaaacagaaaagacaatatgtaccttgaatgagaatcccaatttagatgatttatagtcagatataagattcatgtaataaccgttatgttactttgattggtgcaaaagtaattacattacaccaaccaagtaaaaatgatgttctgctttattatttactgtatattaaatttttgagttttttcaatgttagcatgctacatattctgacccagaaccacatgtattttttcatgagataaataattgaggtcttgtagttcactttatttctagattaaacaagaaaagtctatgaaacattcacattggtgtgacaacagcatggattactcacaacataatttattttctgaacaaagtcaatctaccttggactttaattttttgtggaaaactgagtatataatcattttttaaaaacccactttcttctttaattaccctactgtggcctttactgtgtttaatttgactgtttgagtgacaagtcaccagttgcaaaatacaattcaggacattgttattggtcagagatgtcatatcttccagaaacacatagttacggtcaaaatataaaaattacatcaactgcaaaaggtaaaatactacctgatattttcaggtgacatttctataatgcagtggaaaccaactggagtaatctgcttcttcccattatggctaaaaaaaactagctttcaggccaaccgaactcactagactgacaaagtagctcctcaaagagttgaacactctctccttagtcctgagaaaaacctgtggcactagaacaagtataaaggacctcatttaaagtatatttctgaatctatagaaacttgtaacaacagggcagagcctcatacattcctgaacaaacacaattcagccaaattagtcctgaagtgaaagttattttaaggggtagtaagttctctcagaaaggttgttggtgctgacatgactctctcagatgacagctatttgcaggtttaccatgctgtggtttatcatgtagacctataggaatgaccccatcccacttcaccatccctagctggcaaagttaggtgtgtatcacccaaggatccttgggctctccaacagcatagctcatgaggcaggagggatgaaggaccctctccacagctgagagttgtattttggcttctctctctatataggagtagtcttctggggattttccttagattccttcagtactattattatagtgcaggctgctactacaaacaaaatacggagttcaatcctcagataacagttatccccatactatctgtcagccttcccagcaatgatttcatcaaactcttgttatgtaaccaaatgtaaatgcatgaactaagctcttacattacattagaagccgtccgggaggtggggggcagcccccgcccggccagctgccccgtgcgggaggtggggggcacctctgcccggccgccccgtctgggaagtgaggagcccctctgcccggccgccaccccgtctgggaggtgtacccaacagctcattgagaacgggccatgatgacgatggcggttttgtgaaatagaaaagggggaaatgtggggaaaagaaagagagatcagattgttgctgtgtctgtgtagaaagaagtagacataggagactccattttgttctgtactaagaaaaattcttctgccttgggatgctgttaattataaccttacccccaaccccgtgctctctgaaacatgtgctgtgtccactaagggttaaatggattaagggcggtgcaagatgtgctttgttaaacagatgcttgaaggcagcatgctcgttaagagtcatcaccactccctaatctcaagtacccagggacacaaacactgtggaaggcagcagggccctctgcctaggaaaaccagagacctttgttcacatgtttatctgctgaccttccctccactattgtcctatgaccccgccaaatccccctctctgagaaacacccaagaatgatcaataaatactaaaaaaattaaaaaaaaaaaaaagaaaaaggccatttagcaaggattcattcacgtgctcttcactccttaaccctgagctcaagtttttactttatgtccttgtgaaggtagaaatattacttggttacatttatgaaaagaaacagcaaatagacaatgaaatgtaaacatctgcctcattataccattcaatatttttaagtaattgcttcaaatcatgtaatttagtttgcttttaaaatgatgattattttatgttgtcactcaagttctaacttgaagtttgagaactaattttctcaaagttaaacttaactgcagaacctattgctaaatatcatttgattgtgagaaacatccagtggcaactgctacttataccttacttttcttgatttattacctaaaatgtagtcgacttggttcactgaatagtgatgtttaacttgggcatatatggtggcagattcttacctggatctaagatgcttctgctggtgtggaaattttccatttgggaaatgaaagttttctggtctcttgagggcctcttaagtttgataaaaagaaaaaaacaatcaaatgagcacttcttcgtgaatcataagactgaaggagaggtggagagcatcaaacatgtggcatattctgcagctgtgagagtccatggttgagcaagttcttgctttctcttgtttaggcttctgggcattatctactttgataatctttattgctgatcttttcttccattctgggttatactaataacaataaatgcaaacacaaaactaacaagttcatatggtccctgctttaactcatctcttaaaaccattgttggaaaactagttgtaaatttccagtgacttgtgattttttttattgtcttcttcttaccaaaatataatctaggtcctaaaatgccatatgagatatgtatttaaattagaaaactgtgtttaaatatttattactctggttttatagtggttgcaaatattttttaccagacagaatccactggaaaaacattccacagacccgtattcttagttgatttattgaactctatattgttataaaattccgtacaaaatataatattcaaatgaatacaattatttaaatgtctactataacgtagcgtaaagtacacgtagcgtaaagtacactttgctacccacaaactatctggggttatttataataaagtcatgcatcaaaacatttgtatttcttttatcaccagtcaacatcagctaattttcagatgacataattcaaatttttgtaagccagcctaaaatagaatatatttaggcttggtgctgattgtattagtattgattttattagcactaattttatatgccaccttttgccttcagtggttacttttgaagatgtgatgggggaatggaaaatgcttaatagaaaatgtcttcacttatctatttcataggttaatcattgatattgttttcttatcaaatgaatattaaaaatagcagcagtgaattcattcttgttattctgttgcttttttgttttcagcattaaaaatatatcagcaattatgatatgtctcatatagtcctaggctcataagcttgttggataatttatttggtagcattttgttcatttatttcagatagatagatttaacttttatatttaacttgtaacagcagaaattagataatcagactatttttatactagtaccacaaataaataatgtcacctgcaagcaactttctaaaatattgacttctagcattaaatgtcatgaaattatagtaactcagaaaatcaatagtgatcatttgctactagaaacaacagttatggctttaaataaatgaggatttttaccctgaaaaatctttttacttttgtcaatttctcattcagttgttatggtaattacatgcaggacatgagaatttgaatgagtggttgtgactttgggccacttaaaatttggtattgagtgagaaaaagcccaaataaggatgtttatataatatacgtaaacgattattcaggacattctggggcagcatctagatcactcaacaaggaatcaacattcttagtttctggagtaccactcctgaaagagcctagacttgatgtttattttgaaagtgatggtgacatatcgtaaaataaatggattcacatatttttgtgttctgtgttccagtccagctctgtaatggcagctgtgtgaacttggatatgttcctagctttctttatcatagtttcctcttttataaaataaagttaattactacctcacagaatgactgcaggaattaaatgagtgccggtgaataaaagatgttcaataaatgttaatatcctcagcagccaatatacaaaagtaatataaaatcttaatattttgacaaaaatttatttgacagaattattatatatctttatttgtgtaatattaattcctaatttttcttgtgaataagtaaataaaagacaggaggctatagtagttagctactgatatgtgacaaatcaccccaaaacgtagtgacttaaaacgttcatttatttagcttgtgattatatggtttagaaatttacactaggcttagctcagtgatttttttttgtcttagttgatcttatctacgttcattcatacaattcgcctgtgttatcggcaggttgtgcatccagggactatgcatctgtggattcacccaaccatgaatcaaaaataaatattgagaaataaaaattaaaaataacaatacaacaataacaaataatacaaataaaaaacaatataatctaacaactatttacatagcatttacattgtgttaggtattataagtaaactagagattatttaaagtatatgggaggatatatgcaaatactacttccttttttataagggacttgagcatccatggactttgttatcagcagggatcctggaaccaatccccagcagattctggggcaagagtgtgtatctcttctcagttgccaggttggctgagggtggctgggctagtttggcctctgctagacaacatgtctccactccagatgatctctcatcttccaacagttatcctggacttgtcctcaaggtgaaggcagggatccaaaaagaggaagcagaagcatataaagcctctttagcctccttgctcagaactagcttgcccccacctccatcaccaccatgttctactggccaaagccagtctcaaacccagcctagattcaaggagtaggaaaatagattccacctcctgatgagagaagctgcacggacacattgcctagggtgtaaatatatggagaggtgaaaaaaggggccattttataataaatctaacacaaatgatataaaattttattttaaattaacagtagagtagaaagattaaacagatttatcaactttacttcatttttttccttctcccatggcctaaaatataattcttaaagttaggtttatatagtgggacttgcagactgtgtcaaaacatattttgaatttgaaatggtagaaatactttatatgtaataggaaaatattattttaaaaatcttaattagaatgggaaaaaagaaacacaatatatcaaataattaaaccaaggaatggttttgtacttttacatagcaaaatgtacttattaactttatctaaactaaaactgatacaagaataaatggaaaaaacaagtcaaagttgaaatttttttttaggatttcatgattaaagcttcttggtgattatgcctattatttaaaactaatgcaagtatgttaaatactgctattataaatatagcactttcccttcatcactctaaagcaactgtctacatgttaccttacttcccgtgaattctgtcttggttcaccttgcagagttctactgaacatcagcgtgttatacaattgtttcctttaccctagtaacatgtaaactaaacttctacaatttttaggaaggacttacttgtttgatttgacagctgacttaaaaaataaagagaacagatggagcaaaataataactatgattttaaaaatcatagcaatttatctgtggccaatgataattggtatgggagtaaccatgccaactttcaattatccatggtagcaggcaattgggaaagagtgatggtaatcccacagccaagccagaggcttaatgctagtcattacagattgtgtattattttcctaattccttacagtgctcgtgaataactctaatttatgtgaaatatgtttaaccctctgttgttgcatcacttgctagtagttatagaaaaagtaaaatgtccagagagagagagaaagagagagaaataagaggagaataactataaagggctataatattttatgaacattagtcttttaaagtattattttaatgattgcataatatttcactatataaatacgtaatattttatgtgagcattcccttgttgttagaaatttaagaacatctgttaaatgtgttttcttatttgtgtcactggtgactttagcaaaataattttgatggaatagagagtagaagccaggttggagtttcctgaagagttaaattacaggtgaccgataaagaggccatgcagaaaaaccctcacgagaactagctgtgaagaggacaacagccataggacagtagctggagagggtgtgagtcatttaagaagactttattccaaaatccaaagccatcataaggtccttggcaggaaatattcttgaacaagttaggacccaaaagaaaaacacggactagttcactaatacagagaattccaaacgttttatacttcctaagaaatgtcagactttaggccatcatttttaaggaattcccactaaaatcaagactaagacaaaggtgtaactgctattatttaacaatattctggaatttctgaccaatgtcaattttacttccaaattatagtttaaatctgtctatttctctccatctaccccagtgtcaccaaaccgtaatcattagtcacctcctagttaatctccctgttctcactctttctcattcattttccaaattatggtcagatgcatctttacaaaactattcatgtggcttctattttaaaaacattttagttgtttcccattaggttaaaatcctgaatcccacaaggtcctgcaaagttggacgtagatgtgcttctcagaactcatctcttcccacattccccttttctgcttctattccagccacactgaccttctttcagttacttgaatgtgccaggcgctctcctgactcacagttgtccatcagtgtccccactgctttgaatattttccccttcatttagcttccctctatccacttagcacatcttaaaagtcattttcttggaggcttccttgactctccaatcaaaatctgctccttctgttataatttctcattgtacctttagcactatactgcacctgtatagcatttaccacaatttataattataaatatactggcatgaggattttgtttgtctgtttttctttctccaatagagtagaagcttcaagaaaacaacgaccatgtctgtctgtgtacgtttttatctctaacacctagttgaatgcctagcacacaaaagtattcaattaattcattctttactgtggggaagtattatagagaaagttaagtagtgtttcttttcagcctccagaagtatttaataattattatcttgatgcattcaattcagtatcaaccctatttttttcagactcctactattgaatttgtgagatatagctagggataaaaattaattttacatgtatggcccttagaattgtgtttaaaaagacaatatataaaacattaatatatttaatagtatgctaaaatttacacaggaaatattgtttaacctagtatatttccaatttttattatttgtgaatcacattgccttttggcaggcactatttagctcataattctataaaataaaatacagttcttttaataccagatattgcaatgtcttttgaatttagtagtaatgttaaaggttgtctactggctcctgtatcataattttactttccaattacagtggaattttgggctgttgactgtagtgaacctaggttagttttgttaaggaaatttattcactcaatattttatgtaatttaagtacaaataaatatgaaagtttggggtcacataagaaagaataaatagaaaaaccatgatcctcatttatgtaatgattaaggcaacttgacttttagtagtttctccttagtcagtgctgggtataaaagggtggttttacaatgtgcctacattttgcttttattttgacctttactccatttatcctatttcttcactccaggctctggagctgcctcaggtttctactcttagcttttggtcttccctttctcctttctcaggatctgcctgtgccatagactccacttcctctgctctctgctgggctccttgtcctcagctgctcattaatctcttcacccccactgctttctttttcatttgtttgacttacctcccatcaagcctgatttccacttcaggttactttctttcattttttcgcatatttttgtattcaaaaacaaggaatagatctcttaggcagtccctcaccacgactgaccctgagcatttctgaatgcagctgagtttaaattgagtaaaggcaactctcacatttgttatgaggtttatacacacagggtttttaatgtataaaaaaaagatgtgtttttttaaattaagaaaaacagaatagatttaaaaatcaagcaatttcttctgcttaatacaatcatcaaatatccataatttctaactgtttttagtaaatctcaattaataaatatgctttattaacaaaaatctcttttttggaagtacattccagatggtaaaaagataattaattcgatgtcaccaaatattacatgacaggtgtgttatttttattcaggagctaccggcatgtgaacttctttcacaatcaatgtaaaagcaattcactgtataggaattgctgaacaagtgtgtcctaccagaccgaaatagcagaattccactgcacagaaaacagaggtgttagtgcagctgctgttccaagtggatgttgtacagtgactagctgttttgtaagttattgtctaggcttatggtggtctattgcttcttagtctaatatcttaaaaaaaatcattggtttttattttccttgatatccttgatatttccttacaatctcctttaagaacctccccatcaatgatctgttctaatatcagtaaaggatcaatgaaacaagacagaaatcaaataatcaatttgctttgtcttttttcacttttccttattgttcctcattttctgctgctaatcattttgtgtaatcaaaactcaaggcaaaatggtaaagcgataatgctttgggcaaacattttgtggaatgttattttaattgcctgcacttgtccagccctggggaggagtgtggcaatgcagatggcttcagctggctgtattccaggaactcactgatagtgattctgcctcccacttaaggtttacttatgtgtacaaatgaatcatgcagttcatgtcttggtaagaactacaaggctggagcacatgatagcacccagtaatcacagagcgaatcaaggattcttccttaagttagtggaaagttaggaagttatctaaattgactttattcctttatccggattttgacaggtggcccaccattatcattaatgtttataacagacaattctaagttctttattttaagccaaaatttgttccgtattattttgaccaatctaatttatcccagttctaatctttcagaccagtgttttctctgattatatgttcttgcaaatgaatgactgaccatcttttggagagtttaagacagcttccttttttttttttttttttttttttgagacggagtcttgctctgttgcccaggctggagtgcagtggagcgatctaggctcactgcaagctccacctcccgagttcgcgccattttcctgcctcagcctcccgagtagctgggactacaggtgcctgccaccacacccggctaatttttttgtatttttagtggagacagggtttcaccatgctagccaggatggtgctgagctcctgacctcgtgatccacctgtctcggcctcccaaagtgctgggattataggcgtgagccaccgcacccagccaagacagcttcttaaactgtctcctaaacatgaagatgcattctcctgaacattttcatgtaagtatctcagttttgagcaagtgtttcactgtgcttcatggatcactgctaatggatcccttgtcttcctcataaccttcatcttgtaatgttataactcatcagtgtactgttagtgtaatgctcagacatggacagaattattctagcactttgagcagtcattcatataggcagtttaatataatgaaggcatttggattttgtggagctgagtcctcatcctggctcctggacagctcaagttatccatggctatttcaatgtcttcacctgtgaaagagacagtgaggctagattaggcctagaatcacacatgtttagagctagagtgaatctgagaatatatagagtttataatactgtcaggtggttgttttcttgagtcacaatataagcatttacatgtatacgtgctgcctttattctggggatttaagcctgatgtttctgtttgttaacgttaaacttttgattctggcaggtattacaatggtaaccttttatcagctctgtagacatgaattctaggtccttgaattttgtagatatgaattctaggccttgagtagctaatataaatattgaataagacatgaccagaacacagcactgtgacacaccactggagttctctttttaggggtgatggcctaatagaaatgaaggtagaatgagcgtatttatttaactacctattatttacctcactaaaatttaaccaacatttatcaaacacatcctaagaaactttattaaatgtcttactgaattaaataaaccaaactcataacacatggtttttgttttctgacatggtattgcctattgataatcatcttattcttaactaagagtttaaaaccaatttgtttaataattaaatctagaattttgctaggaatcagtatgaaacttactcatcattcatgtatattttttaaatgagcaagcattagtgtgtctaggcctttccttctccaagattctcagagattcatctcagtggctaatttccatgagctcttagttatctgcccttaatctgtcctctcctatcttaacgtctgtcttggtctcaagagtggttatctagaattaatgaattaaaaggccttcaatttattttcaaagtagtttgatgccgactataatccaatatgatactgtatccctttgaaacatatgctgggttttggaatatatttgtttattcaatcatccatttatttgatcatttaggacccattttttaccagatactgtgttcagcactagggtagcagatatgaaagagacaaaacatcctttcagagagtagatatgaaatgcttgatggtgttttgtataggacctgtgggaaggaagaggagtgagtacataacgctccctaggagaaggaggggagtttgattaagattctttagtgagtcctgaagcataggtaagagttctccagaacacggaagaggcaaatgaaacagttcattgtaaggtttagagtaagaacaaagtatgagatgtttaaggaaccacatggagtgtcttgagtgacaaaaagaaaaccagtgaccaccagagaaaaaaacaaaaggacttttaaaaaattcctgagtcatagtttcaggcaaaacactcaagggagacaattgccaggaaataacatcaagaggatgcctctgagcattcaggtgatgtcatgtttagctcactcttccctggtagggaataccacctgaccaaaagcttgagggaatcctcttactagaagacccatctgaagccgccagacaaaggattagaggctgatgtccctttgagtcagtgtggcgattcctcagggatctagaaccagaaataccgtttgacccagccatcccattactgggtatatactcaaaggattataaatcatgctgctataaagacacatgcgcacgtatgtttattgcggcactattcacaatagcaaacacttagaaccaacccaaatgtccaacaatgatagactggattaagaaaatgtagcgcatatacaccatgcaatactatgcagccataaaaaatgatgagttcatgtcctttgtagggacatggatgaagctggaaaccatcattctcagcaaactatctcaaggacaaaaagccaaacaccatatgttctcactcataggtgggagttgaacaatgagaacacatggacacagggaggggaacatcacacacccgggactgttgtggggtggggggaggggggaggggggagcgatagcattaggagatatacctgatgctaaatgacaagttaatgggtgcagcacaccaacatggcacatgtatacatatgtaacaaacctgcacattgtgcacatgtaccctaaaacttaaagtataataataataaacttaaaaaaaaaaaagaaaggttcaggctggcttaggtaacaatttaattaaactttttgcttggcatttcccaggaatttctgaaactttctatttttattattcttgcaatttatagaaactgaacatttcaatccagtggaggataatagatgtggcctctatctaggtttattttgctagttaagttcctgaagcaacttaatccaaatattttattttgtccttaattaagaaagaaaagaaagaacatgaaatgtagccatttctttcatgaatcaaacaagatttaatatttgatcatcaagaataagtggtaagtttcttgctttacctgctaataaatggccatggtcatattgaaaaaaaaaattttactgatctaaatttcaataatttactagccagaaacacagtctcttgctgtgatcttgctcctcaaattgtcacaagaatccccagagattctatatgtgttacctctgtgaactgatcagtatgtgagtcaacagcaggccttgctatcattccctcctgattcctgagaagaggagtaagaaatttcaggtataatttgagctggcacctgaaacttttgctatatctctagttaggttgaagtatagctgttgccagatacacgtatacatatagatacatatacatacatatatagagagagagaaagagagagaaagagagacagacacagagataaagagataatgttttgcattttatccaatagataattttttatacgttcatggaacagtttgaaaaatttatgattctttggacaaaaaaaataaaaaactcaccttaagttgaaaagtagacattttgtaagactcattccttgatataaagaataataaagaaaccaatacatgaagaaaacagtcctcaataaccccggaaccaaagagttaatgaaaaggaaaattcataaaaatcaatgcacaagaaaaatactttatataaaacatatggaccatatcaaaagctataatgaaggtgaaaatacatagtgtcaaatctggttattataaagaagaaaatataaaaataatgaaaatatgcttttatcttatataataataataaatagccccgaaacaaaatagtagatgggaattaataaatatggtcactaaaatcaatgaaacagaaaattttaaaaattgtagaagggacaaacaaatcaaacacctgatttaataaatgactaagaaaatgaatacacaaagaattaaattattctattaaggaaacagaaaatagaaaaaagacaagctagaaataagaaaaaaaaatgaccacagatagtagatggacttaaagaattctgagactattgttatatgtgtaatttgaaagaaacaaaaatttgatcacctagagaaaatggatgatttcctcaaaaaatataaaaaattgaccaagaataactggaaaatatgactacactaattactgtggaagaaattggagaggtgattcaaaatctaccattgaataaagcaccaggactaattgggtttttcagcagggttttatgtagccagtgttattttaactattctaggctaaaggaaagatccacagcctccaagaagtcagcataatgttaatactaaatctaattttttaaatataactatattttatttattgttatagatacaagtatttttaaataaatattaccaaacagaattcaaccattcagcaaaagaaaaatcaagtaggataatactatgaagtcaaggtggattcatgttaagaagttatatatatcaacataatacatcagccaattaaagcataaaagttaaatgattatatcagtagatgctgaagcttttgataatatgcaatattcattcctaataagatcttcaagtaaaataggaattgatgaaatatttttactaaaagccagcagcaaatactattcttaaaaagggcaaaaatagattagaaatgaaatatgcagaatttagacttaaggagataaaattgccataaccattacttcacaagaaaattaagtaacctatgtagcactagaaaaaagagataaactacctttttttactaatgagttgactctataggtagaaaatctaagagactttgggagaaaatttagaatttagataccagggatatatttaaaaaacaatagattttgtttattttagccttaaacatctaggaatgtaatgggaaatattccattaatataagtggtaaaagcaataagaattttggaaaaatatgaataagaaagggacaagatgtatacaaacaaaatcaaagggcgtaaaataaaatctaaatgaatgtatgtagatacaccattttctttaaaattataaccttaaaagttcagtaattcaaaattaatacgtaaatgtaatgcaatacaaacaggaattccaacatgttttaaattttgtcttgaagttggtaaaattttttaaagtttatatgaacaaataaataactaaaaatagtcaaaaattttttgagaaagagaaatgtagtaatttagaaatttagggtgaacttgctttaccagacatcataacattctataatgtcatagtaacaaaataaatattgcatcatgtagaataaagatagatagactaaacctgagaatctagaaactggcctcagaagttatgtgaagttaatttaataacttttgtatttttattcagttattcagttgaaaggatgggttattccacaggtgcattggcactaccgagtctatccacgaaaaactattttataccctatataaaaataaatgccagatagatgaaggacttatataaaaatcaaaacaaagcaataaatactttacatttgtgtaatccaggattaagtgtatatctaaccaagatttgaaacccagggactgtaaagtaaaagatagacatattagacatataaaaattaaatgtttcagtggtaaagtcataatcgaaatcaagtaggaaataattgttctgataaaatataattaataggtgaccagttaacatttgtacgttccaaagagtttttaaaagctgagaaaagacaactcaatatttgaaaatggacaaaatgtgtgaataggcagctcgctaaagagaaaaattctaatgctagtaaacatgtgtaaggctcagattcactggtagtcagtgatatgtaatgtaaagcaattatgagatttggctttacagccattagcctgccacctgttgctggatgtgattcaaggacaaaggcattcccatacattgctggtggtaagtgtagagctacagtctcttttagaaagcaactgggtaatatctattcaaaaatgaaaaaaatgcataatctttttacctagaaatcaccttcttgaaaatctgacttatataaatatattacatgcatgtgatggcctttattttttaagtggtataagctttaatacaactcctaacacaaattctgttaaattcaaacatttgctgggttcctagaacagtgctcacagagttggcacacaaatgttataacatagtattacttgttaggtatacaaaaaacaaaccatacagagtttttgccaatgtggaatataatggtgttttgtaggggcagaaaactggaactgagtgagtgtcattaacaagaaaacacctgaatacattatggaacatctatatcatagagtattatagaactactgaataaattaggattctgctgggtaatctaaattgatatgtagaatgtgatgatgagggagaaaataaaaaatgcagaaaaatgtatataatataaccaatttttaaaacaaaagtgattaaaatcctgattgtgcctgtatgtatgtgtgcatctattgtaacttatgatgacataagtttggagtaaaaatttggaaaaatacttacaaacttaaaagttaataacaaaagtctggcatccagaaaaggagtaaaagaaattaaaaagtgagaggagagtatgatttattgtcttacttcagaacttacattatattatatatattcttcatatttaaaaaaacatttaacattcataaattttgtatgtgttttatatttataaacttttaaatttataaatgttatattcataaaatataggtataaatatatatcacattacatacatagatacatgcattgcatatgttcccttgcccatgccaagtcttgcaaagaaaacattttaaaatctgtcctaaaatatatgtttcatgtatttaaggatttatataaaattacaaatatattttaggtaattttttaatttcaagaaaagcacaagagaaatggattaaagataggaaaagcagcaaagtagctgctacaataatacacaaatgaaatgaccaaggagcatgacaaacataatgccaggattgttgccatcattgttgccatcatagcaatgacaatgtgaggatcatggtggaagcagcagcaatttaagaacaaaaatgaagatatagaaagaaaaaaagagggggagttaagaagaataattctgttctgatgcattggtctatttgtctacacttttttatttttattttcattttttgagatggagtcttgctctgtctcccaggctggagtgcagtggcacagtctcagctcactgctacctctgtctcccaggctggagtgcagtggcacagtctcagctcactgctacctccgcctcccaggtcaagcgattttcctgcctcagcctccccagtagctaggattacaggcacctgccgccacacccgactaatttttgcatttttagtggagatggggtttcactatgttggccaggctggtcttgaactcctgacctcgtgatccacctgcctcggcctcccacagtgctgggattacaggggtgagccactgcacctggcctacacttttaacaatacaatattgccaaaatattatagctgatgtttatagtgagtatttagtagggaaaattcctcaccaggctctttaagattatcttgggtatcctagaaccttggcattttcatatcaattttaaaatcaacatgcccggccaggagcagtggctcacgcctgtaatcccagcactttgggaggccgagacgggcagatcacgacgtcaggagatcgagaccatcctagccaacacagtgaaaccccgtctctactaaaaatacaaaaaattagccgggcttggtggtgggcgcctgtagtcccagctactcaggaggctgaggcaggagaatggcgtgaacccgggaggcagagcttgcagtgagccaagatcttgccactgcaccccagcctgagcaacagagcgagactctgtctcaaaaataaataaataaataaataaataaataaataaataaataaataaatataaaataaaatcaacatgccaatttccacacttacatacacacaacttgctgagattttgaatgaattttctttcaatctatagatgtttgggaggaatttaccttgcaatagtatagagtcatccaatccataatatatctatttatttaggtttcctgtattgcctgtaagtaatgtattttaattttcactgtagagttcttacataattttcgttagatttatgactaggtatttgacgtttttgatgctattttgaatacttttaaattttaacttccaattgcttctagtatatcaaaatacattgatttttgtttattgacctgtgtctggccaccttgctttattaactaattaattctaatagttcacagactaccatgcaatttgtgaataaatttctacttctctttacaaatcttatttcttggattttttttcttgccatattttactgactaggacctccactacaatattgaaaagaagtggttatagtgtacattcttgttctttttctaaatttaaggggaaagaattcaatattttatcactaagtatgctgtaggcttttgtagagaccctttcttagaatatgaatattgagaatataatttgctgaattttctttgaatactattcaaatattgaacttaaaaatgctttttccacatctgatgagatggtaatataattttctttctattctgttaatgtggtgaattataatgattgattttcaaatgctaaactacccttggattcctagaataaaattcatttgttaagaatgcataattttttctgtgtataagtggattcaatttgctactatcatgattaggatttttgcacctatgtttataaaaatttaagatttttttttctggtcattttctggtcaaactttgctatcagagttatgctaggatcataaaatgagttgaatactgaataaccccttttcttgtttccagaaggagtatgtgtaatatctgtattaatgtttccttaagtgtttttaagaattcaccaaaaagccacagggtctgaaggtttctttgtgaaagatttttacattatgggtttaattatttattttgattgctttgtttatgtttctcctgaaaatttgaaatttttgctccagtggttataaggagaactacataaaatatagtgaagtttctatttctgcagtcagtgtctattgatttccttccctagaatggctgaattaacatatttccacttcttccatccctgccactctctgatgtcaatgaatgacatatttttagttttaccttggtattgttaatatgcttatctttgttacgtattttggttttaaaggcaacttaagttgattttaaagacaatcttttaacacctcactacaaaagataatggacttaaactacccattattgccaccctctttcctctccttccttctaatttttgtcagatatataattttagcattttttggtattcataatatttacatcctgttcttaagtcgcaagccctaatttttatcttatttttagtcttgtagctaaatgaaacctatgttcattgtcaatcttttgcctgaagtttctgtatcattctcttggttggctgatgtttgcctcctagttttttcacaaaaagttaatgagaaatatatatgcgaaggacatggaagtcccccaaactttgctttcactttatactttaatgacaatttagctgtgtttatagttcttgaaagattatttgtttccttggggacattttagccattagtcttctatcattgagtgtttgaatgttgctcgggagttatctgagattagccagcctaaaacctatttccataggagattgataattttcttcattttaaagaaataattaatgcaaatgtaataaccaaatgtgtaatttaagagctgcatttaagaactggtaacatttgaagaaaaaacattaggtttaatttgggtaggttcaaaatgtctccctacccacttgtagttgggatcagaatacaaagtacacctcaaaacatgtcttttaagggaagaattgtttccttgggtaagataaaacttgaaactgaattcctcactattgaaattttaatagtacaaggttaaaaatggcattcaatatgagttttgttgtgtgggatggttttggaatctttaactgaataattccatttgtttaagtagtgaggtactaactttcagaggaagagactttaagagaatcagttgaaaatgactaatgccaaacatgaaagcagcatcatcatttctttactcattcctcagaagagaaacacccttactgccatccagaggtctatggtccagtggcgagttcagcaacattagcaaagggggtgaaggatgagagatgactcagagacttttcagtcaggtctattgaagagatagcttaatcaggaaaattaggaccactttaaaatgagtatcaagagtggaaagtagagacatgctaataagaagataggacttctgaaaaaaaaagtagctgagtatatatgcaaacagccaggaccctggaacctaagtttccttcaccattactgaacgttttcaaaaattccttaaacttctatttctttgtctaaaaaactgtgaaaattttccttatttcaaaactttgctcagaaatgtctctcctgagagtctttgaaagtttagggcatttaaaaatgcatattattaattttactgagttaatagccattatagtctagtagtgtgtgtaatatatatcaggggacatcttaaaaggcatattatcataaaatgcatatttaaggactttccacctacataaattgaacttaatagattataacaagtctagtgggcccattagggtctttggaaaatacagttcagggccttgttaaaacatatattcttcatgtcatattctacttaaggagcttgcttcagtaacctagaatttgaatatgtttgtcttgcttagtcatgaaaaatgaaaataaagaactctttctttttcagtaagacagtctacaaagtcaggaagaaagcaaattttgccgctaattacattgtttttagtttcaaataacatacatagaaaagtgtcaattaaaataatagctgccagtaaaatgttaaatgacttacacgttttatatatatatatatatatatatatatatatacacacacacatatatatatattaatcctccttttataagtcagaaatgtgagggattatatgtttcagtttaagctgaggttattgattgttagttaccaatggatatacttcaatgagaagcattgggtataaattatgtccagtgtttctcataacgtgatctgaaaaaccacctacatcacaatctcgtgggtgcttaaaatgcctgtttctgagcctcattcctgatcccctggatcagaagtctaggcatgtgccttgggaatttgcattttaataaactctcttagagatggttgcataacaactaaagtttgagagcagttattttaatgtgcaaacctatacacataatgtactaaatatgtgaagccctatctagaacgaacttctgggcatatatactttgaccgcagagtttatactacaattccttaaactttcttcaagtaatgcttattttgaaaccagttctggtctccagtgcccaacttggtcttatttagaaagccactgagctttctggctctaagactgagacatggagctctaactttgtagctgcaattggaaaatgcattaataagatatttgagtgcaattgcccattagaaattctatttctaagattttggatactttttgtattttgtttcattttgtgttgtgttgtgttgtgttgtttgagacagtctcactctgtcacccgggctggagtgcagcagagaaaacacagctcactgcagccttgacctcttgggctcaagagatcctcccacctcagcctcccgagtagctgggactacaggcatgacttttgatattccttaaaaatctttttttgttgttgttcaaaatcaagaggcatcatcccaaaggtgtccactcaaggcctatggatattcagcaatgataactgactcttatctgcagcacatcactagctacaccaacacaaaacaaaacacagcaaaataaaatccttctgtcatgttcatttatcctacagtcttcctcaaagtggaattataaaaaatggaattttattatttactaataactctatgtctaaatttgtttttcctgttttctcattttacaagtgcaaacattatcctcttgactcagtgaaaattagacttattcttgacccagacatacggctatactgaaggaaaattcatcattggctactgagaaggatcaactctgatagctgaaataaatttgaaacaaatctcacactagagacttgaaagtccttaaaacgattgcttggtttcacaaacaacactgtgtttttaacatatagaatcggctagaggtccttatgtgcttgtgaaattttccaaatgtgaaagacataagcaccaccgtttgtatcacagctctttctttcactggcttctaggacttgaatctaacaaaatacctcccagctgtgcttaactgccttgtggggttggttcttgattgttggtaaggattccctgccatgcttacttgggagcctcctaacattcttccttctcctggagagagcccctaatggaatggagttcttaataccagaaaattgcctagaaaatttactcaagtagtgggctttctcaacccagggttacagtaaaagggaaatgtgaaaagtttagaattaagtatgaacatctagttctgacatgggaggaataaactgagtacagcatgtaagaaagataattatttggacccttaaagctttaaaccaaatactctgactcatacaggttctggaaaagactcaaaaatggttcactattgaccctgctgtaagaaacagatctttattttgttttttaaagaagttttaaacaccagattcgaaatgacttaaatatgcaaaagtgcagcattattaccattttctttccccattcttatatgttcattctctaactgcagcctcatcagtggtttactacaccaaaggcagtgaaaaggttacatgtcatttcctgtactcctcatattcactagatttgactataaattccatagtgaattacagcaccaccattattaaagtaatataggccaaaagataagcattacttagtgtgcttagtgcttaggattttgcatgaagtatctgaaaagggtcttctgccctccaccatatgtgggcttttaatagttggcttttccttattagttcccagatgagaaattaataaaacaaatgatcgttgctactgataaataaatgctataccggaatcatttgggaaatcactactgcttatgaaaagacttctagcacctcttatacctttccatgtatcagacaagaaagtttactgagttctgtgctagatgctctggtggaataaaaaggaactagaaaacaacacccacgtgttaagagactgataataccgttggagattcaaaacaaacctcttcccctcctccctcagcagtctcaacttgtcttatcagttcaatcatcatctctcaagaggatggttcctaaatctataacctaaacctgatatctttcctggagtctggtctactttacccaactacctgttagacatctcctcctggatgtcccatttattcctttggttcagcatgttcaaaacaaaacccttctgctttcctttcacatctgcttttcttcctgcatttgctcttttctatttgtgctgataacatcaccatccttctgggctttgcacaggtctgaaacctgtaatttttatgaactcttgcttctcccctcttttcctgtcacatctcatttctcatagccgcccttctttttcagccccatggcatttccctaagttctggctttccttgcctttgcctagattgttggaataggtttctaagtaaattacataccgctaagttttttacccactaattttttcctacataactagctccattactctccaaaaagtacaatgccggggttctactcaaaaagagtcagtgcctcctcaatggctaaaagagcatgtccagacatccctaacttgcccttcgtggtttctacaacctgattctgcctgcctttccaatttagtttcatagaattttcctttttcggaatcctgtgctttacctaaagcaagtaacttgctaatccatatatttgtgccttttcttttacttttcccttgttctagaataacgtccctctatttcttttgatgtagatcaagcttgtcccaaccacggcctagaacagctttgaatgtgactcaacacaaattcgtaaactaacataatgagagttttttacttttttttttttttttgctcatcagctattgttagtgttagtgtattttatgtgtggcccaagataattcttcttccaatgtggcccagggaaggcaaaagattggacaccactgatctagatcctacctaaaacatggaaacttgctcaatagccacagaattagactaaaatttaagagccaatttctagaacagaatggtctaggttcaaaccctggctctcccactttactatgtcaaaatactttaccttcctctactttagtttcctcatctctaaagcagagtagtagtacctaatccctagtgctatgatgaggtaaatgagttaaagctcttagactaatgtttcatgtctataagatcttatataaatgctagacttcaattgtgaatgagtaatttttgccttcatttctagagctttatcttgttaagaaaattctcattgcatatcaaaaagcttaataatgaatgtgtacaaatgatgtatctctttatttgtgagcatgtgaagtacccacttataaagactctggtcctaggcataataaaaaattgttagtatggacaatttcaaataaacacaaaagtgtgcagaataaaatattgaacacctgtatatacttcagctgtcttcaattcacagccaatcttgtttcacttagactccatcttgtattattttgaggcaatcccagtcagcatatgtttcagctattaacagttcagtctgtatctgtaaatgataaggcttttgtttttacataatcattatttcattataacacttaaaatttttaaacataactttttaatatcattaagtagtcatttggtgttcaaatttccaatagtatcataaaatcataattttcgttaacaatttgctgtagtcaggatccaaataagataggcacattctagttggttgctgtgcttttgatggtctcttgatctataattttcctccccctctctgtcattttgtttgttttattacattatttgttaaagaatcggggttgtttgtcctgaagaatcttccatagcctggatttgccaactgcagtttcatggtgtactttaatatgttcctctctcctctgtgtttcctttaaagggtggttagatcagtttaggtgtgatgtttttagcaagactacttcataaattgtatggtggtgtgtgccaagagccacataatgtctgaaaatctttctttttgtgatgattgcagccattgatcatcaatatctaggccaattaattcattcagggtcacaaaatggtgatttcttaaaaggatttattcaattttaactttttcttcctttttctgacttctattttaggtttggggggtacatggcaggtttgttacatgagtaaattgtgtgtcacaggggtttggtgtacagattattttgtgacccaggtaatcagcctaatacctgatagatagttttgttattctgatcctcctcccactctctatcctcaagtagaccttggtgtctgttattcccttttttgggtctatgtgtactcagtgtttggctcccactaataagtgagaatgtgcagtatttggttttatgttcctatgttaattcacttaggataatggactctagctccatccatgttgctgcaaagggcatgatctcattcttttttataactgtgtagtattccatggtgtgtatgtagctcattttctttatccagtccacttggatgggcagttaggttgattccatgtctttgctattgtgaatactgctgtgatgaatatatgcatgcatgtgtctttatgatagaataatttatattcctttaagtatatacccagtaatgagattgctgggtctaatggtagtttgtgttctctgagaaatctccaaactgcttttcacagtggctgaaatagtttacattcttaccagcagtgtataaacatttccttttatctgcaaccttgccaacatctgttattttttgacattttaataatagccatcctgattggtgtgagatggtttcttattatggttttgatttacatctctctgatgatgagtggtgttgagcattttttaatatgcttgttggcctcatgtatgtattcttttaagaagtgtcctgttcacgtcttttgcccattttttaatggggttatttggtatttacttgtccacttgtttaactttcttatagattccgggtcttagacttttgtcagctgcatagtttacaaatattttctcccattctgtatgttgtctgtttactctgtgaatagtattttttgtttgttttttgctgtgcagaggctgtttagtttaattagatcatatttgtcaatttctgttttcattacaattgcttttgtcatcttcatcatgaaatctttgccagggctgatgtctagaatggtattttctaggttatcttccagggtttttacagttttaggttttatatttaagtctttaattcatcttaagttgatttttatatatggtgaaaggaaagggtccagtttcaatcttctgcatatggctagccagttatgccagcatcatttattgaatgagtcctttccccattgcttgttttcgtaagccttgtcgaaaatcagatggttgtaggtatgcatctttatttctgggttctctaacctgttccgttggtctatgtgcttgtttttgtaccagtgccatactgaacttgtagtatagtttgaagtcaggaagtgtgatgcctccaactttgttctttttgcctaggattgctttggctaccaaggctcttttttggttccatatgaattttagaatgtttttctctaattctgtgaaaaatgttgttagtagtttcattttgcacttgtatacaagaacttaaagtaaaatttaaaaaaagaaaaaaaaatgttgttagtagtttgatagaaatagcattgaatctataaattgctttgggtaatatggctattttaacaatattgattttttctattcatgagcgtggaatgtttttccatttgtctgtgtcatctctaatttctttcagtagtgtttggtaattctcattgtagagatctttcacttccctggttggccctattcccaggtattttattctttttgttgctactctgaaagggacagtgttctcgatttggctctcagcttggacattgttgatctatgggaatgctactgatttttgtacattgattttgtatcctgaaactttactgaagttgtttctgagatctaggagcatttgggcagagattatggggttttctaggtaaaaaatcatatcttctgtggtgagagctagtttgacttcttctctttctatttggatgtattttatttctttctcttgcctgattgctctggctaggacttccaatactgcgttgaatgggagcgatgagagaggccatccttgtcttgttccagttctcaaggagaatgcttccagcttttgcccattcggtataatgttggctgtgggtttttgtcatagatgactcttattattttgaggtatgttccttaaatgcctagtttgttgaggattttaaacatgaagggaagtttaattttattataagcctttccttcatctattaagatgatcatgtggtttttgtgcttagtcctgtttatgtgatgaatcacatttagtgatttgcataggttgaaccaatcttgcttcccaggaataaagcctacttgatcatggatgattagctttttgatgtgctgttggatttggtttgctaatattttgttgagaatttttgtgtctatgttcttcaaggatattgacttgaaattttctttttaaattgtatctatgccaggttttggtatcaggatgatgctggcctcataggatgagttagggaggggtccctccaccttagttttttgaagtagtttcagtaggattggtaccaactcttctttatttgtctagtagaattggctgtggatctacctggcccagggcttttactagttggtaagcttttcattactgattccatttcagaactcattattggtctgttcagggtttcaatttctttctggttcaatcttgggaggttgtctgtttctaggagtttacctatttcttctagattttctagtttgtgtgcctagaggtgtttatagtagtctctgagggatttttgtatttctgtggagtcagtggttacgtcccttttgtcatttctgattgtttatttggatcttctctctttttttattagtctagctagtggtctatcaatcttatttattctttcaaaaagccagcttttggttttgttgatcttttgtatgtttttttttgcatctctatttcctttagttcatctcttattttggttatttcttgtcttctgctagctttggggttggactgctcttgtttttcaagttcctctaggtgtgatgtttgtttgttaatttgagatttttctagctttattatgtgggtatttagcactatacattttcccctttacaaaagtaaataacatatatggatagtttgtaaacatcttctcaggcagcaactcaaaataatgtggagatagatgataatgatattatgaagtcaagtttattaataaggaatctgaagctccaaaaagttgtgattttaatgatgttaaattcctagctcttttcatcttgttcactctaattgagtgagaatttttagaaagtttatagaagtattaatgcccaagcaaataaagaagaaaatgctctaatccatgtatcctggtcaaacaaggaacgagttaaagacagcaatgagagtagtgagtcattggacctagtggaggtttgcctatgacgcttgtggagaatttctttctagatctgtcattctcactggattcccaggcaacagctgtgacagactaaattgtctctctcagatgagtataaaatttcatcttccttcctcatcagcaaaatgaaatgaaatggagaattttggaaatggcctgaaatattattgcagacattgctataatttggaaattgtcacatgagtacacagaagatttggcagtttcaagaattcattctggatgtggcaccagttccaaatcagcctatgagaccattatttaaaatgccatcactgtattttaccccagatgattcctgatgatattttattcaggagacatttgtgggagatctgctgtgtgcctctatccatttgcatctgagaagaggaagaccagcctaatgattttcagaaatgagcctatgttagcatatctgaccctgcccacggtgtccccacatcctcagacatcaccttaggcctggcttcaccaaagaggcaccttctagttttatctctctacccaggactttttattcctttgtggactcccttcctttgaaaatcaaatgttctctctctcacatacacactctctctttctttctcttaagactcagctaatctgaaaataacttgccccattatttgtcattcgaaatgtagtacccacaagttaaacaaggtgggagggtgagttgtggcatgccaccttgccaacatgttccattgggaccatttctatggatgcattagtttactgccaggtgttagtatttatagaagttatggcaacagttctatgaatgtctcctttatccctctaccacaaaataagcttctaagaagtctggaaattctgagagtatattagccaatgtgagtgatcactatctaatagtatattttccaaaagcctagctttctaaaagagagtcttgaattttagactgtcatacaaatgtcagttaggtagctttcctgccatagcaattagccaagttaactaggtagccaagacaaggataacttgatgatagatggtttgatttaagtaaaaccgtgtgatttttttttttttttaccaaaagcatgctctgggtaagttagcaaatcaaagcaaagactatgtctttctatctggaattccaacaaccatctaaattctttaattatacagataattttgcatttaaaatttttgaagtagtggactattaactagatcttagaaatggtttgtgaaacttcaataaaagtgtttcttgaaagaagatttgattctcatatatgaaatatgaaccaagttaaatgtacaatctattgatacctacatttgtagttactaaagggaattgagataagctgattttatagagttatttcattagattaagtcctttctctccttggagaaataacttaattaggtatatgtcacaaatgcaattaggtgaggaatcttggccctaattcatttagttgaaagaattacgaacaatttgtgacatagcaagtaggtttttatcaagacagtctttttgagatcagctattcaaaaagcaggggcactggactctgaacacaaatttatctcaaactttatctcgattcatctttgtggcctgatgaggtcatcatttgaaaagaatctaggtgaatataatttataatacagtaccttacctataaattcttctttatctcagtattgacacaatactattcaggtggctttaggagttatttgcttctatctgttaaaaatcacaaaggataataatagaaaaagacatgtatattcggacagctatagaggcagacatgtgattagaatcggacctcctgtttccaagcactagactcaggtcactagatcacaattacagctttatgctttggcttggcagttttgaaaagctcttatttttcttagccttatatttgactgccagagacataatcatttctttaccactcatcatgaacaacaaagcactaaattagtatctagtgttaagatggtaagctacaggtatatttaagttaggaaagaatttcttatttggaaaaagaagttatattttgtaacttcctttgtttaactaatttatataggcaggttagtagtacactatacatgtatttttttaatgtttaaatttaaaacatttaggcaaaggagttttgtctaaaataatattccttagcttactgattcttaataattaatcaaaaccaatatattttaatgatttacattactgaaaaactgtaacataagcttatttaaaacctttaaaaaactataacaagcttatttaaaacctttaaaaactacaacataagcttatttacaacctttaaatagagtctgtaaaacagtacattcagtgaaatctagttttattcctattcttctaccttgttagactgtacataatctctctctcaaaaagacttgtgtgtgtgtgtgtgtgtgtgtatatatatgtatgtacatatatagtatgtgtacatatatgtatgtgtacgtatgtgtgtgtgtgtttatatatacatatatatatatagagagagagagagagagagagaaagagaaccaaaagagaatctaacagagtagaaaaaggagaaggatcactgggaaacttaatgcatatgtgggggatatcaaataagcccagcaaaaagaaaaagcaaagaagccttgagaaaggactgcaacattgaatgccttctccaacccacccacagattgatcagaagtggatggaagccttatggacttgaggtgctatcacagcttctgtccaaacaactagacaatgattaggttatttggacacaggggtgatcccaacaaagccagtttaaaaataaaaataaagagaaaaatgggccggatgtggtggctcacgcctgtaatcccaacagaagctgactctgagagggccagggtctcagatactgaatttagcaaagactttacagaaatattgtaaatctgttcaaggaattagagaaaactctgttcaaataattaagtgaaaatatgacaattactcaatctcagtagagaaacagacatcataaaggaaccaaatggaaattctagagtttcagagtacaataatccaaatgaaaaatttactagctagactcacagtagatttgaggtggcagaaggaaaaatcagtgaacttaaatatggataaattgaaatgatctaaagaaagacgagaaagaaaaataataatgaaaaatgaacagagccacaacattctgtgagacgacatcaagcataccaacatgtatgtaatgggaatcccaggagaaaggaagagagagataaataagagagaagcaagagccaaacacttctgaaatttgatgaaaactattaatttatagatgaaactttagagaactccaagtagaataaacacaaagagaaccacgtttagacacatcataatcaaactgctaaaagccaaaaaaaacagtaaattttaaaagcaataacagaaaaacaattcatcatgtacgtgaaaacacaataagaatatagcaatttcagaaagaatggagacaaaaaggccttagaatgacatactcaaagtgcaaaaataaaaaagagattgtcaactatgaattctgtcttcaatgaaactatcaaagatgaaagcaaaaatgaagacattttgaagcaacaaagtataaaatgaattccttgctagcataaatgaactataagagttgctaaagaagtcccacatgcaaatacattataacagacaattttattttttgcaacacaatttatttatttatttatttattttcccctttccccacaatttattttttaatgttttcattatttcacatagaaacttcatccctttagccaggcttggtgtctcatgcctgcagttctagcactttgggaggccaaggtgggcggatcacctgagatcaggagttcgagaccagcctgaccaatggtgaaaccccatctctaataaaaattttaaaaaaactaaccgagcatgatggtgcatacctgtaatcccagcaactcaggaggctgcagcaggagaattgcatgaaccgggaagtggacgttgcagtaagccgagatcactccactgcactctattctgggtgacagaacgagactccctctcaaaaaaaaaaaaaaaaaaagacagaaaaaagaaatttcattcattagaaagtaattcatcattcctacctcctctcacaccttagttccctcattttattgtgaaaatattcaagcatatacagaaagattgaaagaattgtacagtgaacactcatatattcatcactattctacaatattttgctgtatttgttttatcacatccatacatctatccatctctttgttatgtacttcaaagttgcagacatgagtacgtttcacttctaaaatgttaacatgcataacattaattagagtttatgtttatctttttttttttgagactgagtctcactcatgattttggctcactgcaacctctgcctcccgggttcaagtgattctcctgtctcagcctcccgagtagctgggatcacaggtgcacaccaccacactcggataattgttctatttttagtagagatggggtttcaccatgttggtcaggctggtctcaaacacctgacctcatgatctgcccacctcggcctcccaaagtgctgggattacaggcgtgagccaccatgcccggccttcttttttaattgctaaaattaaaaagaccaggtgtagtggctcacgcctgtaatcccagcactttgggaggccaaggcaggaggccacttgaacccaggaattcaagacaaacctaggcatcaaggtgagaccctgtctctacaaaaaaattttttttaaatagctagatgtcatggtgcatgcctgtggtcccaactacttggaaggctgaggctgaagcatcacttgagcccaggaggtcaaggctgcagtgacctgtgatcgtatcattgcactccagcctgagcaacagagtgacaccctgtctcataaaaaaattttttttgattacatttaaaaacctttttagaaacagggtgtcattataacagacaataatttgaattaagaggaagggatggaatgaagaaataaagagcactgaaatttgtaaatacattgggtcaatataaagcattctacatcgtcatcaacaacaaagcactaaattagtatctaatgtaagctctgttaagatggtaagctacaggtatctttaagttagaaaagaatttcttatttggaaaagaacagttacgttgtgtaacttcctttgtttaactaatttatatatgcaggttagtagtacactatatatgtatttttttaattttaaaatttatttttaagttttacttaagtttcaggatacatgtacagtacagaatgtacaggtttgttacataggtatacgtgtgtcatggtggtttgctgcgcctactgacacatcctttaagttccctcccctcaccctccatccctcaacagcccctggccctggtgtgtgttgttcccctccctgtgtccattgttctcattgctcaactcccacttaggagtgagaacatgcagtgtttggttttctgttcctgtgttagtgtgctgagaatgatggtttccggcttcatccatgtccctgcaaaggacatgatctcattcctttttatggctgcatagtattccatggtgtatatgtacaacattttctttattcagtctatcattgatgggcatttgggttggttccatcactttgctactgtaagtagtgctgcaataaacatacgtgtacatgtgtctttatagcagaatgatttatattcctttgggtatatacccagtaatgggattgctgggtcaagtggtatttcttgttctagatccttgaggaaatgccacaccatcttccacaatggttgaactaatttacattcccaccaacagtgtaaaagcattcctatttctccacagcctcaccagcatctgatgtttcttgactttttaataattgccattctgactggcatgagatagtatctcattgtggttttgatttgcatttctctaatgatcagtgatgttgagcttttttcgtatgtttgttgcccacataaacgtcttcttttgagaagtgtctgttcatatcctttgcccactttttgatggggttgtttgctttttttcttgtatatttgtttaagttcattgtaaattctggatattagacctttgtcacatgggtagattgaaaaaattttctcccaactataggttgcctgttcactctgatgatagtttctctggctgtgcagaagctctttagtataattatatcccatttgttaattttggcttttgttgcaattgcttttggtgttttcatcatgaagtctttgcccatgcctatgtcctgaagggtactgcctaggttttcttctagggtttttatgtttttgggttttacatttaagtctttaatccatcttgagttaatttttgtataaggtgtaagaaaggggtccaatttcagttttctgggtatggctagccagttttcccagcatcatttattgaataggagattctttccccattacttgtttttgtcaagtttgtcgaagatcagattgttgtacatgtatggtcttatttctgaagtctctgttctgttccattagtctatatgtccgttttggtaccagtatcatgctgttttggttactgtagctttgtagtatagtttgaagtcaggtagcgtgatgcctccagctttgttctttttgcttaggattgtcttggctatatggggtattctttgattccataagaaatttaaaatagctttttctaattctgtgaagaatgtcaatggtagtttgataggaatagcgctggatctacaaattgttttggtcagtatggccattttcacgatattgattcttcctatccataagcatggaatgtttttccatttgtttgtgttgtctcttatttccttaagcagtggtttgtagttctccttgaagaggtcctttatatcccgttagctgtattcctaggtattttcttctctttgtaacgattgtgaatgggagttaattcatgatttggctctctacttgcctgttgttgttgtaaaggaatgcttgtgatttttgcacattgattttgtaccctgagaatttgctgaagtggcttattggcttaaggagtttttgcgctgagatgatggggttttctaaatatgaaatcatgtcatctgcaaacagaaaatttgacttcctctcttcctatttgaataccctttatttctttctgttgcctgattgccctggccaaaatttctgatactatgttgaataggagttgtgagagagggcatctgtgtcttgtgcctgttttcaaagggaatgcttccagcttttgcccattcattatgatattggatgtgggtttatcataaatagctcttattattttgaggtgtgttccatcaataactagtttattgagggtttttaacatgaaggatgttgaattttatcaaaagccatttctgcatatatagagataatcatgtggtttttgtctttggttctgtttatgtgatggatttcatttattgatttgcacatgttgaaccagccttgcatcccagggacgaagccaacttgatcatggtggatacgttttttgatgtgctgctggattcggtttgccagtattttgttgaggattttgacattgatgttcatcagggatattggccttaagttttctttttttgttgttgtgtctctgcccagttttggtatcaggaagatgctgacttcataaaatgagttagagaggagtccctctttttcagtttcagaaggaatggtaccagctcctccttatacccctggtagaatttagctgtgaatccgtctggtcctgggctttttttttggttggcaggctattaattactgcctcagtttcagaacttgttattggtctattcatggtctattcatcctggtttagtcttgaaagggtgttttttaaaatatatttatatatatatatatctatttcttctagattttctagtttatttgtgtagaggtgtttatagtattctctggtggtagtttgtatttctgtgggggtcagtggtgatatcccctttgtcactttttattgtgtctatttaattcttctctcttttcttctttattagtctagctagtgatctatccatgttgttgttggtttttttttttttttcctcaaaaaagcagcacctggattcattgattttttggagggtttttcgtgtctctatctccttcaattctgctctgattttagttatttcttgtcttctactagcttttggattagtttgcttttgcctctctagctcttttaattgtgatgttagggtgtcaatttgagatctttctagctgtcttatgtgagcattaggtgttatataaatttccctcttaacactattttagccgtgtcccatagattctggtaagttttctctttgtttttattggtttcaaagaacttgatttctgccttaatttcattatttacccagaagtcattcagaggaggttgttcaatttccatgtaattgtgtggttttgagtttcttaatcctgagttcaaacttgcttgcactgagagactgtttgttatgatttcagttcttttgcatttgctgaggagtgttttacttccaattatgtggttgattttagaataagtgccatgtggcactgagaagaaagtatattctgttgatttggggtggggagttctgtagatatctattaggtccacttgatccagagctgagttcaagtcctgaatatcctttttaatttcctgttttattgatctgtctaatattgacagtggggtgttaaagtctcccactattattgtgtgggagtctaagtctcttttgtatgtctctaagaactcgttttatgaatctgcgtgctcctgtattgggtgcatatatatttagaatagttagctcttcttgctgacttgttccctttgccattatgtaatgcccttctttgtcttttttttttaatcgtagttggtttaaagtctgttttgtcagactaggattgcaaccctttctttttgttgcttgccatttgcttagtaaattttcctccatcactttattttgagcctttgtgtatctttgcatgtgagatgggtctcctgaatacagcacagcaatgggtcttgactctatccaatttgccagtctgtgtcttttaattaggtcatttagcccctttacatttaacgttagtattgttatgtgtgaatttgattctttcatcatgatgctatctggttattttgcacattagttgatgcaatttcttcatagtgtcattggtctttatattttggtgtgtttttgcagtggctggtaccagattttcttttccatattcaatgcttctttcaggagctcttgcaaggcagacctggtggtaacacaatccctcagcatttgcttgtctgtacaggattttatttctccttcacttatgaagcttagtttggctggatatgaaattctaggttgaaaatcctttcttttaagaatgttgaatattggtccccattttcttctggcttgtacagtttctgctgaaaggtctgctgttagtctgatgggcttccctgcataggtgacctggccttctctctggctacccttaatattttcttccttaatttcaaccttggagaatctgataattatgtgtcttggggttgatcttctcaaggggtatcttagtggcattctctgtatttcctgaatctgcatgttggcctgtcttgctaggttgaggaagttctcctgtatagtattctgaagtgtgttttccagcttgtttccatgctcctcatcatcttcaggtactccaatcaatcgtagtttggtcttttttacaaagtcccatatttcttggaggctttgttcattccttttcattctttttctctaatcttatctgcatgccttatgttagcaaggtggtcttcaaactctgaaatcctttcttccacttcacaaagtgtaatgctctgtgtatgcttcatgaagtactattgctatgcttttcagctccatcaggtaatttatgttcctctctaaactggttattctagttagcagctcctcaaaccttttatcaaggtttttagcttgtttgcattgggctaaaacatgctcctttagctcagcgtactttttttttttttttgacggagtcttgctctgttgccgcccaagctggagtgcagtggctcgatctcggctcactgtaagctctgccccccgggttcatgccattctcctgcctcagcctcctgagtagctgggactacaggtgcctgccaccacacccagctaatattttgtatttttagtagtgatggggtttcactgtgttagccaggatggtctcgatctcctaacttcatgatgtgcccgccttggcctccctaagtgctgggattacagcatacttttttattatccatcttctgaagcctacttctgtcaattcttccatctcatcctccgtccagttctgtacccttgctggagagatgttacaatcatttggaggagaagagacactctggccttttgagttttcaacattttttcattgattgtttctcatcttcatgagtttgtctagttttgatctctgaggatgctgacctttggatggattttttttagggacttttgtttttcttgatactgttgttgttgctttctgtttgtttatttttctttcaatggtcaggtacctcttctgtagggctgctacggtttgctcggggttcacttcaggccctattcatctggtttgctcccacacctggagatgtcactcaaggagtctggagaacaacaaagatgggtgtctgctccttcttctgggatctctgacttcaaagggcaccaacctgatgccagtaggattgctcctgtatagggtgtctaacaacccctataggagggtctcacccagttgggtggcatcgggaacaggacctatttaatgaagcactttgtcccttggtggagggggtgtgctttgctagggggaaacccacttgtctgggctgcccagattcctcagaactaccaggaggaatggttaagtctgctggtccacagagactgtggtcactcgccccctgcccaggggctcatgcccagggagatccaggttctgtcccggagcctctggctggagttattggacttcctgcagggaagaactgcccagtgaggaaggatgagtcagagtcaggcctgaagaggctctctggctgcagtctgccacagccagtgtgtcaggctttgggggatacctattgggaccaagccattcagtctcccttgaaaagcacagactgaaaagcccttgaaaagggctttttcagtctcccttgaaaagcccttcccccacccaaggaacttagtgtgttaggcagttgtgagtcccagtgctggctgctaccccttcctcagggagctcaaatggcttagacagtaagccacagctgtggggctggttgcccctcaccctgggagctcagcaggcttaagcagattccagctgagagcctgttgagaatctgcgcagctctggggttgggaccctaagctctggtggtgtgagtttgcgagtgggattttcccatccatgggttgcacagttctgtgggaaaagcatggtttccctggctaggcagcatgctcactcaccacttcccttggctggggggtgagggctcccctggctctcaggtgggctgctgcaccacactgctcttccttcctctctatggatcatgccagtcacctagtcagttctgatgagagaatctggataccttggttgccggtgaaggattcacacgcttattatggttcttttctatgggagcctctgattgccgttgtttctagtcggccatcttggccccatccaaatttttaaatttaaaatatttagatagatgactataattgtatttgtcatgtcatatatttgcgtttgtatagtcatagatatatgactatatttgtatttttcttctaattttttaaaaaatataatgttaaagcaataactattacactacactgttacatttataggatatgaatatattatatatgatatcaatgatacaagaaaatggagaggaaatacatctaaactgaaatttgccatagttttctgaaattaagtcaatgttaactggaatagattatgataaagtaaagatgcatattgtataatcactttaaaaatttcaaaaaaagctaaaaatttatgaaaaactaaaatagcatgctaaaaatatttgttgaacaaaaatgaaggcaggagagaaagaacaggggagcaaaaatgattacacttatagaaataactaaataacaaaatagaaacctttacccaacccaatgttagaaaatatttttctatgttttgttctataatttttatagctttggaatttacatttgtgtccattgttcatttgagttaatttttgtgtagggtgtgatttatgaatcaaagttaattttttgcacatagatatttgccatatcaataattacattaaatgtgaacagaataaatacatcaaaaggtaaagaatgtcagattggattttacaaagcaatatccaactatatactatctacaagagatatggatgagattcaagatacaaacaggttgaaagttaaaggatatatacaaagatgtactatgtaaagagtaaccacaagaaatatggagtgagtataatagtattacacagactctatgacaagtgacattattggagacaggaaagaatattttatataatgataaaagggccaatatagcaggaagatatagcaattattattgtgtatgtacctaacagagcctcaaaatgcatgaagcagagacggacagaaatgaaagacaataggcaattagaaataaatagaaattagaaagaagcaattaacacaattatatttaaagatttcaatactcctctctcaataagaatatagtagacttgaataagcctacagtacactcatctgaactgacattcataaaacactccacccaacaataataaaatacacatttttccaagtgcatataaatcatttaccaagatagactatattctccattactaaatgaatcacaatacattttaaggattcaagttatataaagtatgtttttggtcacaatggaattaaattcgacatcaatattagaaaaaatctctattaaatcttcaaatgtttcaaaatgaaaaaatatgattctcaacaccctgtaggtcaaagaaggaatcaaaaggaaaatttgaaaacattttgagcttaataaaaataaaaacaagtttagttgtatagatttaaatgcttatattagaaaggaataaaaattgaatgttaataatctaagtatccacctccaagaatatggaaaaaagagcatatcaataaccaagtatgtagaaggcaggaacaataaaatcagagtggaaataaaataaaaatgggaaaaaaataactagaagaacaatacagaaaactaataccatcaaaagttggttctttgaaaagatcaacaaaattggtgaacttctagccagactgatcaggaaaaaaaaaggaaagaaaaaattaccagtaactacaatgagggaggggacaccactacagaccctacagaaactgaaaggcttacaagggaatattatcaatgagtttaggctaataaattctataatacagataaaatgtacaaattcttagaaagtcaaaaattaccaaaactgactcaagaacaaatagaagaattgtatagtcctatttcagttgtatacattgtaatagttaaaatcttgctattaaaaaaagcttagattcagatgtctttaattctatcagatgtcttcatctttatttgaaatgagaccaatcctacacataattttttcaaaaatcaaaaaggagggaactcttcctacttcattttatgaggccaatattactctgatactgcaagtcaaagacctcagaaaagtccataggccaatatctctcataaagagagatgcacacacacacacacatatacataaaaaaccacttaacaaatattagcaaactgaatccaataacatatagaaacaattataaaccttgaaagagtggtttaacatttgaaaatttgttgatgtcatgcaccatattaggaaataacaaaaccaatatgattacctcaatgaattcaggacaaaatattttttcaaaattcaatacccattcaacaaattaagaatagaagagcagtttgtcactctgataagagggatttgtgaaaacaaaaattgtgagtattatctttcacttaatggtgaaagactgaactctaagatcaggatcaatacaagaatatccactatcctcatttacattcaatattatcctggaggttctagccagtgtaatactgcaggaaaaagccattaaagacatataaaatggaagagaagaagaaagcccatctttattcttagatggtataatcttatatgtaaaaaattctgaagaatctacaataaaagattacaattcattagcaagtttagcaaggttgcaggaatcaaattgaatatacaaatttttatttgatttccgtatacaagcaacaatcaatcaaaaaaatgaaattttgaaaacaattttatttatggtgatgacctgtacacagatgactaaaaaacattgctaaaagcaattcaagaagacctaaataaatgtagagttgatttgtggtttggaagacccagtattattaaggtgacagttctttagatattgatctatagattcaaggaaatctcaatgaaaatctgaagcatttttgcaaatgcaacaaatttttctagccatcatgtgtaaatgcaaatgacctggtatagccaaaatgatttttaaaaaaataacaaaactgaaggactaatattacctgatttcaacatttatcataatgataatcaaggaagtgtggcatcagcttaaagatagacaaatagacaaatgggaaataatagagtcaaaatgtaaacccacatatatctagacaaatggctttcaacaggggtacaaaaataactcagctgataataaatagcttttttcaacaacccttttatatggttggatttgcatgtttaagaaaaagaaagacaagaacttcaacccatacctcccacattatagaaaacttacttaaaataggtaatagaaataaatgtaaaaaccaaaactgtaaattttttagaagaaaatacagaataaatactttgtgactttaggttaggcataggtttttaactatgacactaaaaagtcaatcaatgaaagaaatagttaaaaatatttcttctttgaaagacactgccaggagaataaaaagacaaagcacaccatgggagaaatattttcaaattacatatatgataaaatgacttttatccagaatatataaatagctctaaacaaacaatccaatttttaaaatgagtatgattgtaatagcactccacacgaaagatatatgaattgcaaataaactcatgaaaagttgttcaacatgattagtcattaggaaaatcaaaacaaaacaaagcaaacgagggaggagccaagatggccgaataggaacagctccggtctacagctcccagcgtgagcgacgcagaagacggtgatttctgcatttccatctgaggtaccgggttcatctcactagggagtgccagagagttggcgcaggccagtgtgtgtgcgcaccgtgcgcgagcggaagcagggcgaggcattgcctcacctgggaagcgcaaggggtcagggagttccctttccgagtcaaagaaaggggtgacggacgcacctggaaaatagggtcactcccacccgaatattgcgcttttcagaccggcttaagaaacggcgcaccacgagactatatcccacacctggctcggagggtcctacacccacggaatctcgctgattgctagcacagcagtctgagatcaaactgcaaggcggcaacgaggctgggggaggggcgcccgccattgcccaggcttgcttaggtaaacaaagcagccaggaagctcaaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctatgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccacaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgacaaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtcacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacaaaataaaaaatgataaaggggatatcaccaccgatcccacagaaatacaaactaccatcagagaatactacaaacacctctacacaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaataaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcacaagcatggcacatgtatacatatgtaactaacctgcacaatgtgcacatgtaccctaaaacttagagtataataaaaaaaaaaaaaaaaaacacatgaaaaaaaaaaaacaaaacaaaacaaagcaaacatggaaatgtttgttattttaattgttatgatggtttcatggctgtttgcatgtgtcaaaactcatcaaatttgtgtacgttaaatatgtgaaacttattgtatgctggttacacctcaataaagctgttaaatttttttaaatttaaaaatattatttcaagaataaaataaccaaaccatattctgggagcaagtatttgcaaattatatatctgataaatgacttgtatcaataatacataaagaacttttacaactcacaaataagaaggcaaactaaaaatggaaaaaagatttaaatagatgattcttcaaagaagatatgtgaatgtctaacaagcagaggaaatgatcattaatcattaagaaaatgcaaattaaagccacaatgaaatactatacatccactaaaatggctataatcaaaaagattgacaaaattggtgagaatatgtggaaatcaggaaccctaatacactgctgatgggaatgtaaaatggcactttggaaactggtttgggaatttcctagaaagttaaacacatacttacctattatgacctagcaattgaactcctgggtatttacctaagaaaagtaaaaatctgtgtccacaaaaagatgtttattttattgttcatggcagcattatttagaatatctaaaaataagaaactggtgaattaataaataaaatatggtgtacccacataaatgatactactcaaaaagaaacaaactacttagccatgcaacatgggtaaactcaaaagcataatgttgaatcaattaagctagacaaaaaaggctacatattgtataattctatttatatgaaatttctagaaaaaagcaaaactatagagacaaaaactatgtcagtagttttctgggactacaagagtgagaagcagttgactacaaatgggcacaaggaaacttttttaggtgatggaagtattttagtcttaggttgtggtgatgggtgcagacctatataaatttactaaaactattgcaccctacatgtacagtgtatcagtattatggcaagtaaatcataccttaataaaactgttagctaaacaataaaaaagatatctatgctggaagtaggaacatgagactcattagcatatagatgatcattgtagctgtaaaagtagagaaaacatctagggaaagtttgttgaaagggaaaacataagaagctgggacagatccctgtggagcagcaacacttagaggatctagcaaaaatgaaaatgagtaaatgcagctacagaggtagaataaaaatgaaggaaatatagtatcacagcaagtaagtatttctaggagggggcttgtcataaagatatcaaatgcttcagataggttaaggaagaaaaagactaaaaggtgtctgatggtggtcacccaagaccttggcatgagcagtttttgaggaccaaataaggtacaagtcaatctggagtgaactgcagagtgagtgggagtaatgaatgcaaacaggagtattgggagcctggctcaagaagtttatctgaaaaaggaaggatttccttccaggtgaagctggaaatgacaggatatagaagtgcaagattttgttttaacagaagattcaacagcatgtttcagtgtggttagaaagaagtgagggagaaaaggctgaagattcagaagagggccataatgagggagcagaaaaagataggattgaaaacacaggttgaaagattaccattaaacagtaaggaataattgttccatgtagaagagtaaagaatggttttaaaataagtgaatttgtagatttcatggcatcaaggaaaggcttgtatgatggcttcttttttcttggtagaaagcaaggtttttgagagtaaaagcagaagtcataataccaaggatttgaggggaatggcactctttaaggacctagaattaggttagtgatcatgaatttataataataccagtctacccaattgtatattttttctctaggaacaagaggtggacagtttgattcactggagttagctccatcagaaagctagtagagcaagggtgtttagagtggtggtaacaaaacacttggaatgacagatcatggatggacaaaagtgaaggcattgggggctgatagacattgtcttcacttgcattcccctgaaacaaggtccgagacaatgactttaggtcaggtagttgatttgagagggagctcaggatacaggagtgacggaatggggaaaataagtcaggaaacaagggaaagataattaaagggtgcatgttttgagctacgtatcattgtgggtaactgcagctgagtcctactggaaatcctctgaggaagcctgtagaatgtgcctggaaattatccctctgtagaacagaaagctgacacattaatccactaattcctgtcaccctttgctggagaattatttctagaagcattaactacccccatttttccaggataccttgccagggctgaacaaactctctggcttcagaaaaatcccagaggcagaaaatgaaaagtaatggggaggattgggcttgaggtgaaatattgacagcatccaaaactccacaggaattttctaccaccagcttcagctaaaagctgaagtagtcctaggggcatatggtagaagatgaaattgaaccagtttacaaaagtccctatgcagtcaaagtaattgaggaaataacttaggataatagatggagttctttgattgtatggaagttattgatatcctctgagctattgatttatcatctgtaaatggggatgagattacccactttgtgtggttactgctagaattaaaagtccttattatgtaaggtgcttagcacagggcctggcatgtagtaaggtatagagaacaaaagctactatattattgctattatctattgaaagattagtaatattaataactacctgcattatggataatagactaattcaaattttatgtataatatttttgaatattatattcaagttcactacttaacttgaaccagtaagttcactacttaagaatataatatttcatatgacaagacattgcagttttgtttggaagaacattaaattctggtactttttgaaattagttttatcatagaatggctattgggaaaatcataaatgtaatctaattcccatgcattctttttcctttggttaggatttcgttgaagtttttattagactagaatgatttattttatttgtaaagaaatcaccacagatgtattgttggttttgttttcaaatcttttctgcttttcaacttattcaaacacaagaaacaatctaaatgcattctactctctacaacctctgatgtcaaataagttttctttaattctagcttaaatctttaatgctgcagttttgtttttgcttattttcttctcagtggagaaaaaaggaacagctggttactattgtcaattttctattgtttggaatttattaaatatgcaacacttgtgaatacatagatatcaatacatatttccttccagatatagaactcctattgcttttctttcaagagtgatagaattttatatgggaaagctttagagttcttctagtcccagtatatagtctgattatttaatactagttaaaatattattaattgccatctagaatttcttgtggtaaattgcctgatgtgttctttgctcaactaccaattggactattattatatttcttatgaatatattgcaacgcaacacaaaatatctttgcatattgatgttaactattaaaccactacatgatattttcccccaatttgttatttgtcttttaattcagttgatagtatttttgccttacaggttcataatattttgtcagatatatatatttttctcttatgaatttctttttttggtttcatgcttagagatgccttactcaccatgagcttttatctaagttcacctatattttcttctggtcctttaatatttttatttttaagttggttttctaatccatccagaattaacttaaatgcaggattgcacatttgttcctaataaatttcaagttgtttattacagcatattgctttgatatgttgtaggattttatatcataaatctgttacatatatattcatgctatatatcagtggttctcaatcagaggtgattttgccctctaggaacatttggcaatgtctgcagacattttttattttccaggactaggggagaggctggctactggcttttagtgagcagagagcaaggatgatactaaccatcctacaatgtacaggactgcccccacaacaaagaattgtcaattgtactgagattaagggaccttaagagatgatagatggatggatgcatagttgatagatcaatagataaatgtatagaagatagatattcattgaataccatttttctgccagttacataccaatagtaatattttccagcctatatttttattctttacctatattctattctttaccctgaagggcattttaagagacattgactcctactttatggaaatccagatacattgaattgttggatatccctggtttgagcacataataaatattgaatgagcgttttataaaaatgacaacaataaatcaaataaattttaatgaaccttatttcactacagtaacttatttttatatgttaaaaagtatgctttttaaaatccattgcggagttttgctaggaatcaattttaagcagtatgtttcttctttagtcttctgccacatctgttattctcttgctatgcagcataaatttcatcagaatattaactctgttctctatattatttttatttagttttattaccactgtcaagcttgcagatttccttgtacacacacatctctttaatatgtagagttgcttattcttaccatctatgagaatcattacttttgcataaagactatatccatttttagttacattctgggagttaatattggtatccatggaattatatgtgtcttctgtgtcaaaaatttctattcactctaataacttatcctgaacatattttgtattggtattaacactttattgtttctgatccccttattagaaagatattttcttctgtgtatttgtgagccttttaattcttattttgcttcctgtcatatttgacatcctctacaacagcaatgtccaatggatggaatttatcgtgatgatggaaatgttctgatctgcacagtctaatatagtaggcatggttgagcacttgaaatgtagctagggcaactgaactgaggaactgaattttacatttaatttaatttagttttaattttagtagccacatgtggctagtggctgctgtatcggacagcacaattctatagagtaattccttacccttccatttttagcttaaaatcctcagctttattttaacttaaacctatttttactggttgtgtttgtatgcagttttgtttgttttgtatattgtatgcgtttcttatgtcccagtgattacgttattttttacttcatttcctatgctttccatacagtaataatacatatccttaggcaattgagagtgtgcaaaggtatttctgtaatgtattatctattaatatcaggtgcttgcttttctttacttttttgcaaataaaatgataatgttcattgtaggaaaaatgaaggaagaaaaacagaaaatataaagaagagaataaggcaaagattattactactactaacttcacagacacacacagacatacgcagagggatacacttggttgagtactttctatacatattcttttatttttaaacaccttactgattgtacagctaatacgtatttatcactagaaaaaaaatttaaaaacaggagtaaagtgaaggaaaaaaatcatctgtaatcacaatgcatagattaaccacttttattactttgatttgttttctcacagtgttgtttctaagacctgtgggtagatggtgtgcaggtaggtaggtagacagctggatatgtagaaaggcattttcaaaaattgtattatactatatgcagggtgggacaatagaagtatacacttttcaggtggcaagaaaacaaaattatatgtcactatgagtatgtatcatccacagtggtattagtgaccattctgaacatttgtaactttaatagaaatatatattggttaacatttatccactgggtttgtctatttattaactgtatcttgctttttatatcatgaacatttttctctagtataaaataaaattcacaaatgtgattttaatggctacgtcataatccattcgttgtctctatatcattaactagtttcctattattggacagttaggatgcttctctttttttactactataaatagcattacactctacatttagtgcctaaaatttttcatctctgattttttcatttctgattattttatctctgattatttcattagtatacatttttagaagtgaaatcactggcccaaatgaaatgaatggatatgagatccttggtatatattgtcaatccaaatcaccttccagaaagttctttgttgcttatagaagaaaatattcttgttccatttttatggtttaatcatttttatgcagctattttttttttttttttttgagatggagttttgctctcttacccaggctggagtgcaatggcatgatcttggctcactgcaacctccgcctcccaggttcaagcaattcttctgcctcagcctcctgagtagctgggactacaggcgcgtgccaccatgcctggctaattttttttgtatttttagtagggacaggtttcaccgtgttggtcaggctggtctcgaaatcctgacctcaactgatccaccggcctcggcctcccaaagtgctaggattacaggtgtgaaccactgcacctggctgcagcttttcttcgaacttttaaacttctgtttggttttacgactcaggattgttttttaataaacgtgcctttcaagggtttagcaaagtaatcatattgttataaatacccaaccaacataactttattttttgctagcaaaggttttcagatataagatttttcattgtataaattgtttctttttagggtgaacaaggagaaaaaggagatccagctctggctggccttaatggagaaaatgtaagcctaactcttttttctgatactctgtttacattttaccactaagatatgctatttaatgctattaagatttgcctatttttggcagagccagccagccatgatccaacaaaattaagaatcatggtgttctttcacatggctcagtagaggcccagtgtttttagtttcatttcattggctttatgtattttctacctgtgcttagccttaacaggcctttctccttgacgtttcttgcttgcaaattttctagtcttttttttctgtcttttttcatcttacatatcttctgccatggcttgtgctcttatcagtggttcacttttcatctcagtccaaatctccatctagtctatagatggcgtctgtattggtaggctttcagtgatgggaagaaagggcgaagtgaagggaaactaactccgtattgctcccctccatggcaccagttccacagcctcagggataacattgcctgtgatatcctaggaccccagtcatcttctccccttcccctcaggatggttatcctcccagaattgcactccagattttaggataaaatttgaaggatggcccaaatgtgggtttcactctgaaatgtaattttatttacatttactcaccatttactatagatttgttatctttactggtaggggaagtgtccaaaatgagaattagtttttccctcggcttccttttctcacttacataaatatgttttggaaaggacctgaagggccacatgacttataaaagaataaggaaaaactgtgagactatatctagctccctaatgccctagatgtgttcagaaacccattttgtatgcaggagatcattacagcggaagagaggctgaagaccaatctttccggcctgtggagaaagtcgtgtgtgtgtgtgtgtgtgtgtgtgtgtgtgggtgtgtgggtgtgtgtgtgtggagtctcccaaaaaagaaagaccctagtagtaatagtagttaatgtttctatgtatgttaactaaaataatagttgtttcaccatcattcttatttctctccctttgaagtgatttttctacaccagagaataggcactagccccagtggcttgtagctatgggagtctctgcatcttctttaccacctgtaatacatcaggacactgaatgtcacacatgtttaaatagagtaactgactcacctcttactcctgtcattggaggcacgtggtgaagtgggatgagttctggagtagaaagccagggtccagtttgtcttccagttctgtcacagaagagcagatcacttctcagagtctgtaaaagtgatggacttgggatagattcttttttttttttttttgagacggagtcttgctctttcccccaggctggagtgcagtggcagtggcatgatctcggctcactgcaacctccgcctcctgggttcacgccattctcctgcctcagccttccgagtagctgggactacaggtgcccgccactaggcctagctaattttttgtatttttagtagagacggggtttcaccgtgttagccaggatggtctcgatctcctgacctcgtgatccgcccgcgtcggcctcccaaagtgctgggattacaggcgtgagccaccgtgcccggcagacttgggatagattctaaagcccctatcgctattatgtgctatgattttatgcaaagagttattaagattataaacttgaaaagtctgacgaggcctgaagcattcattcaggttcattgagtgcctgctacatgtaaggcacagtgagaaaaacaaaacaggaagagatgaagccagagcataggaagtcctggatgtgaggatgcttgtccttcctcctcaggacaaaggggagatgtggcccacactttgtttaaatgaaaattccttttacagtggattctgaaatggatagaatttgggcctttgcctgtgttttctgttctttctattacactctccgtgaaagcaaagaccatgtgttggaatcctagtacttagcacatgtttggggtaagttccaaataactatttgctgaatgttagtttgaaaaactgagcggttattaatattatgacagagtaaaatataagtaattagagtctaagctagaataacagatgtggaagggaagatacagagaatgatgctaaagaggtaaaatacatatgatttggcacttgattggagttgaaaactcaaaaatagcccaacatgttgaccgttctgtgtgagaaggatactaacttgtgagaaatgtaggagtgttcaaacagattaattacagtgttccaaaaaataaccaaactacaagtatgtgggctctctgagatagaggagcaaaacagagtgtattacaagtgcataaaagtaatattggaattgaaatagaaagaggagtttttgaaatatttgaataaaactagaaagatatttgagaggttggaacctgaaatatattcacattaatttcaagatttgaaaatttttcttacattgtctgaaagtaaggtttttgggctttttaattaatcaactgatacatgcatatatttgagggcctactatattcccaaactctctgtcagccactgtgtgagttccaaatctgagtaacactaacttactgagagatcccaaaggcctagtgagcagtgtgaatgtctatccctttgaggaatcttgaaagagtccttcacatgccccaataacaggaggtcattcctttagcaccgttattgtctgatgtagctcattaagtacaaccataaagcatgacaaagcacattaacttttctcacttggttacttagttaataagtagatgatgttattttttccccttaattttgccaaagatattcaggagttatgactaaggagaaataacaaaaagtagtaagagttctcctctttcccctctatcactagtagtaaagaatcagctgcttggttattacactgttggagatggggggagtgttaatattgtgttatagttcataaactattttcacaaggaatttgaaatttgaccctcacccagcttaattggctagtagagtggggaatgatagtattcgtattttcagaagcaagaaattaaaggcttcagaaattaagcaactttcttttttaaaatactaaaattggcctttaactctaaatatttggctgaaaagtctgatcttcccagtaaatcctgccacacatcattgcttatttttcagtgctaaaaaaactgagtctgcaaactaaagtaattcagcgtttatgacagttcactctgactttcaataagcccaggtatacattcttaggaattgaaaggtattataatggctattttgatttgaattaaagtcaagccaatgatggaaatcataacttcagaaatattgtcttagaatgtatggtaaataaactcagtgagccaggtgactccagctactttctaagtcagagtatattggaatgctttaatatttctactaaatgaattccacagcctttttaatagtctttattgctgtgtattatatatgtatcttagtgtcaatgtatcttataataacttattttgtgccagctttctcacaaaatgggccagctcactttggaaagtgtaaactttaatttaaagggtagtatgtagcaattcagtctttctcaatgtggcactcttggcattttggcaagacagttctttttcaagtcagactgtcttgcaagagcagaatgtttagcatccttgaagctcaccaacctaatctaaatgccagtagcagcccctagtcattgggacaagaaaaaatgtgctgatatttttctaagtgtatcttaactgtgtgtgtgtgtgtgtgtgtttgtatgtgtgtgcatgcctaaacttttgtttgatgtctgtggtattactaaacaaatgcatgctcatatgtccattctagtttaaataatgcatacaaaacatatattaaaattttcaaaaatttgaattgctagaaaatttaaccttgaaaatatatgaccttgtctttacacacaatctagtgtataattaaataattttgattgtggcctaatacaagatatatttaacaaaggtatcttagaatagacttgagagagaataatataaagttgtaattgtgatctttaaagccagactatctgggttcacatcccagctctgccactaactagctgatgtactacttggtaaattacttagcctctctgtgcctcagtttctttatttgcaccatggaatgataatttcaatatcctctctgtgcctcagtttccttatttgcaccacggaatgataatttcaatagtacttactgtaggggaaaagataattttcccttcccctctgaggggttcagtcagctgaaatgaactgacaatggacagattaacaggagaaaaggcatacaaatatattaacgtgcatacagtgggagccataaaaaatacgagactcaaagaaaggccagatggttgaagcttaaatagaaccctctttataggaaagaaggagatggggaaatgtaggcaattttgagaggtagtaaactcttttttgaattgaatgggaccaagagctaacaatagcttgtggacaagttacagaaaggtgaaggctggacctccactgtgaacaaaagttgtcttgttttgcagataaagactcccagataatctctcagagctgccctcagaagaatagaccaagagtctgtctgggcatcgtgacaacttttagtttattctcttctccagagattaattttcctggttattctgttagattcctaggaagggggttttaagacaattgctttttttggaagaagatttctcagtctgataaagaaacttccagagagagctcctccctgtacttgaggaggggttggaggaaaaacaagagaaggttagaaagttcttggatctgaggcagcttctaaggcttttcaattccttttaattcaaaagtactcagcatgccaaagcaccacactttggggttatcactctctgtaccccaaaattacctcatggatttttttgtgaagattaaagggactatcatacagaaagcctttagaacagtgtccaacatagggcaagaactatataaacattcactattattagaaaccaagttaaataaaacacatttagctctaataggtacatgtttttatttatttgtttctgtggggttatacaatcttagaaaagtagacttaattgttgagttgtctctttttctgaatctatattatggtcttttaagtatcccttattagaattacagcatctgatgtttctaaaataatcatgttaatctccttataccaatgcaatctgtactagaggatacaaaaatattgaaatcacaaaaccagagataacagctggcaacagctgttgacattgctagggaataacattaagtcattgaaagcttgtgaaaagaattaattgatgggttaaaaatttttaacaaataatatttttatattatcttctgaattttaaagatatgatatcccatgagtagtactaggtactccaacaaaaattgattttatagtctacccgcttttataattctagttataatactgctcttcagcttttgtcttgcctttagataacggtttctgcctccacattacatgtagaatcaactactgtgcttttgggaatctttatgtacatgaatttgattgaaaaccttcataacagataccgatcttactcaatatttaattcagagtctattccatttggctctttatgcctatggtgagtgctgtgtcctttctccctagcactcaataaccattgataggagcaccagtgtgacacaaggagaaaaaccgcatttgagaaaagcattactgatgtgtttctcagaggctattacaatgccatggccttaacaacattgtactttgtcacaggaagacgtgagttacatgggcctactttaatggtcataaaagtagaagcttgacaaatgcagtacttctcaattgcattttatcctatgtgagttaaagcacagttgttacatatccatcaaactggtataaagctgaacaagaaagaactatcagttatcccttaaacttgaacttgaaaagtaaaaacaacatttattaagtgcctaccgtatgctaaatgtctctacaacatatgattctcagaacaacccttcaagaaaactattacttattatacctattttataggaaagcttacccaacttacccatgattatacataaaaggccattcgtcttctgactctgctgaaatccacatctgtgaagtcttggacaccccagtagaattaggcatctgtgggaaatgcttttgtcatacctgctatatacttcaatgataatactcaatattcacatcagcttgtaattggctacatcatcccttcccctcctccctgcccatagttgactgaaccagggagagttacctgattcaactgccaatacattgcttccctagaaattacaactgggattaatttgttggaattaatctttaaaacttttaatgtattattttatacctacaaaataatatatataacatatatgatggttataaatcatagttataatgaggaccccagtgtacccagaactcaatgtgagaactaagacgtcatcctccacttggaatctccctgtgtggttcactatatactgtcctccactccagagttaaccatttttctaaatgctgtacctaatgtttccttccatgcttaaaaattatgtttcacacttacacatttataaggagtatataatttagtcttacatgtttgcagacgttcaataatatttgttgagtaaatggatactcaaggtttttatcagtcatttctttttttgtgtttgtcttttctctgcatagttttacacaagcaaaaagagaaaacctttttttaataaatttctctgctcagtgaatgggataacttcctagccagttacttaagtcaaatgcaactcagcctggagactttccttcttcttctccacttctggcatatctgccagtcttgcttccagcatgtgccaactctgaccacttctcatcatctccactggcacaagcctgtcccagccatcctgctctctttcctggaaaagctgtcatagccccttttatgctcccactcttgctgcccataatttgtgttccacgttgctgccaaagtggtttgtggggatttttgtaaacatattcacatcatgtcattttcctgcttaaaacacttaagtggcttcccattgcatgtagaacaaaacccatcttcctcatcatggcctgcaattacttatgtaccatgacccctggcaaaccttgacttaaccccctactccttacctgtgtgctcatgacactccttttatcttagtgacctctgtgcttctttttccctctgcccccacacagatcattgcgtggctggatcctttttttttttatttgagcaaattcatgaggtacatgagaatttttttacacatgtataatacatagtgatcaaatcagggtgtttaggttgtccattttccaagtgcaatacattttttaaaagtatgcttatcctactctgctatcaaacattgaatttattccttctaccttactgtatgcttgtatctttttatccacttcttttcatcctcccttgccccctcactcaccctttccagtctttgttatctatttttacactttctacctccatgtgttcaaattttttttgctcccacatgtaagaaagaacatggaatatttgtctttttgtgcctggcttacttcacttaatataatgactttcagttccatccatgttgctgcaaatgacaggattttgttttcttatggcttaatagtactccgttgtgtatatataacaccttttctttatccattcatctgttgatggacacagaatgattccatatctttgctaggatccttctgaaacaacaaatgtcaccaccacacaaggaccatttctgacaccccccttgaagtagcaactctctcctctttcacttttatcacattcagcctgttgacctgtttattgtcagccactcacctcttattacatgagttccttgaggacgggaaccttcacctagttaaagaaaaaaatcgttgacacttgtttttaaaaagcgataaggaagacattttattccagactattgcaataggggaattgcaataagggagacagatcaggttcaactctaactacaacaaggacaggtggggatttatagccaatgagtagagggagggatgtcactggatagaaaattactaagaggagacatcaagggtagggtgattcttaccaaactgatctaagaagattcttgctgaagacaggccaaagacttagacatcaagttagaggatgaagaacttgatcttctcaaaagtaaggaatggagaagagattttaagggtgagagattctctctaaacatacttagcaagattcttgctataactgagctgggaagaccaaagacaggatgggggccatggtccaggtctagctgagaagagggctcagagaaccatgactaaaagtttggtgatggagagaatcttcattaatttcttgttcttttctgtatctctaaagtcgtactaatcaatagaaatataataagagctacaaattcaagatgaaggcaaatatattatttttttctagtaaccaaattaagcaaaataaaagggaacaggagaaaatacttttaataatatgttttatttaatgcaatatatccaactgttatcatttaagcatataataatttaaaaattattagtgagatattttacatttttttcttatactaaatattgtaaatctaacagtgttttatattcataatacacctcaattcagagtagtcacatttcaagagttcgaaagctacatgtggctgtggctaccagtacaggtctaaaggccagaagcaacttcacacaaggtatataataaatgtttattgaataaataagtgaaagaacaaatgaattaataataaatctattcacagaaatggcaaatttcttccttcaagtgtttacaatattctgtttccaagttctactctggaaacatgtataaatagagtatgcgttgcttgatttgggaagaaatggatattgtaaataataagacaatactgtatcacatctcaaatatcatttaatttttcactcatcctttttctataaatattccaaggtaatgatggaaaaaataataactatgagttttatacgtgaaggcatttatgcaactagaagttttttttgccaattaggtattgttttcatccattaaaaatgtttttcttaaagtataatactacaattttcacacactgtctgcaacaggattattttaagtatctaattttcttttgtttctttcacttcatcactggtgtctatgttgagtacaggtgatggcatttggcattatttattcactacaaaatgtcagggcagtaatagccgggtctttcagctaggaacagtaagacacttagacttactgtgcattgtgtggcttcagaatacttctttcttctattattgttcttccttcatccagtgtgttaaactaaggaaaaaagaagttttttttttctatttaccacgtagtcaggatgtgtctatctaactttctacgtacactgtgaattcatgcagctgtagagctgatctcctctggtacaatctattgtggaagtctcaaaagctgtcattgcttagtcagatcaactaaatacccattaaaacatccaacagtccagaggacttatgaaaatatttatctgttattctgtatatgtcatatatagtttcatttgacatctttataaatccaagtaaaaaggaattagagaactaaaatatactttaaaacaggcaagagattacattttagctccagttgtatgatagcaaaagaatacatctttcattccttttcccctcacaattagatttcttgatagagacataaaaatgtttttgattttactcttgaatttttttggcaagcttaacaaaggccaaatcaatgctaaatcagaggtatttacaacatccacaaatttaatccaaagtggatacttaaaacctcatatagatctaaatgatattctcccagatggtgaattaatgtaattttagcaggaagcaaagttgcacaaatatgcagtattgaggactcgcgctgatttaatgtatctgtgcccaccacggcacagatgttgcttatcattttagtgccagttgtctctatttctctctatactacaaaaggaagaatgagatttggaggttcagtaaattatgatttattttgttactaatgacttgttagaaattaaagctttctgtgaactgtgtattggttatattctttctacagggtttgaaaggtgacttgggtcctcatggtccacctggcccaaaaggagaaaaggtattgtgtttacccagccaagcccaacctttctttaagaaaactctgacaacctatgcagtgacttctcattcatactgtttatctcctaaaagcattctaaaattaaccaaaagctgttaccttaatagcatctgaataagaacagcctttttgttcatttaattagtttgaaaagactaaatgcacaattgctagttgacattagcttgtatttataagatttcccttttctcacccttgcttaacagcatgaggtattcaatcatcaaattagcaagtgtgacctgtattggaaaactttgccaataacactgagctgctgccataatggtgaggcaagtggcttttggaaagaagctagttttgtatctcagtcttaatttaactattccattttctgccactttttctcataaaataagttatttcataatgacatgttggcaatgatcttgaaaaggaaattaagaaataggaaaaagcaagggttgttttgaataaagtagttgggtgatcccagtttgatgaaaattgtatgtatatgtgttttgcaatgcattttgttctccatttttagcacatttagaaatccttgtctatcttcaatatttatctctgtgttaaaggtgatcctgcaaatgagtccccagtgactgatttaagccacttcagtgttcccttagcaactgttggctattttaattcaattgttccaaaaaacaatgaatacacaatgctaagttttaacttctgaggtggctatattggttgagaaaagagaaagtcctaaagatactcaatgtgagactacagcatcctggtaccccacgctatacagtacagggcttccataatgtgcagctaaataagaaccgtggaaaggatgcgtggtctttaatgtttgagagttcttaagaaataaataaagttcctgggaaagtaaacatgaaggtgacatagaaattggaaaatagtgaacttttagatgaaccattttttaaagatgttgaatagtttgttgatatatccacctggaaatttgtattcacatagatcagcaaagcaattttagcgttcagaaatacataaatataggcaaagcctcttacagttgatggcaaatgcaatgccaattcagcagagctttagaagaggccatgggactgcttcttgcagctgggaagcatgaaatggggagatccacttattatttctgctgatcttcatactaactttgtcagacaaattatctatcgccgtgacacttcccagctgcttcattggcaagtaaacatacttgaaaatatattatttctaattttggattagtagacaaaagaatagaaaattagattattttcgctttcaaaacaagtcctgctgttgcaaaaagcatagagtatacaaggtgatttttatatcatgaaagctaaaagggacatgatatattttctttatgcagagacttttatcaggatgaagttctatttttctattcttcaagatttatctctatatattgcttctatccacctagaaatttataaataatgtgcaaaaagggactagtggtaattgtagcttttctttaatctattttagggagatacaggacccccaggaccaccagccttacctgtaagtattcttgaaatcaaaattcaaaattgaaatccattattctgtttattatccatattacatcatgactaaaccagaatttaagtcacagagttaagaattgaaggtgacttcgagtacatgtagtcaaacctccacattttaaagatggggcatctgcccacaacagtgaaatatctgacccaaggtcatacaggtagttacaattaaagtctggaatcagtacctaccctgagcaatttcctctatcctccatatggctcataattttgtctcctaaatgtttgattatgcactcttaacatcaggtttaatgtaaatggaatcagatacagtcctacttgctttaaaaactgtaaaaggacaaaacaaactctaatcacccagtgaataaaaacagctacctatttaaactggtaattacattctcccaacactttccaaaatcattgttattttcctctatgatttgattctaaaatttgcagatgataaaattgcaatattttagtgacagatttatgagaaaagtttatagtgtgcacataatgagattgttctcaatcaaatggtacatcatgtattaagcactttataataaatatatgattctcttatattcagatacaatttactattacagacttttttcataggtgattaaagattcttatttaacttaaataagactctaagcctaatggaaaagaggacagttttgttttgttttttttaaaaaagatcttctatagcctgaagtcttttgaattttatgttgatgttacctagtgagataaattaagcatttaaatcagtagtattcgaagacctattctgattatagaaggtcagatttttaaaagtattctagtaatctgaatggagcccttcccataggtagaacataggaatctcaaaaactgtgtgattttgataatatttatatttatctttgtacttaaaaatcccattatgaaaaatacattaataatgtcttacacaaataattgttacaactcccacataaacaaatgttttttgatatgtggaaaacctaaggaactaaatagataacttacttggggataactcattcaatttgcagtggaagtttatgctttaagcttttattttaagcatgaaaagaaagactatttttttgagaggaggttttaagtgcatattattcagttttttatactttgtagaattttattttattttattttttgagacagagtcttgctctgtcacccaggctggagtacagtggcacgatctcggctcactgcaacctccgcctcccgggttcaagcgattctcctgcctcagcctcctgagtagctgggactacaggcacctgccaccatgcccggctaatttttgtatgtttagtagagacaggttttcaccatattgatcaggctggtctggaactcctgacctcaggtgatccgcccacttcggcctcccaaagtgctgggattacaggcttgagccactgtgcccagccttacactttgtagaattaaaaaaaaaaaattatttagcagtgatttagttaaacctgctctttttacttaggacagatgcctgtttctctttaactaagttacatgcagtcatttagttaaacctgctcattttatgtaagacacatgcctgtttttcttcaactaagttatatattcaactactcagttatctgatttcattgtcattttcaactcatgttggaagactgatatgcaatctacatatattatttcgcctgaaatacaattttggcttctcaatcagaaaattgtattggattacatatattttgtggatgtttaatagcagctagcttctttctgccaaggaacaccttgaagatacctctctgcaccaattcatctgtcaagcacttagagattacaagctaatttcatacttgtctaaaaatacgacaaggaaaaaacactatgaaatgaaatgttttatttcataaagtaaaatattcatattattggggtattactattttgtatgcttgacattactttctttattaatataaattatcaactcttccctacaaaatagggataaactaaaatgaataccaacttacaatacactaaatatttaattgatcttataatacaggttggtacattattagttgaaataatttataatagtctttgaggaagcccaaatgactaactgcgttatatttggattaaatgaggcagtgatatattggagtcaataaacagagttcatccataattgttctcaaaactagctccacgctaaaatctactgaagagttaaaaaacttaaccaatattggggctccacccccagaaattccaattcaatcaacctgatgtgggaccagtatattttaaaagctccccgagtggatctaaatatgcagcaagagttgagaaccattatttatgggaactagaatggaaaaagctttcttcctactcaaaaaaattatatcagattgttgaagaagtccaacttccatttgaaatccaacttaatacatagcgataaagaactatctctttccgttagggaggcatactagtaaaatgaagttaagattgaaccctgcttcattaaatggagagaattagggctaggaagatacctttaattacaaccttcatctaaatgtccatgtactcctgtggcttgggtgcctttcatgcttcttaaaatttaatgtatgtaggaacactcagggtcttgttcaaatgcatatttttattcctaagtctgaggtgagatctgagcttctacatttctagcaagccccaagggagtcagatactactggttgttgcactacactggtcacaaaggcttagcaccctcttcccagttagctgccttttcccatagatcaatggttctctgtcgcatcctggccaacatggtgaaaccctgtctctactaaaaattagctgggcatggtggtgtgtgcctgtagtctcagctacttgggaggctgagtcaggggaattgctcgaacccgggaggcggttgcagtgagccgagatcgcgccactgcactccagcccagctggagacagagcaagactccgtctgaaaaaaaaaaaaagattaatggttctctatcttgactgcacattggaattacccaaggtgctttaaaaattctaattcccagactgtaccacataccaataaagccagaatctccagggagggactcaggcaacagttgtttgagatttttcccaagcagttctaatgtgcaggcacgctcgagaactaaggctctgaaagcatgtctaatacttttctttacagctttctcttacagatcttgagcaaacattttggaattactcattacactagtatttatatcaaaaacacccaacctgattactttcaggagcttccaggagaggccagccttcctagtcatacctacaatttgcttcctgattacttcattatagaggatagatgaacgtccatctccacatttacaagctactagcaagtccaacagtaatccttcttgagaaggacaacaagcattgacaacttcaggacacagaattccagaaattctcaaagcacacacagctgaactgcccagaataactaagggcgaagagctgaacactttttccccctctaagccatacattctatatttgctttacttttattcatattttgtttaataagaaattaagagaaatagtaattgagcacactgtaatactgagtttactgatgcaggggcaatcctttatgatgtttttggggaagtattgttttttttttttttcttttgagacagggtctcactctgttgcccaggctgaagtgcagtagccccatcacagctcactgcagccttgacctcatgggcttacgtgatccacccacttcagcctcccaagtagcagggactacagacggttggcactatgcccagctaattttttttttttttttaacaaagacaaagtcttgctatgttgcctaggctggtcttaaactcctgagctcaagtgatcctcctcccttggcctcccaaagtgttggaattataggcaggaaccactgagtccagctgggattatgtttattgctgttatttttgtgtccctgtggattcttgtgcttttggtacttaaattttttttaatcacatagaaccagttcatcaaaaaaaatctgatatgtaaaaccatctatttcattaaatgttacttttgttgcttatttatactttcttttataactcgttgagtctgtatataattgggtctcagtggaagagagagaataaagaagtgagggtgaccaagtttaaaaaggagtaggaaaggtaaaattgaggaaatggcgtgaaacacagactggagtcctagaaacagtttgatttgctaggttcagctacaatagcttttaccctttatttcacctctcccttcctatcacctgaaagtattcttactgccagtgaccagtgcttcctcactctctaatatataagaaacctattaataagaaagccaaccaaaatggtgctgcagtttcaaatgcagtttgcaatatacccctttattatttcaggaaatgggaccccattcaaaattccacagttgaatccctttgataacgtttgaatccttctatagattcatgttcacgggtcatatggaaaatactccaatgtgactgccttggagaaaagaaaaggaaaaaaaataataagagaaatctgaggcctgtaaaaatgtcatggagattaaagtgatatttatggcattaattgtcacttacatcctttaacctttaaatattctgtcaatctacttgacttgataaaaatagaattatactttttgatatgacgttaataaacttgcaaatcttattttgtagactttccagattattctaacaataaaagatattgaaattcaagaacaaatttgtgaatctgtaagtggaacatctggaaactattttgtaaaacagtgtccaagaggcttcccttaatactttttttaaacaaaatttcatatagagatacggaaaaaaagaaatgaaacactttcagcccagaaggtgggaatgtggttgaattacacacacaaaaaagaaagactaaaaatccatggttgccaccataaacccaccttcatgtatctcttgctaggaatattttcagcaaatacagctagttgaaaataaaaaatttaatgaaatatctgatttcttttcagccactttttggaagataccaaattcactaattagtttggtactaacaactattttgttaacacaataagccattatagaaacttataataattttaaagttctaaagaaataaatatgagattcttcaacttgatttaaattaattaactgattattccacccttatcctttttatatttcaaactgataaccattttaaaaatagcacatcttgttagattttaagtaataataatataaataataaatggtagacatttattcagtgctatgtattgtttaaaccaaaccttaaacaaccctgtgaggtataaaatgattattactacatcgtacataagggaactgaggatgggaatatctaagtaaattgtccaaggttcacagatgttacataacagagctaatattcaactgcccatttggctgactcttaaaacctaagctattaaattctgcaagcattatttaaatctagtttaaaaaattataaaaaaaacagaaatgttctaaactattgcaaaaattaaaatttttaaatcaggtcaggcatggtggctcatacctctaatcccagcactttgggaggccaaggcaggcagatcacttgaggtgaggagtttgagaccagcctggtcaacatggcaaaacctcatctctactacaaataaaaaaataaaagtaaaaaaaaaatagccggatttggtgatggatgcctgtaatcccagctactcagggaggctaagtgggagaattgcctaaacccaggaggaggttgcagtgagctgagattgcaccgctgcactccagcctaggtgacatagcaagactctgtctcaaataaaataaaataaaataaaattttatcttgaagccaaaattcagaaaaattcaagtgcctagcagagatggggtggaaatgtaaatgtgcgatgcagcccagtgtaagataatagagtgtgcttggggttagggaccaggatagctatgtttatctcaaagtatcaaattcgaattaaaaactacttagagattgcctaatgcagaatataggcatactttggagatattacaggttcggttccgtaccactgcaataaagcaagtcaccaattttttttgcttttccaatgtatataaaagttatgtttatattataccatgtcctataaaatgtgcaatttatattatgcaaaaacaattttacacattttaattaaaaaatactttattgctaaaaaatgctaatgatcatctgagccttcagtgagttgtaatctttttgctgtggagggtcttgcctccatattgatggctgctatctgatcagggtggtggttattgaaggttggggtggctgtggtaatttcctaaaataagacaaaaatgaagtttgccaccttaattgacttttcctttcatgaaagatttctctgtagcatgtgatgctgtttagtagcattttacccacagaacttcttttgaaattggagtcaatcctctcaaatgctgctgttactttatcaactaaatatatataatatttcaaatcttccttgtcatttcaacaatgtttgcagcattttcaccaggagtagatttcatctcagaaaaacattttctttgttcacccataagaagcaactcctcacttattcaagcttaccatgagagtgcagcaattcagccacatcttcaggcttcacttctaattctagttctcttgctatttctaccacatctgcagttacttcctccaattacatcttaaacccctcagagtcatccgtggggtttggaatcaacctcttccaaattcctgttaatgttgagattttgacctcctctgtgaatcacaaatgcctttaatggcatgtagaatgttgtttttcaatttattttgcccaggttcatcagaggaagcactatctatgcagctatagccttacaaaatgtatttcttcttcttttttttttttttttgagaaggagtctcgctctgtcgcccagactggagtgaagtggcgcgatctcggctcactgcaagctccgcctctcgggttcacgccattctcctgcctcagcctctggagtagctgggactacaggcgcccaccactatgcctggctaatttttttgtacttttagtagagacagggtttcaccatgttagccaggatggtctcgatctcctgacctcgtgatctgcccgtctcggcctcccaaagtgctgggattacaggcgtgagccaccgcgcccggccacaaaatgtatttcttaaataataagtcttgaaagtcaaaattactccttcacccatgggctgaagaatggatattgtgttagcaggcatgaaaacgacattcgtctccttgtacatcaccatcagagcccttgggttaccagatgcgttgtcaatgagcaggaatattttgaaagaaatatttttttctaagcagtggtatcaacagtgggcttcttcagtaaaccatgctataagcagatgtgctgtcatccaggctttgtcattccgcttatagagcacaggcagggtaaatgtagcataactcttaagggccctaggattttcagaatgaggattggctttaccttaaagtcacaaactgtattatcccctaactagagagttagtctttcctgtgaagctttgaagtcaggcattgacttttcctctccagctatgaaagtcttagatggcatcttaactgctttgttgacattgaaaactcgttgcgtggtgtggttaccttcattgaagatcttggataacttgctgcagcttctagatcagcacttaatgcttcactttgtacttttatattctggagacggcttctttccttaaacatcatgaaccaacttctgctagcttcaaacttttcttctgcagcttcctcacctctctcagccttcacagaattaagaggcaagggcttgctctggattaggctttgatttaagggaatgttgtggtttaagggaatttgtggctatttgggtcttttatccagatctttaagtctttcttcatatcagcaatatggctgttttgctttcttatcatttgtgtattcactatagtagcacatttaatttccttcaagaagtttttctttgcattcacaagttggttgtttgtctggagggacctggcttttgcattcacaactcggctgtttggctggagggacctagcttttggtgtatctcagctttcagtacactttcctcactaagtttaatcatttttagcttttaattgaaaatgagagatgcgcaactcttcctttcattcgaacacttgaggccattgtatggttattaattgacctaatttcaatattgttgttccttaggaaatagggttgcccaagtagagggagagagacagagaaatggctagtcagtggagcagtcagaacatacattctctctctcttccctttctgaaatgccagtggcagatatgttagatttttgataatgtccctcttgtccataaaactctgttcatttttttcccatctaattccatcttcttgggaatggatcatttccaataagcccttatcaatcttactcttgctttgttaatttccattctgctgttaagactatcatgtgaattttttagtatagatactatatttttaagctagtgaagtttattttatattaaatagtgtctatttctctgctgttatttcctatcttttcattcattatgagcatgttttccttcctgtccttgggaatacttttaatagctactttaaaatctttccaggcacggtggctcacacctgtaatcccagcactttaggaggccgaggtgggcggatcacctgaggttgggagtttgagaccagcctgaccaaaatggagaaatgccatctcaactaaaaatagaaaaattagccaggcatggtggtgcatgcctgtaaccctagctacttgggaggctgaggcaggagaatcacttgaaactgggaggtggaggttgtggtgagccaaaacataccatggcactccagcctgggcaacaagagcgagactctgtctcaaaaaaaaaaaaaaaaaaaaaaactttctccgatcattctgtcatctgagtaatatcaagtagttctttgttgattgtcttttctccttagaatgggttatgttttggtgcttacttgtatggcaagtaattttttattgtattttggatactatgaatggtaagttacaggaactctgaattccattttttctgaagagctttaatatatttttaaggcaggcagttaaattggcttgactcgcatagcaaactctgtttctcctacagctggcaacagctgaaatccgttttgttcttttaagctaagctgagctacttgcagtttgcactgtgtatgtttggttaggagtcagccagagatttggggagagcttatacgcagaattttggacttccttacttatttcaggatttgacaaaccaaccccactttactttacaggaattgcatttgccctaaactctgtcctcagatttttcaatccagcaagtctgtaggctttctatttagctaacccatgacccagacttgagcctgtcctcagactaaacatcttaaaaacagaaaactgactccatgctgtttaatttttccaaatgttgactcccctccagtatctgcctgcttttgatgagtttccagtgtcttcaggtagttgttctacatgttgttcagtatttatagttgctatctgtgagcatgttgatttaatataactactgggccatcctggaagcccatttttgtaatacaatgctgagtaacttataatttacttagatatcttgctcctgtaaacataagtgagttagccttcacatttctttacttattctattgaccttgccttcaaaaaatatctagaatctgaccaattctcacacctctgctattactacttggtcctagttaccattataaatctcttgattttttcagtagccaattaatggtctccctccttctccccttgctcttcttgcgtgatttacacaagaagccagaatgttccttgtcactcttcttttcggaatctccagtgtttccccaggtaattaaataaaacccaaattccatacaatggcctacaaagtcttacaggattcaactctcattgcatttctgacttcatctcattttcttctctttctttctgattttactccacaacaaagtaatttttccagaaaattatccaatattcaatttttttttaatgcagagtgctggccaattagaataaatggattgttctgattcagtgcactggtgctgtttgtattttcaggcttacagtgaagaatgaatgactattaagttttaattcctgtgatttgtctaatgattatgatacaaagtttaaattaaaatgtctttaatctatagttgtagattttaccatgtcttgccttattcattttttcatttctcagcaacttgttaaactcatagatggtaaaatttagcattctaatcataaaaatgtgaaataacttgctataaatttgagacttatggtttcaacagcacaaatgaagccaaatacagtcaaataatgcagtgattcagctgaaattctctaagcaactgggttattaacaacaaagaaaaattcccttataaatatgtttttcatatatatgtaccaactttttgaaattccacgttttaaaaatatcaccaaatcacattttttcaaaaggtatttgggttctaccacatctggaatggccatattgctaatatcattgtcacgtattgagttgcagtaatgatggattagaaaaggcacttttgaataacctgttaaagaataaaaattccttttctaaattatttaaaataaatatgttaacaaaactatattcagaatcagcattttttaagatactgtattctgattgtgagaaaactaaatacttaatgtcaagatgacacttaaccagtgagttactgataaacttaaattatctcttctgttgatatttgtaatttacaaggcagatatacgtgagctaaaaccaatgctgaataagaaaaatgtgtttatcataataagtatacacatttatttgatcaaatataatgtatccaaggtcataatgaaaatctgataaattattctgaaatatgaagatgttgacataaaaatcctctattaaaggtaaatatttcatggtttaatcatgttatttgaaaaattgcattttatattagcttttcctcctcgtgttgaaatattagttgtaaatcattacattcaaatattcaagtacgataagcacaaattctttggttatatgtcatctgttgttaaaaccttaattttatataaatgtagtgtgtctttatatgtaacttcacaaattgtgtatgttctataaccttcctattacatactattgccagattctcctcaattaaataatataatcctgtttttacagtaaagttttactgaaatacattactaaggcttcagaagcaagacagggactatgagtgaaatgagacagttggctaacatctctatctccttttctcttccagtctttgcatgtcatgtcagaggagagacaggtgaaggaaggtagaacagtgctatttcatgtaatatatccactaattttagttcctaggaaaatggctgtgttgctctggccatgtctctttgggaagttattaaatactcatccagatggcaccaaatgtttatgcagaagccaaaggttaagtctgtcaacagcagaagtgccttagacatgcttactaaatgatacttaaataccagttccttggagcccacataaatccagcttcagtgagaaattacgcacagagagggtgcatagcttttactctaagaaaactaccttaaataccataagcaacggagagaaaatctcagctggtcatttataaatcaaatgacattcaattagcagatgcccctaatgcacaagagatcatatagtgttcacataagggaatttttgaaataattatttttctaagttggtatgtacaagaaacaaaaataactgctcagtaagtgatatggtccctttcctcccttcctcttttacccactcatttagttgaatgcttactgtgtgccagatactgtgttaagccctgcagacacagtaacaaacaacaatcattgtcgttgccttcagaaaacctacgtggtttaagaaaaagcaaccaattggttaaagttgatcatttttaaaatgatcgtttgtgaattgtgtataaaaagtttacaagtatttgtacaactgtagttgttcatattatacacagacatctagttatttcagagaaaattattttttaccagaattcttatgttgtaatttaaagttatttacttttggtttgttaaaatcagttaattggaattaatataattctaatcctttttagagaccaatcgttttttagttccatttaatatatcaatataaggcattaccacaaagatttttaaatgcttagaatagaattgaattaaactaattttaatgtagatttatgactgaaataaatacgtgctttgctgcatataatttttcaaaggcttacccattttataattttctgatggcatttagaaaggttcttgttgtatgcccaaagagcgtaattcctctttccattctgactagaattaatatgttctgtagcatatatgtattataaatatttatatgtacatataaatgtatatattatagcatagtaattaacaggctattcaatttaagattattttaaattcctcacatatcaaaatctgagttatttagacactttatgagttgcctaaatttgaatcaacactattagttttctaaagttgcgtaatttgtatttaattcattgttagttttctgaaactagtaatccaacttagtattgggatttctgaggtcctaatctgccagtagaaagaaggcagttgaaatattttaaaaaatcaatccttttttttatttgtgggcaaaagacatgtaagtgaattagttgattaaaatataaggtatttttctacaatacaaagctatttttatctattctgtgaagaaatactggcgagttgatgcttaaagccctggaaatatttatgttttagcctcagggaagatttatgttttggaaaaacttacagttggctcgttcgacatggaggtgatttatatctctttcgttagatgattaatttgagaataactccttctgcccttttgtttatagtttgcttctgtttcaaaaggcattttaaattgttttcatcaaaagtccaaattatgcattttaaacctcaatcagtaaaactttctttcctaaaagtgctatgcattgacaatttgtgacttttacaaaagagttattttatttcatgttgaaatactcagcaatctagaaaaataaattaaaatgtattttaaatgccattagaaaattataagatgggtaagccttttgaaaaattatatgcagcaaagcacgtatttatttcagccataaatctacattaaaatcagtttaattcaattctattctaagcatttaaaaatctttgtggtaatgccttatattgatatattaaatggaactaaaaaatgattggtctctaaaaaggattcgaattatattaattccaattaactgattttaacaaaccaaaaacccatgcagcttagctcaggaattatacagatcaagggaccaggctacctgagtttgaacctaaccatgtttcttgacctttctgtgtcatctataaaatgtgatactaatatttcctattgtatagtgttgtagtgatgattaagtgagttaatatatgtaaagattttagaacaatgcctggcttctagtaaatactatttaactcttagctattgatgttattgttagttaatatgctaaatgtgaatggcaaaaatatcaatagcaatgagcctaaagttctttatgaaataattgctgacaaatgtttatagagaacttttataaaatcacaggatttttatgggtagaattccttcatcttaagaaaactattaactataaactgaattctaagtattccttttataaccagtgtaaacttcatgagaataagaaccttgtctatcttatttacaactgtatccccagagactaaaagtatttgatgtagtataggtactcaataaatatttcttcttcataggtagaggaaacaaatattttttactgacaaacaaattattaaagtaaaatatcacccaatcctacagtgaaaatatctacagaaaactataacatcacttacttggatatcataatgaggaggagattccctctttccagctaccaaacctaattaatttaggacaggtggtcaccttctcccatattaaaaattttcagcaataacaatattaatgtcacttactacccctgattatttttgatcaatttgaaagtcacgctttttgtgagaaacaggaattatctctttaagactcctattatctgttcattattctgcagacatgaacaaaagctttatatagcttaatccattactaaagtcatattttgcaaaatagagaaacactggatgtaaggccaggaaaccagattctatccttaaatatgaactattttgatttatttagttattttagcttgggcatatcacttagtaatatgtaagggtcaaacaggatgttgttaaggtcattttcaactctaaaattctgttattttctcttttacctttcctaaggaattcaatttcctttagctgtataccatctaatatctatctccttaataatattgttcttttccttaaatcccctctattttatcacattattttaaaaggatagagaataaatgtaaggaatatttaagtcagacacatgcccaatatagagaaaggattagacttaccagtgtcaagaactgtaaaagatatgagattttacccaacttgaataataacaacttagcctgccacagtttcatcaatcctggcagaagacatgaaacttctgagtcagagaaaaaggcattattactcatggcagcaagcagcatgagccttatgtttgttttggttgcccttgcccccaggtaccagaaacaacccaggtaggtgccacatattcagtgggtttgcatcacagcaaagtagggaaggcaaatttttaaaaaatggattgcaggcaaacttgccctttgccaaaagggagactttatctttaacattctaaacagtaagcaaatctatccttgctttgcggcataaacatcctttaaaagatagcccagaacaaaagggtggttagtacctccctcgtaagacatgcagaagcacaaaagcctcatggaaagacccattgtctctcaacaataccatttttcatttctatactgtcttggtgtctggcaaattttttatgagtataccactccattaacagctctgattaatattatcaatagagactgtgaccaaaactattcaatttgtctcatatagcatttaattaaaggctactgttaatagaacgccaagcaagtagatgaggccagcctgcactattgatctcaaccctgtcccccaggattgcaaactcaaacagccgaatagatcccataaatcatccaagtctatcttagaaagccagatgatttgctccctacgtttctgaattggcctttctgcttgatttgaggcattaattcaggaacatcaacaaagacaaggacattttttagaaaactgcaacagactcagtgtgtctccgactttggcccaagtgggcaaccataaggatactgagctaacagtgtactaaaccaagtagtctttatctttttttatttaggaccatgtcaaggaataagaatatccagctggcagagccagaattaagtttgaatcctctagattcccttttggctaggtttctaccctacaggtgtaaagatagttcagaacctagagcagttagtgcctcactcacaagataaatagaaatgcaaaagactcagagcattgttgccaacaaccagctcttgggcattgcatttgtttatgaacaaatattagcaaatgttgctcttttgtttaccacaccatggctaactataccgctgactcattcagcttacaatcagctctagtcccggagtatctttttttctggtgtttttctattcttacttctcttcagtctatactgttgatttttcattccatttcttgtagaatgctgtcctatttcacagccacttcttagtttcctatataatctattctggaaagtttaataccttcatgtatcaaaaatgtcaagggtcactctgtgtcttcactctgataatattgacctgaatccccagtaatggattaagataaagcacattcaaatatatcttattttctaaagatttatttggaagtgcaagtagaatatattagaagtagatagagtttgggggtcagacatacttgctttaagagctcagctccaccatttatttaccatgttatctttagagaattcatcttctcatctataaagggaatgcttctatttcttagagttgttaaaattaaataagatcatatattaaagtaactggtggaattccagacacactagcaggtatgcaatacatatcaattctctatccccttcttaatttactattgtgaatgtgtggaggccatcaaagaatgtattgaaatgatattgaaatgttgcactagggcttccacattttgcttctgtgcaaacatggaagtctttttgtatgttatgcattattattttacttactattatttgcttgttatggttctgtaatatgcactctatatctgagaatataatgaatctcaaattatcttgatttactcaaggacttttttagaaacttgaaaataacattctgattgctccatttcattgaaatattaaaacaccaattgtaatttactttcatgccaactttctagtgactggtaaattgaaaattagggtttttttctgactttgatagattcacaatctgattatttggaagtcacatactacccatgttaccaacccaatagactggaaagtgacactggaacaacctgagcatgtatgtaacacatcataactaatcttattaatgccattagtactgaattggagttacactgacacaaccttaccttatttagtccataaaattaggtagttcgaccgattaaccctgtttctaaaaggttatgtttaaagaaatatttgtatatagacttattttttcattgacctgcaatataattcccatagaaatgaagttagccctcagatgtatttagatatcatatttctaacatttttaacgttcagtcttttttgtcaatataaaaattgccagcatatatttttccatttaacacccacaaattgtgaataaataaacaatgcaactacatttcactttatttagtgcatgtattaccaaaattagccatattgttaattcttaattcatagggagggagatctcacagattttatgaatgaagaattaactataaatatttaaggatccactctggcattttttcaaatgttctgcagaattaacaagacttgttcaatttgtaacatcattctgcctgattctgtcaccaataagtacaaattgagtctaatgacaaaatgataaaaagatattttggccaggtgcagtggctcacgccttaatcccagcactttggaaggccgaggcaggtggattgcctgagatcaggagttcgagaccagcctggttaacctggcaaaactccgtctctactaaaaacacaaaatttagctgtgtgtgatggtgggcatctgtaatcccagctactcgggaggctgaggcaggagaatcacttgaacccaggaggcggaggttgcagtgagctggaattgcgccactgtactccagactgggtgacaagagcgaaactcctctcaaaaacaaacaaacaaaaaagatatttcacatgatatgaatagccattttttgtcatccaaattattaacaaatcactgcaatttcagaaaagcttctgttaacagtaatgacaacttatcatctttgtactttagaataagttgccaggtatgaaaattagggcaattccttactatttcaagtgctaaatttgaatctgtatgtaataagtaaactttgagtattagcttatttgccttaacttgtttaatgttttaaataaaattgtagtacttttcaagtaaattcatttacaggattaaagaatcaaacagtactgttaaaggcttataataaaaaataccatttcaataaatgcattggggacaactacatagcatttgggaaaacacaaatttgggtttgtacatgactactgtgacaatgtaaatatcagatggatcaagattttaaaggtgaaaactaaaccacaaaagtcctaaagaaaacataagaattttaaaaataattaagcataacttttaaaatatattttaaactggaggtataaatagaaaaaagatagtatattttactgcatgagcaaacaactcctatataggggaaaaaataccccactaaactaaatcaattggccagctgggaaaaaatatttacaactcacatcataacaaacaactacatatccaaatatagagagaaattcctccaaatcaatttttttaaatcccaagaagaaagaataatatggcttttaaacatatgaaatagacctaaattcactcatcatttaaaaaatataaagtaaaacacctctgtgatactagttttcgcttataagattggaagtggtcaaaaagtttgatagtacactatgttagcaaatgttgagaaacatacctatacattttagggcaagtaggtatggatataatctttatggagggcaatttgatactgtctgtcaaagtttcactctaggctcattcatttataaaattacacatgtaccaggttgttcatttccatattgcttgtaatagtaaaaaaaaaaaaatagagacaacctagatgtctagctacagatgaatggttaataaagttataaaactttttatttaaacaaatataaaatgttcacattttttggcgtggcctggtggctcatgcttgtaatcccagcaccttggggggctgaggtgggtggaacacctgagatcaggagttcaggaccaacctggccaacatggggaaacctcatctctactaaaaatacaaaaatcagccaagtgtggtggtgggttcctataatcccagctatgcaggaggctgaggcaggagaatcacttgaacttgggaggcagaagttgcactgagccaagatcgtgccactgcactccagcctgggagacagagcaaaactctgtattaaaaaaaaaaaaaaaataaataaaaattcacattttaatgactgtaaatattgtcatgtgcagagctaagtggtgtaccttttctttcttgaatagtttgtcgtttgtttcggtttgttttttttctggcatttctaattctttctactttccctgttattgccttccatatttttcaaattttctcattgagtttcttgttttctgagagtatcattcagacctgctattccatctgttgtagggagctttctaagccatctgcagaattcccattctgtgactacctttatttttttctctgagttgattccactgccgcttgttttccttgtcatctccattcttggttttactccttcgtttatgtgaacatacctttatacaaattatggaaaaaatttgaaaggaaggtacgtcttctgggattttacacatctaaaaatgttttgttttgttttttcactttcacacttgattgatagtttatctgagcatagaattcttgcttgaaaattatttccctaagaattataaagatttttcttgagtgtcttctaacacatgttgctgctgagaagtctaatgcctatggattctttttcctcttgtgctcccaagaagagagaaaacaagaatactttcttctccagaaagtcttcattcaagaaagcagaagggagggacattttctacatttcctttctggttgagtagaactacacttacctctcctccttcacctgtgccgtgtgattcatgattgagccttatgatctatgagagcatctctatgtagtgatgaagcacttgatgtttagacattcttctcataatagagcctactttttcagaccattgtcttgtgtgaactcaacaatccttatactattgcaatcttaatcctcctaagaaaatggatgcttctggcagaaaggaggaaggccagtagaaagaagttaaaaagagacgatacttcaatctatatttttaaaacttaaaaaaaaattattacagcatggagcatttttctcctcttaaacgtttgattttcaacacctcactcaattgcaaattgagtgatattgtataaaccatcttcacagttatcagcattaaatacctaggtctttcatgtagtatgtgagtatttctgtactgatttattttttaagccaaaaattactagattaagtttcccatggtctagtcatttatgttgcataacccaaatgcaaaagttacccatgatattaaatttgaaattacatgtatatcatgctgcccattgttccaaaaacattggaagacattttaaaaccacatatgtatagattgttccttctgtctgcagtagaaccatgttcatgttttcacgtggccactgacctttggcaaagccaattcaaaaattcagactattatcatcatcagacaaatcattaaaatggagtcaatcatacacccacttgcataaatcattaagacagatgatacaaatggatttgacagaccatgacctaccaattttttacttgtcaacaaagcttagagttaactgaaataaaaccatttcatttagtaggttactgccaaaatataacaaatctatacaaagtttttcatagtcaagaataatttaaaagacaaaattaccaaaatatgaatgtgcttatgataaataagtgctagtaaacccagaataattaccaaagctaaaactacaccattaaaaatgatataagcattttaaataacttgattgtttctatttttagtagttaatggtttgtatagatactttaatctcttctgttcatgttgttttttcagaaaataagtacttaatcctaatcaatgtgagataaattaaggaacgcaggttatatttcttcttttaatgaagggcaaactcctccagatgtaagcatagcatctatttgcagtactgccacataagaagtaaaaatagcttggattattttggtatcaagtaggatttgtagatgaagaatattatctaaattggattttccatagctatggcagttaatattctaactgctgcagaagtaccaagagaaatgcaaagaatcagaatcttagcagtcattcatccattcgacacctactaactgcaaggcacactgctggataatatgcagtatggaaagtgaggacatacacaacttaaaaaatggaaagtctcataataggagcaaaaattattgttagaagagtgcttatgagaagtacagatatcacaacatcattccagattcacagactctatgttctattattcaattaaaaatgtttttagctttattggcttaaacaatagcgacagagaacaagttatttcaggacctatataataaaaagataagttttctgagttcaaaaaacatgggaaaagattatgattaaaatatattcctgcaaccacatggaacgatcatatttcattgtgtcccatgtctgaaatgattccaggtctccatatgaaattgttaagttttaaaagcactatgtgtaacctctaatttttaaatttttgaaggcaggataaaattgttcacccagttagggaactggtttactacaattggtaatgattgaatcattcttgtccaccctaatatttcacgagattttctttctagcacagctcttcctattctctcttatcagtgcttccggggagatttgtcaaggcctttattagtgtgtggaagagacgctagtgttccttgtttcacagatatctatttcctagtacacactgactactgattttgataaaatgataggcttttatacaaacatagaattccttttctaaacacttgtgcacccttaggaaaatttttttcttatgataattggataaaataacataacataaagctggtcaccctctaatttattaacataaacattcttaaattctacttctcagaactaatgtaaaagtcacttcctttctggctgctctagaggttaaaaaaaattatggcactaatagagaagtgaggaaagttaaaattaaaaaaaagaaaaattacttcttgagagtggactatatattatatttttacttatttgcttttttcttttataaaactcatttcctatcctagaacaattcattttcaagagaagaaagtgcacgtataaaacaaaatttcattccgatgtccccaacttaaaactttattcctgttattcccatgttaaaggcacaaaattttctgtaaaaacagataaattctgttttccattttattttcatacattctatttgaaacacagaaaatcccctagtagtagtttagaatttatgcagattctagttaatcttatgtttcaagtctatgaagcatattctaaagcaataatcataacacttaaaatacacttgcataacatttttgttgaagtgggtattaggtatcatatgcactgcaacattcctggcaagggagtgcatgtaatactttaaaatgaaacttccctttttcacttcagctccttttcttgattaagaagctgtaaatgtatcttgcctcttttcacaaatgaaaatgtgttcaaacgtaattaatctaccctattaactctacaaaacatctgctatatttgttaaacacttcaaacttctgttctgaaccagttaattctaagtaatttctcagttaaatatttacatgggcttccatgatgataagctctagcttgtcttaaataatcagcagattgtccagagagagctgtgtgaaatgtaacacattgtaatagctatccactggaacttaaaatggttagctggcttggactattttttgcttatttttatcttagccaaaagaggtaacagccttatgaattccattctttgtcaatatttttaatgtccagaattgtgttaaacggaaaatgaatacctatgtagacctatgcagatgtttaccttgtgaaaatgctaaatccaatctcaaatgtctctttcagaaaagtgataaatctgtatgtgtgcaaaattttagaaataactcaatttacagttatttttatagcagactaagtaaattaaaaagtagaaaacattgataggcatttttcatcagcaaattaaattgaagaagaaaaaaaatccacaggctatgcaaatgtgtggtgtgtacaaagataattaagactatgattctctaactgcacaaattatataaatctgtaaaatatcaggttttggtcaaaaattggaataagttccacaacagagatgctgttacaatggtaaatgattaatttgtaaatgaactataaggcaatttttctcatagacatcagagaatagaatgatcacttcagactgaggaagacagacaagattgaaagttctccaatgtggtaattaagtccaagttttgaaaataaaaatgattatataaagagcagatgccagttctccaacaccaacactcagtattgttctaactaggtgttttcttctttacaatatgccaaatgtttattgagttccttctataagtattgtagaggttagaaaaaaatgagcctgtatcctctacagcaggggtccccaacccccgggaaaaggaccagtaccagttcgcagcctgttaggaaccggaccacatagcaggaggtgagtggtgggcaagtgagcaagcttcatctgtatctacagccactccccattgctcacgttactgcctgagctccacctcctgtcagatcagtggctgcattagattctcataagagcatgaaccctattgtgaactgtgcacatgagggatctaggttgcgtgctgcttatgagaatctactgcctgatgatctgtcactgtctcccatcacccctagaagggaccgtctagttgcaggaaaacaagctcaggactctcactgattccacattacggtgagtgtataattatttcattatatattacagtgtaataataatagaaataaagtgcacaaaaaaatataatgtgcttgaatcatcctgaaaccatgcccccatcagggttcatggaaaaattgtcttccacaaaacttgtccttggtgctgaaaaggttggggaccgatgctctagagctcacagtcaactaaaaggataaatgaagcacacacataatgacctttacaaaaccagaataaggaagaactgtgggagggattctgagacaaatgctgagctctatccaagttcaatttacataaactggaggttaagtatgtctgtaattttcataataagtgatcgataaatccactgtttgactttactaaatgggaggaacagtgtcctggatcattataaataatcctcccagaattttaatttgttagtttgggaatagatattatttttctacagttgattgatctgtgttttactaatgataatattaaaattatttttgctttgtcaatttcaactaatgttcaatactcttctcaaaatgttctgaagattaggagagcatggctagaattacaaattggtcttggatcattcaaagagtgaatgattcatcaaggattaaaaaagaatttcctcaacttctaatcaaacccatagctgggtcctagacttagcaaaactgtggaggaggagatcagagtcatggtaacatctaggaggcccgtaagtgatttatgtatgtgagtttgtaccatatcttagtacttgagtctcgcatacaaaagattatcataaatattttttgcgtttgttaaatacattccaaatcaaatattatatccttgcattaggtagactttgctacataatttctttaaatagtaaagggagtagatttttgattatatgtgtctcagaattaagtgaactccctgatgtgtatgttttagtaactcatgtttaaaaacactgaatgagctgtcagcatttggatgaatatcaaaaatgttatatattagtttgactattcatgaaattataatagttttcctaaggataagagagaagagtttaatctagagccaagatcgtgtcaggcttataaaaaaatgacacaacctccctgcaattatattgtaattaatacttgttatatttgaatttcaaaatttgtttttcttataaacactaggaatttgccattttaaagttggcctaattatccaacattacttgattatatatcatttggcaggttttgttgtttttttgtttttaactacaaacagaactgattagtttttttcccttttttttcctacctaaatcaataaaacatagactccatatgcccctgtaacattaaattgctcccaaagtagataaaagaaatgagagtgataaatacataaatttcattcaactgttgtggagaaggagtaacaaagatttgggggaacagtgagaactgatgacatatgcagaattttttgtactaacactttaaaaaaattagttacaataatttatactgaactctgagaatattaatcaaatgaaagccatctgatttaaaaattaaaatacgtatattacttttttattcaaaataaaattagatggtgaaattaagcatgtatgacattcatgaaaatttagtaataaaataatttacagacaggcaaatgctgagagattttgtcaccaccaggcctgccctacaagagctcctgaaggaagcactaaacatggaaaggaacaactggtaacggccactgcaaaaacatgccaaattgtaaagaccatcaagtctaggaagaaactgcatcaactaacgagcaaaataaccagctaacatcataatgacaggatcaaattcacacgtaacaatattaaccttaaatgtaaatggcctaaatgctccaattaaaagacacagactggcaaattggataaagagtcaagacccatcagtgtgctgtattcaggaaacctatctcatctgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagccttagactcccatacagtaataatgggagactttaacaccccactgtcaacattagacagatgaatgagacagaaagttaacaaggatatccagaaattgaattcagctctgcaccaagcagacctaatacacatctacagaactctccaccccaaatcaacagaatatacatttttttcagcaccacactgcacctattccaaaattgaccacatagttggaagtaaagcactcctcagcaaatgtaaaagaacagaaatcacaacaaactgtctctcagaccacagtgcaatcaaactagaactcaggattaagaaactcactcaaaaccgctcaactacatggaaactgaacaacctgctcctgaatgactgctgggtacataatgaaatgaagacagaaataaagatgttctttgaaaccaacgagaacaaagacacaacataccagaatctctgggacacatttaaagcagtgtgtagagggaaatttatagcactaaatgcccacaagagaaagcaggaaagatctaaaattgacaccccaacatcgcaattaaaagaactagagaagcaagagcaaacacattcaaaagctagcagaaggcaagaaataactaagatcagagcagaactgaaggagatagagacacaaaaaacccttcaaaaaattaatgaatccaggagctggttttttgaaaagatcaacagaattgatagaccgctagcaagactaataaagaagagagaagaatcaaatagatgcaataaaaaatgataaaggggatatcaccactgatcccacagaaatacaaactaccataagagaatactataaacacctctatggaaataaactagaaaatctagaagaaatggataaactcctcgacacatacaccctcccaagactaaaccaggaagaagttgaatctcttaatagaccaataataggctctgaaattgaggcaataattaatagcttaccaaccaaaaagagtccaggaccagatggattcacagccgaattctaccagaggtacaaggaggagctggtaccattccttctgaaactactccaatcaatagaaaaagagagaatcctccctaactcattttatgaggacagcatcatcctgataccaaagcctggcagagacacaacaaaaaaagagaattttagaccaatatcccagatgaacatcaatgccaaaatcctcaataaagtactggaaaaccgaatccagcagcacatcaaaaagcttatccaccatgatcaagtgggcttcatccctgggatgcaaggctggtttaacacacacaaatcatataaacagaaccaaagacaaaaaccacatgattatctcaacagatgcagaaaaggcctttgacaaaattcaacagcccttcatgctaaaaactctcaataaattaggtattgatgggacgtatctcaaaataataagagctatttatgacaaacccacagccaatatcatactggatgggcaaaaactggaagcattccctttgaaaactggcacaagacagggatgccctccttcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagttgataagcaacttcagcaaagtctcaggatacaaaatgtgcaaaaatcacaagcattcttatacaccaataacaaacaaacagagagccaaatcatgagtgaactcccattcacaattgcttcaaacagaataaaatacctaggaatccaacttacaagggatgtgaaggacctcttcaaggagaactacaaaccactgctcaacgaaataaaagaggacacaaacaaatgggagaacattcaatgctcatggagaggaagaatcaatatcatgaaaatggccatactgcccaaggtaatttatagattcaatgcaatctccatcaagctaccaatgagtttcttcacagaattggaaaaaactactttaaagttcgtatggaaccaaaaaagagccagcattgccaagtcaatcctaagccaaaagaacaaagctggaggcatcatgctacctaacttcagactctactacaaggctacagtaaccaaaacagcatgatactggtaccaaaacagagatatagaccaacggaacagaacagagccctcagaaataataccacacatctacaactatctgatctttgacaaacctgacaaaaacaagaaatggggaaaggattccctatttaacaaatggtgctgggaaaacgggctagccgtatgtagaaagctgaaactgggtcccttccttacaccttacataaaaattaattcaagatggattaaagacttaaatgttagacctaaaaccataaaaaccctagaagaaaacctaggcaataccattcaggatataggcatgggcaaggacttcatgtctaaaacaccaaaagcaatggcaacaaaagccaaaattgacaaatgggatctaattaaactaaagagcttctgcacagcaaaagaaactgccatcagagtgaacaggcaacctacagaatgggagaaaatttttgcagtctacttatctgacaaagggctaatatccagaatctacaaagaactcaaacaaatttacaagaaaaaaacaaacaaccccatcaaaaagtgggcaaagggtatgtacagacacttctcaaaagaagatatttatgcagccaacagacacatgaaaaaatgctcatcatcactggccatcagagaaatgcaaatcaaaaccacaatgagatattatctcacaccagttagaatggcaatcattaaaaagtcaggtgctggagaggatgtggagaaataggaacacttttacactgttggtgggactgtaaactagttcaaccattgtggaagacaatgcagcgattcctcagggatctagaactagaaataccatttgacccagccataccattactgggtatatacccaaaggaatataattcatgctgctataaagacacatgcacacgtatgtttattgcagcactgctcacaatagcaaagacttggaaccaacccaaatgtccaacagtgatagactggattaagaaaatgtggcacatatacaccatggaatactatgcagccataaaaaaggatgagttcatgtcctttgtagggatatggatgaagctggaaaccatcattctcagcaaactatcacaaggacaaaaaaacaaacaccacatgttctcactcataggtgggaattgagcaatgagaacacatggacacaggaaggggaacatcacacctgggtcctgttgtggggtggggggagtggggagggatagcattgggagatatacctaatgtaaataatgagttaatgggtgcagcacaccaacatggcacatgtatacatatgtaacaaacctgcacgttgtgcacatgtaccctagaacttaaagtataataaaactatatatatataaaagaaaatttagtttatatgaaaaaaattaaaaatgaatatatacataataagtaactatggatcatgataagtacatctggccttttagtttcaacgtagccatcactttttagaaaaaggtcatattataaaaatgaatgttaattatttttaaattagataacaaaagaatttcttctggaataaggggaataaatttacatttatttgcatttgtattatcagatttttcatttatttcaaaccatttaaggcatttaatagatgatgggtgaattataaatatttggaaaactttttgaaaattactgcctttatccaaaaacttttattggagtggatgagttccccatgtgaattgtcatttggccagtaacaggcacataccgtgatgaataaaatatagattctgttatagattagagcctggtgagagtaacaaatcattacatgaataatcacttaaatgaattagtggtaagtacttgagagaaaaagtgcaaggcactaggagactgaaacaaggcattgtctccaagtggtacatcagggaagatcaagcctggttttcttaagatcagtttggctgtgatgtgaatggatggaggaatgtgtagcttcaactaggaagctcttacagatgagcaagaatatgggagcagcaggagtggagagaaatggatgaatccaaacgtatcttgtagataaagccaacaagattttgtaactgtatgtgagagagaagtttaagagagttgaatgtggagaatgagttctagatttctggcatgagcatgaagagagtgtggtatggatttattgatttggggcatggtggaagaggatccagttctggagggaggatcctgagttcagcatttgatggggtaaactgtggatgcctgtgaggtagcagtggttccatcaagcacgtcgtgggtctgaatgcagctcagagataaactggagttgtagatctgggaattgctggtctagagaatccaaagcccacagatgtgtgagatcaatgtgagagaatgtggactgagaagaaaatgagacaaaaatctcccgcatttaatggttgattagggaagaaagaagcagcaggaaagaagtagtcataactgctgaagttttttttgaatggcaatatcatcatttttaatttcatgtggagtaagaatttctgtctaaaataagaatcaggagacttgactttcagattaatacctgggatttcctaggactttgttatgatctgaaaaaaaaagaatgtttattttccctaccactttatattattacaagaaagcagtaaataatatttttaatattaaaagttcaatgttatgagtaggcatgtttgaagccaacaccataatcatgcatttccttagaatatactttaaaagctactctcaaccaaaaatataattttatttatagagtttaaatgtataaagaggtatctttttctgcttgcaaatattgttaccacttatttatggtggtttgttgaaacatggttccaatcatatgagattcttcactggcggtgaacatttggtctcacacctggtgtgggtctgcctttttttctttctggagttagctacaaagaagccagtcaaagaagggcaattcatcattattaatatattatatagttcaaccttgaaagagctcaaattactttaaaagtttgttttaatcaacaaaataattattaattttcacaacattctttgtgaggcaggtgtacttgaaacagtgtattaacatgtgtctctttttcctcatagggttccctggggatacaaggcccccaaggtccacctggaaaagagggtcagagggtaagtaaagctggaacaactggtgggcattactaacttaggggatacttatttgggaacactaatgaaaatgaaaccgaaatagagcaagcagatgggcatatggagagtatcaattatccaaaggctgaaatttgagattcgagattttgacagaggttttgcaattcagaaaattctatatttttcaagattggcagcacaagtgtagagatattgtttggataaaatgaattagccctaatttgatctacactactttggtcatacttttagtttttgaattaagttgatgagtatctttgtggaggtctagcctatttattaattccataaaggttgtggatattaactacattctttatccaaattaaattattgacttcactggcttttcataactctcctttcattgccatttattgcctttaactgagacaaaatagtaagcaaataaatcatcgttggaattggtagtagagcaataacctcctatttctagtgcagttcaatttcatcattccacagtaaaacgaagccctgcagtgttatgacaactggtcagcttcatatgagcagtggggaccccattcttgtgttttactgttattattatcattttcaaaccattttaaagtctcaaaaaatcttgtgtgttctttctcatgtgcttatttatggcagtctttgtactaaatagtacaggtactgtcaacttctgttcccttgttgatgagcattccatgacttagagtttagatgatgtgcctaaacttgagcttctgactgtagtcctacgttctcttttattattaaccccaaatatgtttcttagacattctcatttattattcccagttctgccttctgtaaaataagtctctttcctcaactacaaatatttgagggtcagtggtgtattgtactaaggtttaccttttatcaagttaataaaattccaattctcttaacttgttctcttatcgtatggattctggactctccaacatgccaataatctttgtcagaaaacactcattggctttccagagttgtcgagaatgagactggatacatgtggtcttacttagggcagagtaaaatgaggcaagtacgccccataccacagacaacatgctactattatggcctaagattgagccaatgctcctttgtctggtattgtacttttgacttgtactacatgtggtcaattaaatgctcctccctttttattttaatgaaaactgctaagtcaggtcttcacccagcccgttgttgtacagttacctttttgaatcacagagtaggaactgatccttgttgttaaatttcatctttattgattttaatccctaatagcattctattctttgggggctttttgcttttaaaaaatgatttgaatcctgttttccagtgaaatatccctcagccttatgctactttaaaatttgataagcctaccttctgtcttcatttaaatcgttaataaatcctgaacagaacagggcctgacaaccctgtgtaacaccagcctaggctaccatcttttccaccattgatgtccttaaagtgtgacaatcaaatcatgtacaaatgtatttgaaccctaccaccttcccacccacatttcttgatttggcttgtaagataattatgacagacttgttagatactgggtgaactgaaaaaatatttaaatgaggctttttagaaataataatgcttcaaattaaaattgtaccctatcaaagcttgcatttcataagaaagtagattaaagaataaattaaacatgtattttccatgataataaagaaggaaatcagttaaattgtaaagttcaaccactattttatgtaaatttactccatttataaatgcgtatagtccagataattttatattacttttatcttctatcaagagtaacataatgtcagaaactaaaaaatgtaatagaacttatagacacttttaggcatagttcgtcattattgctactgctctttcccaaatgccctatttatcaaaagaagtagctagagcaggtattattgacattatccacatttacaaataattatatgcatttggattatatccatatatgctcagtgatttattctactttataagctacttgaatgggaaacaaatgaattttaaaaatgagcgttcttacatatttacatttaggtccaactgagtgccaccatttcttctcagctcaatagttaaggagtactcagctctttcagacatataaatgtatttgtacatgtatgcctgtgtatatacatatgtgtgtatacatacagatgcacattctgaaagctaagaccaataatttttctatttcactaaagtttgcagtagaaaacaatagtgagaaaaatctaggaatttaaaatcatttttatttacccaatgttaaaaacctcttgtattttaattgagtggttgaccaagaaggtattgactatcattaaggctatttaaatgaaacataaaatatgtgaagttttatgtactttattcctagacataatgactttaattaaagcagaacatttaattttaaacaaatcattaacttgttggttttcatcaatgattaaatacgtagtagctactactctaccaatatctcacaattatggtgagtttcaaacatgggtgtcacatttaaacatgctttgaaaaatatcaaacattatagaaacatgttaatattgctattattattatgaaagacataggattctgatcaatgaattctttttctttttctctttaactctttgtgtagtttcctataagcataatagcaacactatttttgcaagtaccacgccaaggttctgtttgaaattttgattagttgattttatttttttaattatcatttaagctgctaaatcttagtttataaagtgttcatttaataaaatgtagaagtaatgtgcttcttacacttaaaagctattcttaacaatgttctgtgacaatatgtatctgaaatttatgggctgttttatttctcaacttcctgattttcattttttggatcttttatatgccattatttatttatttactttgtcttcttgaagccctgcaagcaaaatatttggttgacatattttttagtcttacatcctttatggattcacacagtttttagaattcaatgaatgttgaatattgatcctaagctacagatgagaatgtttcagatcacgatgagggagaacagaatggcattgggggttgggggccttcctggaagttaagagggggtttaatccatcatgaggcagaaaaaggccgtacagaaccaagaagtcaacagaagagcggttctagattcttgaagggttcagcagaattaaaatttggaacaaagtaagtggagggatgctggataagagaagtggctggaattggtgccaggggagagaagttcggttgagtagtgaggagggcactggaaacaaaaatctcaagaaaatgtgtaaggaaattagggcatgagttgtgaggtaggagaggcaaacaatggagattgtggtggagggaaaaggacaggaactggatggaaacccagagaagtatctttgtgaaaagtggaatatttcaggtagcagatcatgttcatggatattaatgagaaacattgcaaaagaactggcattataaaaattccatttaagatgtaggttccttgcaggatttcttagtattcctaacaaacagactctccccaaaaataatgaaaacaataatttttatgtaaccttgaattttcattttatagtcacattaaatgcacatctgaataatctcaaggttagcgtgaagctaccctggtctttttaaaagaagttcctctaggtctctgaaaaaagacatttactggtgaatcaactagttactgccgcaaacagaagtttgtgtggttggaccaagatgacacctcactcttgcactctgttgctggatcctaattttgatcctgaacagaaactttatgttttaaattccctgtaacttacccctctatcctgccctgtcttgctctcaatttatcctctctgcctgtgcctgtcctttttcccctctctgggcaaccatcctcttgattgcctccttgcaacatttttgtgcaggttttactttcccttgaagtgcttgctccaagctggctttgaagctgtgtctggagtcaggattccttgcattctaaacagcacagagaacatcaacctacctacccctgcccccgtcaagatgtgtttctttgcaccagcccacacttgatggcaaaggggctgggtcacatttcctccatgagctgggagcctacaaaagtacaggagggcagggcaagcaacatgtccactttcatcttatggtgcaagcaacttggaatttagcatacaggttgcaccacagactttggggccagattgcctgaattttatttatttatttatttatttatttatttatttatttattattgagagagagttttgctcttgttgcccaggctgcagtgcagtggtgcagtcttggctcactacaacctccacctccccagttcaagtgattctcctgcctcaccctcccaagtagctgggattacaggcatgcaccaccatgcttggtgaatttttgtatttttagtagagatggggtttcaccatgttggtcaggctggtctcaaactcctgacctcaggtgatccaccctccttggcctaccaaagttctgggattacaggcctgagccacagcgcctggcccagattgcctgaatttaaatcccagctttactgcttatgagctttgtgatcttgtgtgaattcctcagccactctgcacctcacatgcctcttttagaaaatggagatgctaataacgcctaccccacagggctgtgatgaggagtaatgccatgtcggtgttagcctagtgatctcaagatgtttatagaagggaatgtaggtatacagcttcagaatattagtacttgattaaggagaatgtctaattgatcaagaaaaaatatttaagataaaatgacttttttcactactactctgttgaatctattttatttaaattttacctgaatcttactttacctagatgtccatgcccattttctaatgccccagaagcttgaggcccagtgttgatctaacttgataataaaattaagtatgtaaaaatgtctgcaaggtagagtagactattgccttttccttaaagaaagatatgaagattggtgtcatcactgtggagtagctgagacctcaaaatttgtttgatgaacaaattgtgctgatcatgtgtaaatttactgggattttcatgtaaaatttacacttggtttttcttttggtttgattctgaactggttgatatactttacctaagacagcacaagtaatgaattatgttattaataagtactggggtatattgatctcattaggtaaaaggacatcaaagtcattgcttctatgaaatcaacacatacaacaggactcacttaagcaaaattttccttaagcttatttgtttttacagggcttgggatatttttcaagtgaaattgtgccctcatagtctagccatgctctatgaaaactttgtagaacacagcaagacagtaatgcaggtcagacctgcctcacagtaaagtaaaaaaataataataatagtgtttcattgggcgcggtggctcatgtctgtaatcccagcactttggaaggccaagacgggcggatcacttgagatcagaagttcaagaccagcctggccaacatggtgaaaccctgtctctactaaaaatacaaaaattagctgggcatggtggtgggtgccagtaatctcagctactcgggagactgaggcaggagaatcgcttgaacccaggaggtggaagttgcagtgagccgagattgtgccactatactccagcctgggtgacagagcaagactccacctcaaaaaaaaaaaaaaaaaaagagagagaaagagtatttcttcttactttaagatagcttattccaagttaccaacttcacagctacaaagtgatctcattgttccaatgaaatgatttcagggtctggtagaaaccactaacaattgtctgcagttgcacatccttacacaggcttgaattttagagaggagtcttatagagaaaagaatggataattatgaatttataggaagtaattttgttagtttcacattataacaggtgatatgattgtcttcttatctttatgtgtcaaaactgacaatgacctttaaaatgcacgatgagtgtttcataattctgctctcactaaaacgatgactggtgtccttccaccaggaatttgtattactagcaagaaaaagtcaaaaattactttaaataatagttttaactctggtcgtaggtagaaaaaaagcatcttttttgcttggattcatctataaatataaacgtataccttaaaaataacacgttaaatgttctgtattctacaactattggttcatgcttattacttgttagaaaattcttggcatacagataacatcgtattttatttacttgctatgacatttcttcagaatgtctccatgaggattatcttgggagtttgcaagagataccatccttaattctgtctgacatttctagatgaataacagggaaattgggtaccctattcaggtccaagcaacaagtgcagagctttctccaacacattgtttgaatttacaaaaccaaatatgaaactcggtggataaaaataagcaaatctgcatttatccctgcatctctgtttgcagagctccatggtggactttggccgcttggtgtctcctaaaattggatcaaatatagttactgaagcaatgtagtaagacaggaaaaagggggaaaggctaatatatgttcatgtcaaacaaatgccttcaagggcgtagttgtgcagcgaggatagtcctttacttttgcctcatattctcttactggtgggaaagataaatcaaggaaaaagatgttggaaaacaacttctagcacaggctaattaaaatcagatgaacaagagatgtagcccagactttgtgatcacaggccatcccttagataaggttaaacagcacagctagttactgacagtgtgcctgtgtctccttgtggtaaatttcactctaactagtggtctctgcagtgcacttgagatagaagagacaaaacgccctggaaaggctgtcaatgagaaaaaaaaaaattgtaagcaatgattttgttccaataatacttatatcaatagtaaagcaacagtgagctgaggtccttacattcacttaaatgaagagctgaatgacattatttgtattgtaacaaaataacataataagttttctcttttatatggattagtaaaggaaaaatgttttgtattttcaaataggaccctgagtctgaatggtttatttatttatgtgaatagacccaagagctgttctctgatgtggaagaggcacatcatctaatggggactccttcaaactggagagattcagcctctgagccgagtggctgagagcttcagaaagaagcctggagaggtgagggtggacccatttcaggaacatcaaatcatcacattttctagctaaaggggtactatagtatcattccagcccaccaaataagaaaacagagacccagaaaacattggcaattctccaaggctgcagggctatttattctaactgttctgcataatatacacccattgtctattttgtggtatcacactgaaacccagatttgcatgttttaaaatagggatattgagaatttaaccaaatcactaacttttaaaaaagttacttaaaaatcactaacttaatttttctaattaaagccacacactagaagggacaaatataggtaggtacagctgatccctttatggtctccacacattgtgatgagcacacattctgtccctataacctgcaccaacatttgggaaccagcaatgcctggccagtgagggaccagggggagagtcagaactgctctttttttctcaggagagcaattggatcaatttgtgacttcagccaaatcactcaagactctagtctaaatttatctgttttatcataacttagccctcaggtatattatgggattaagccggaagcactttaaatgcactctggtgacaggtgttctatgaaggagtcttataaatattacctacttagccacagaaacacttaaagagaatggaaaaggagaaggcacattctgccaaagtggcgatatgctaatacacctgcatcaggatctttattcagaacattacactgaacacgttagtaactatttcatatgtttaccattggaaatgtcaagtagaaagttatttatccatttgggatggagcgaatatatgtgtggatggctgccaaaaccaagaattaatcacaagttattaatcaatttggaaaatataaacagataaattttcagaaatgcaaaacattcggagcatgaaacatttttatggcctaatgactttgaaagccagcaaattatgtttccaataaataagccctcaactttgtaaaactctatagtattttgagttaccttaggtaatggcacataattctcaaagcaactttaattttatagcacttttgtttttcttatacattatattttaattatcaagagagaagctattgcaaagtaaatgtgatgccataattctttaaaaagttgaaaatttatcttttatatgatgtacgtagattgtactgtgtttttatttctaaatttcttggaatggtagtattgagagtcgctcttgaattcttcagaaataccttagaaactactttttctcattttcctcaaaaccagtaaacttttacttggactttttttgtgtgaattattgtagattaatttgatatttatttgatatctctaatatgtccaacacaaacatatacatatatgtatgtacatgtatgtaagcattatccattgtgttttctaaattcacaacagtatacaacgtatgttgtgaccactgtattatggtgtcatttttggctctcaaatcactagacaatgcacttcttgaacactagaaaggactgttgtttgtatttcttatgtgagagatgttaacaatgtgtctatgcaaccgtgagaaagatgactgcagagtatctacaagtatatttaataccttgaatgtgcataaaattcaataatgtaaacacaatttatgtgcattcaatatttttattcattaataatgccactttaagaaaatcagtcttagaacatacaatgaaaagagcaagatatcattggaaaaaatctacaccttttgttctgccatattgaaggccgttgcttcacactctccattggccatgtgttttatgcagtcttccaaatcttttgcagaaacatttccatagctttgtgcatttattcaatcatgtttatagtttatttgtcttcgaaagtatttgagggtcttataaatgcaatcaaataaaaatctctacactgagagaaaaagacaagagctaatgaatagagagtaggaaagagaagaaaataagcaaaaacacctatactgagtgaggcaactgcatttgaacaaaaagcctctctgaaagatctgagggcctatttatttactcaagaaacatttgagtgcctgttttgtgtgacataccatggaagttggcttaagtcaggcttccctaaaagcagagcctaagatgggattcttgtataagcgatttacagaagaaacctgtaacagagtgagggaagcagacaagagaagagaagaatgcaggcaaaatgtggtttcaggagcatcaagtctctccctgatctcacaagacactctggagcacgacagaatttctcctgccttgaagcaaggggcgaggcttgccctcacagggtggggagatgggcagtaacttcccagtatctccaggccaggtagatcctgtagactaaggtaaccctccaggaatgggtgtagatagaagcttgtagcagccaacacccatggcaactgagcccaccctagcctggcaccaactgcacctgtacagaggtgaaataaaacacaatccttaacatcactgacacagaatccttgatggcttttgagtgaaagtgaagacatgattttaaaaagaactttgataatattaacctcacaggccgggttcagtggctcacacctgtaatcccagcactttgggaggccgaggcgggcaggtaacttgaggtcaggagttcgataccagcctggccaacatggtgaaactctgtctctactaaaaatacaaaaattagctgggcatggtggtgtgcacctctaatctcagctatgtgggaggctgaggcaggagaatctcttaatcccaggagacagaggcttcagtgagccgagctcacatcactgcactccagtgtgggcgacaaaggagactctatctcaaagaaaagaaaactattcttgtagtctaatcaataagtaataaagggcatgattataaaaaccagtgaaatggctgatgggagtgacatcaaggagattgaatgaacacagaacaggcaaaggacttaagtttcagaagtgattgctgacgtatcaagtctgaaatgatagtgcctttaaatgaagtagaaaacacttgaagaaaacattcttttagaagagatgagtcagtttgaagcctacagcattagggctacggaaagaatctgcaatcaaaagccccttaagatgtgagctgagtagaagaaccaagtttactgttagcaagtcatcagtttaagggtgataactaaagccatcacaatggggtgagggggcagtgtgcaagggagaaactagaaagaaaagaactgaaagtagaaccttgaaatttgggtaaacctatatataggaatggggtggagagatgaactagaaagtttaaagtatagaaaagtgggagaataagaagaaagttttgaaagggaggagactgcgaactgataggaaattcttcagaggtatcggaggatggaggttgagaaaaagccattggtgatcttgaaggaagctggtttcttagcatgtctgtgttgcacagaggcagacatgacactgcacggatctcaagagtgtagtagatattgagaaagtcaggggattatgaactattattctcaaaagctgaggtgtaaagagagatggcataagactacattgggagaggtcaaggaaaatctttgtttctttttttctcataagtgtatatatatatatgtgaatactcaactacgattacaaactgaagcaaagaagtctgtaaatagggagaaactgaagatgcaagcacaacaaacaataataaattatccagacataccggaagaggccaaaagggaaggcacaggtataaacatgggtcagcatctttaccttgaggacacaggaaaaggaaaggaggggcatggacactcactttgaggacaaagtagaaataaaggcttattgcatattcacattgcatatgcatattcttctcatatagaaagaattttttagtgtagatatgatttagtaaaacatttgctgtttataagaggcattaatcacaagattgttttcaggccaatagatacacctactactttcttccctcatgaacagcgagcccaacttaggtaaaagtagagagaaatatagaagtagaggaagtcaaactaaacgatggtgaaaggggcaggccttgggataagaaaaagtctattattgcaatttcagtttaatttcagttttgctaggtttttcaagctgctggggaaaatgtgggcatttcattttatcccttttatctaagactcctttcctttgtaaattaccagtggtatcttacaagagcatttctgttatcagacatttgtctgaattcatttattttgtttcacaaattcattttgtcagaacacagttctaactccttggaaaactttgttttattggtataatataaatgaggtcagggtaaaatattgtcaaaattaaattgttcttatctttattgcttttggcaactttcacgttttatgtctctgtgcacattctgtaaactgtcatttattttttctcaaatggtataaaatttctgaagcatgctaattatgtatcgtttccaagcgaggaaatgccaagggactggcttaccatatgaagagtcctgcctgtgttttatcagtaagtccttgtggttatggtgatacatttttgtatactctactggtaacttactatgggcttaaaaacctttttcactgggagcttatgcaagtgaatgtggtgtgtttctttgcagctgttgccatagaaataaagaccttttcaaagtaaaatgaggatggcataagaattacaaattcaaaagaagttacgcttctaatttaatatcaaaaatggtgcactattccctttctttttaattttgtcaaaattgcatgacctgagtgcgtctaatatacttttattagataatttctagtatcagaaaagctaaagccgaaaaaatggaatagatgaattccccacagcattcagtaggatgggctttaatctttaatcttttattcttaagacttataatatttctaattgtcttctgcatgctctacctccatactactttctatcttattttccatttaaatctaattacctataatgggctttcttaaaaacaaaccatttattttgctttctttctttaccacatcattttcaacaacaaggcacattttctagcattaacacacacagaaggatgaacaaatctataaaactttctcagattttattactgttcatgttcagactttgaaagccttgtagacttcttttgaaaatgaaaaaaaaacctgaagcagttacacaaattaaagtttataccagaatgtaaatcaacacacagctcccttcattgagaaattcttgctaaaaagaaatgtcagcagacctaaacaataggcttaatgacatggcaaaaattgtgaatttgtaaagattaatatgttaatttggagattattttattttgagataatgtggaaaatgaccatgcatgctgaggtatgatggttattgaggagaaaaattttatcaaaaatattaggattatagaattaattcattgtttctgcaagttaagaaaccagtttattcttacttttttaaaaataaaatttgaatagttttatagacttgcttatttgtctgttatcatcagtattttaaataatgtcaatatttctatgcaaagaaagaatgtaatgtgttttttaatggtaggaaaaaataaaagagtgaacactgaagtttctagagattgttacaatattattctcatagctttacaacagttatcaaagaaacaagtgatgttcttgatattctacatcagtgaaaagttatcttcaaatatttaacaagtttgataaaacatttcaaattttattttccaccaaaagaagatgcatatataggaattctagaatgttgaatttatttatttcattgagaggttgtttaactttaataaataatttatagggtgatttgctttaactgactactgatgaagaattgaagattaattttcaaaatacagcatcacttgctccatttttaaataaaagttgtaaataatattctgagagtctaaaattacttcaaaatttcttcttccatttccttcaaaatatctttgttaaaatgatttctatcttaatgtcattaaaacaaaataatgaagcacttttttaattaattaattaatttctgagacagagtctcactctgtcttccccaggctggagtgcagtggtgcgatcttggctcactgcaacctccacctcccgggttcaagcgattctcctgtctcagcctcccaagtagctgggactagaggtgtgtgccaccacacctggctaattttgtatttttagtagagacgggtttcaccatgttggcctggccggtctcgaactcctgacctcaggtgatccatctgccttggcctcccaaagtgctgggattacaggtgtgagccaccacgcccagccaatgaagcacttagataaaagttatcctctaaaacaatgatccccaaccttttttggcaccagggatgggttttctggaagatttttcaaggactggggttgaagatagggtttcagggtgaaactgttccacctcaatcatcaggtctagtttgattctcataaggagcgtgtagcctagattcttcgccatgagtggttcacaatagggttcatactcctatgagaatctaatgcccccactgatgtgacaggaggcagagttcatgcggtaatgctggcccgccactcacctcctgctgtgcagcccggttcctaacagtccacagaccggtaccagcctggggcctgggggttggggacccctgccctataagaaatgtcaattcaacttgaagtagatatgttaacaagcaaaaagcaggatcatgtcttacattaaaaactatataatagtgtttatttcttcaaagagtgcatataggtactttgtatgggaaatcactatttcactcatgattttttgtttcattgtaattacaaaatgataaaaagttaatgagtgccatagggaatctttatgtgccttatacacactttaaataaagtgtacagttttgtaatttttttcatttttccctaatttttaaaaattttatttttaaggcataattttttgtttgttgaattcagtaatatacactggaatttatacttcatatgtgtttatttcatttttttctagcaattcagctttgttatgttttataaaagtactgattcatgacagattggatattttaaaaaccagtcctttcccatagaattagagaagtgctgatttagtaggttgcattgattataggctaaaactgaaacaacaaaaactttatcaccagcagaaggaattcattttactgaagtatgattagttaagctttttaaaacagtttagccttgtaataattaagagaaatgtgcacttagccaggtcaattctgaaaattaaccagcaaaatatacaatgaattctcagctatgcaacatatgttaccaggacttagaacccaggcagccatattctatataaagcaaggataacatgtttcactgtctgttctgttttattcctggctacctggactagttctgctggagtccatatgcagggcaagacaaccagtagggctaaaactgattatataaatagaatttctgaaaaagtattataagaggaaagagcagtttcctccctcaactctttcaaccttttttccccccggaaaaaagataaaatgaagttaatggacaatttgtgaagaatagtccaacttacctttttaaaattggaagatcccttttacacaaagatttaaacagataatctattatatgaccacttatagctaaaacaccctcaagtttaacaaaaaggacagttatttgatagatttaggtatgtggacagccaaacaagcagaaaccatttaagataagataatccaggtaacggttggtgaagataactaactttaggatcgagtttagacttaatgttgactggcacgaggatgctgagatttaaagaagttaatatgacttgttcagagtcacaaagccagaaattggtagtcatgttcaagtctatggccgaattctgctccctcaatagccatatttttcaacccatgagttgtgatccatgagcaagtcagaaatcaacttagtgggtgacaatcagattttctttgaaatattaacaaatggccagaatacaatagaatatacaaaatggtttaaccaatgtagaggaaaatcagtgtcgtcagagagaagcctgatactgacacagaagtttctctgcctattttcctctgctcagcccgttttctgtctggaggctgccttgattcattcccctactaatcactttgattttccttctcttccagatgtacagcttgtgcagatgaatattaggtggtgggtagagatgctccctctgctgtagagtggctttggtgaagccaaccaacccacagaccttacctctataaggagggctgtttgttgtttgattagtttatgcctctgatgtatatctggttccttgaaatttttattaataaaatgtaaccctctgtataacctcaccaaagtaaaatctcaaaaggcattaattctggagtcttgcaaactcctgggtgagccctgcctgtgtgacccagggaatactacttagcctctctgagtctcagttcttcagttatacaaccgaaataatactaatggtacctaacccgaagttgatgattagaaaaatatatgtgtaaagtagccaatacagggcctatcacatgctaggtattcaataattgctaattattatatcatagttataatattaatttctaagtatttgaacataataaaatcctctagcactaaaaccatggaaaagatttagtgtttcttttggaatccgaagacttttctggatttgttgctagcacagttgcccaggaagaagtgtgactagccagtgggtgtttgggggtgaaatccagcctgtgccctgctaactactaacactgtacctcagtgtagagctgcagctaatagggaaagcactgtatctgctaaatggagctctgtctcctgagtcattaagccagttagcactgtcctacagaagcttggaagtgccagttagtagacttttccatttagtaaagtgctgaataaataaacttttactacaactggtttctttaaagtgtttgtacttctaatgatattctagaacagttttgaatttttttctctttgtcatcacatagatgcttgtaaaaccagccgaatatcaggaataaactatttataacataggttgacatggtactatttgaaatgttttgtggactgcagatgtttcataaggattctttattctttttccttccattccttgatgttatggaatatgtcagaaggcttttttaaggtcaccatatatctaacctcttgaaaacgtatactcttatttcaaagctctaagaaactggtacctggatcactagacccaaatttaacttcagcttgctcagtttacatcttaaactccatttaaaaattgttattgtgctattagagaaaagtcccatatgatacccaatttgtattttgaaattcagctggataaattgaaatgctgaaagtgagttatgctattgcaacactcaccatatattaataactgaactgatatttgcgggataaggtttttctatcagagaaaaataaaatgatgttaaactgctagattccttggatggttagttcttttctggggtgaaagacttgagcaacactagaccccagtatacacaacctcaaaaactaattgaggctttgccctataatataataaatggccctatacttttcgtatttctatattttactactctagaaatatttccatttggaaatgttacctatccacaacagaattcagcattcacagcagttaaatataacaaactatacacacccctgccccacccccctgacacacacacaccaaggataaatcttaaaaacaataatattgaatacaagaaaaaatacataagtacatatatttcttttttaagagtacatgaaacagaaagataatgtaaactcgtgagagtagttatcccaagaggaaggtgagggaaaaaggactacagatggtcaaaaagtatttccatttaatctatgatattttgttgattaaaaaattcttgaagaaaatatctcaaactgttactagttgttaatgctgtgctgtgggaaaataatcatttgttatgttactctttttacatatctgcattttaaaactatctcaacaaaataatttcaaattttttacaaaggttttatctcatgttatctacagcaaaaacaaaaataaaaacaaaaacatcaccagatcttaaagaactttcaaggcataattagtttcatggttttgatgtcgatgctcatctcaaagtatagtaatgaatgcgatcacactttttctcattagtacaaactcctcatttgtctagtacctttcaaaaagttacgtttacttccattttcattgttagctcagtccaaaaacaagaacaaatatttattgagcacctattgtttgccagaaactgctgtaggcagaggataaaccaatggacacaatagactgggaatcagcagactacagcccttgggccaaatctggtgtaccatgtgtttttttttaaataaagttttattggaacacattcatgcccatttgcttacatattgcctttgggtgcttacaatagcagagttgagtagttgtgacaaagactatatgtctcacaaagcctaaaatatttactttaaatatttcttacttttcacaggaaaagtttagtaacacctaaaatagtcaaaaacctctgccctcatggaacttacattctattatggagacagatggccacaaaataaataagttttagtgtggttgatggtgatacatgcaaccaagattaagaaagcagaggaaggggatatgcagtgttgtgtggaagtcagagaaagccttgctgccaagctgaccgtggagcaaagatctaaaatagatgagggccatgtgaaaagctgagggaagctctttctaggtaggggaagcagcaggtgcaaaggtctgaggcagaaatttcaaggaactttaggaggtcggtatggctagaatggtgaaggaagatgagaggaggtcagagagtccacacggaaaggcagagcacagccttgcaggtcattcattataaggagttcagcttttactctgagtaagggccctcatttgtctgttgtaaaatctagactgttcatttcatttagaaacagaggccaaagctatagatactgactccttaggtcaaatgctattcaagtctgaaaacttcaattctaacctcgccagcaatggtaaggatcgccacactgccagttcttaccagtgctaccaggggaagaaagcaagaaaactggtgactatatgttgccacaatttgaaaaacatttctgtgacacatctatcccataagttatccatgatgacacactagtgtcggcactagagagcacatgctatgtaaggttttatttcaggccagtaggttggcctcaataacattaaatttcaaactgaggatttggggtatatttttcttagatatttgccaagaatgtaattgatcactggctctacatctgaatgtgttcagccaccttctacgtgcccctaggcagtttaattcctctgggaatgcttgggaacttctgcacagaagaatgggtagacctttcacagagagttcattccgtggcagctaccatacctgccctccagaatttatagtctaatcatgaggaaaagatcatagaaagcccctttcaaatgtatatatttctcttaaatacctctcagatcttcatatattctagcccactatctttaggcaggtatgtttttattccttttttttccctaaggtagaaattgctcaggctgagagattatgtgactttttcagattcacttaattaataaatgaaagaggatgtactagtggtcaggtatctggcttctcatacaatgcacattttttttctatcctgttttttaagtcaatgatcaatttgtgtcataaatatatgagttagaatctgtatcacctcaatataatatacacccttctaaaatataaagcatgactatgggtaacaagtattgaaagtatgccaaaatagaaatattgctgctccaatcatccaaagccactatgtccacgtttaatgcagacttataattcttgaaaatactggtgaactactattctcttttgtggatctatttaaatagccttatttttttgtgcagaacaaaacttatattgaggaaagaagagaaatattctaataccagactatgagctcctcgagggcaagatctgtgtataatttttctctttactctccaacatccagcatataataaacacttaataaatatacaaatgcttatcattgatacaagactgtctttatttttcccattcatttgtgttcctaagtggcagttgatttctcattaaagtagtaaaaaatctgtaacttcgattgtttccaacattagctcctgtagttttagttattgttgatttttgaaagatttaaattaagggtctgtcttcaggagctcaaacatctaaatgaacgtatgaatattgccatgtaattttatgtttgaatcccatagacaagtgactggatttttctctttgcctctggagatcttgacatcaaatagatttcacctacatgtgttttctcttttgaatggatttaaatcatatttcttcaatttgactttttccaaataatcatctggtaaaaatactttattatgtgtaagaaaaagatcaatataactttacttaaatgtatagttttttctcagttgttggtttgtcagccatgatccaagataagggctttttttctttcattaacccctcaaggctctcatttgcaaagtcaatgggacagttaggcatgtattttttagggcatctttgtagctttgattctatattttaaaagatgcccaaactatggcattatttcccataagatctctaagttattggttgatcaaaatataaatgagacaataaactacatttgcatatttctgtggatgagtttaaacatccttgtttctcctgcaaggtctttcacttgagttaggccagccaactgacatattgctcattaatcatacatattaactggagtagttaatgcttcaaaatccaacttaccattctgtccacagggactggtttgtgttttctaaatgtgatgacatatgcttcagacactgctaattaggcctttcccttgaaaattcatcctgacatgtttcaagaacacttttctcccttgagtacaagttcattaaattattaatatccttttataagtcttgtaggactacttacacaatgcagctttctctgttttcaaaactatagtttataatgaaggatgaaatagatctcacttccttatactgtatatctttttttccagtcaaaaacaatgggctgggtaaatatcagagaataatagatactatattcagttacataaaatgttaatgtaagattaaaaatattttttagcctgggcaacatagagacacccatctctacaaaaaaattaacaatttgctaagtatggtggcacatacctgtagtcccagctacttgggaggctgaggcaggaggatacttaagcccacgaggttgaggctgctgtgagcaatgatcacaccactttacttcagcctgggtgacagagcaagactcttatctcaaaaaaaaaaaagatttgcacatggaaatggaaatggaaatgttatacggtcagctgtttgtatctgtgggttttacatccgtggattcaaccaaccatggattgaaaatatttgaaaagaaaatatggttacatcttactgaacatgtacagacatttttttggtcattattccccaaacattacaatataacaactatttacatggcattttcattgtacgtattataagtaatctaaagatgatttaatgtatatgagagggtgtgtgtagcttatatgcagattctataccattttatataagatacttgaatggctatgaattttggtattggacagtggggatctggaacaaatctcccacagataccaagagatgactgtacatataatcgactctacacacctgtaaggaagtgttataagcaatctaaaacagataacctaaaattagttctattgagcttctgtattaaatgatgaatttggtggcaattttaccttctggcctattatctacctaagcaggtgcttataccaacctatataatatgacctttttaagacgaaactcctaacggcttcacatcacaatcacagtaatgaaactcagagcactcaccataatctacaaggcccagcctaatctggcctgcctgccacccaaccacacacttgctcttctctagcaacctgtgtttctttctattccttgaagaatttgttcttgctgttccctctactggacagctttccctggatgcacctggatgctctttctcagaccttgcatgatccttggactcactttgttcacatttctgctgagggcttccctgatttttctatctaaaacagcacaccttcctgtataactctgtactgccttaccctgctttatttttctgtatttcctatcactatccaaaattcgtatctttatttatttagttcttagagatgcaataagtatagcctagtggtaatggtcagagatgatacagccaagttgcctggattcgagtcttaactctggtgtttactggccccataaccttgggcaagttatgttgtcactaatttgcctcacccttaaaatgggaatacctcaaatatattttgaggattaaatgaataaatatgtgtaagtttctttgaatgatatttggcatctattactattattgtccccactggtatataagctctattgagacagaattcaaggtatttccagagcatggtaaagcatctaacccacaatagggacttcgtaaatacttcttaaattaatttatgaacaattctgggcacatgccagctgaaagtggggaaaatatcttataaaaacacagcgaaaagccagcaggtgaacaaataaagagtttaaaagtcataatggaaattttatgtagttgagaaagctgagttggttatgtgagttttgtaaatgtaaatgcatatgtactagatgtagcaagaatgaggggaacaagatgtatttagggtttctgcctttaggatacttccctagaggtgaacagagaaaaagtcaaagaacataaaaagaatctggcgactgaccaacaattgctgccggcaggaccaactgggtcaccagctttcccaggaaaccctaaccttactttgggaaatgttggatctgatgggagctgagggaaggtaaattgtaaagcacagacttcaaattacttttacccagttacagcttcaggtgacattggatgttaagtttaaggaagcgaaaagtagtattcaaataaagaaaaatactctcggttttgtacaatagtatgtcccaagtgttcagtttttaaaggtcatcgatacattttccaaatatttaaatcaatcatgcaagaaaaagaagtggtgagctgggaaatgccgtctgaacacacttgatctaaagcctggggataagtatcagaagagaagagaaccgaagagcgcacacacgtctaagacaggttaccgcaggtgcatccagggaaagctgtccctgtttgaggacttttcaggggatataatgtcccaggttgttgctgaggttatgtaaatgactttttctacccacattttcctcctatccccatgatccctccactccagagggaaactggagtgctgaggtcatctataaccaaatgaacaagtctgtctaaatgcctgttgcaaataattgtcccttctcttccaccatgaaggcaagctctaggtcttaatcatcttaatatattttccccaacacagcaggtaaaacagacagtaaatttctgccaaataaaacttactcacatctttttgatagggtttttttctgaaatcagcacttaagtatcaaaatgcaatttaatccattaaattcacttcaattaatagagaattacataaggaaaatttttccatttcaaaattgggtgacctttatagttccacctcactgatcctctagagttctcttcatttgtcagacagttattgaatgactgcaaaatgtagttctgtgaacttattttgtactagtcaattcaatcctggacactgaatatgtagctctaaaattctaccccttgagtatatcttttagattatgtaactcagaaatactgaaactatgtcctgtcactttaccttaattgaaatcaagatatccaaatattactaatgattatttgttccaatgctcactggtgatgctgagcttgttcctgtttcacgggcttagcctctgacctgtctgaagtttgtagatgaacttcactacactgtttttattttaacatttctattaaataagacttatcattttatatgcattatttgtccctctgcatgtcaattttgttgactctaaacctacaaacataacagttcccataataaaagtgaaggagaaaagtcttcattcatgaggcattgtgaaagtggaatgttttagagatgtggaagcctggcagcataattctcagacaggaaggcaatgtatataaaggccaaattccccttctccagtatgggagtgtgctgcctgtgaacatccaaatatggaggaaagaacgttttcacaatgagctttcagcttccaccagcttcatgtggcaccaagatgttaaaatacatcacagtatattcaggaaattgtttagccataccctaccactgccccatccatgatactagaccaatgaagtggcttggcaaatattggcaatgacaggcctagaaaacagagccagaagttgggccttagagagttggtggtgtggcaaggcagttaggcattccaacaaatctaaatggaaggtttgggttggcctcagaatcagggtagagagacgtgagggcaagcagaaatcaggcaagcagaggagaactaggaagatccacgttccaaagggaaaagcagcaagtaaatgggacatttacaaaatctgacttggtagtgagaagaagagaagctcaaaaattataacagcaaaataacctaaattgtgaatgatcgggatactcacatcaaggaaacgttaatcctgttttaatgttttaatgaatcatttattcagattatcatttattgaactgtagctcaagaggtttagataatgatgtcacaacttctaacttgttttgaaaagccacattagttacagatagagtccatctaaggggggataaaaggaaaggggcagagagatgagtaaatactggaatgaagtaatttaaaaatgttaagatcccagcctcaataatgttcatctttccttagctctgaacctatttcaagtcatttgttcatgctgaattgcattttcttctcatgtccttacgagagtcacttgtcagatccctgaagtaatgagacctttatgactagtgttgttactgtcatagatacattttaaaatatctattaagaaataaaatgtacttaacatattatgtcttcctcagtaagtattccattctcatttttacacatatcattgagttcaaaatgtaattctttacatcaggcataaatcttatttcctttcatgaagttaaaaaagaaaactaaacttcccagatagtctgtaatgttttcctgtgtaattaacacctcattcacagttgtgtgtgccagtcaaggccctgtctcctctttcctaacatttccttaataccttgttcaggctgagctgatgcctaacagtgtgcaaaatacacatatggaaacaggggaatgttagagagaagtcagctgaattaccgtgacctgccagtttaaagagagtacttagacacaggtttcattttgtgggtttggggtctgtgtgccatcccttaagtccaattactgctgtaacctcatcttcttcatcatcatcctcatcaacaataaaaaccatctgtcaaatgaataccaatagtccattatttgcattcttctcttcttaatgcttctaagagggccaaatgtttataaatcaagtgtctaatttaagatacacgttctctgacactgcaagtcatcctggaagcattaggttatttttactgttgaaaatttgtagatgtcattgatttaaatagccttgtatctttttttcttgctgttaatagtgaccctctgtgtccttgtgcacagaaaatgcaagtggaatcaagctttagatcattcaaataaaatcattccattgtgggaatctcctggcttcatttttaaaagttatattgaaatttaacatacattaagaaaaatgtgaatgtcataagggtacagcttgatgcttttttataaaatggacatacttatgcaaccaccacatagtccaagcaacagaacatcatcaccccaagaaactcctctcatgctttctttcagtcactttccactctcacatgggtaacccgttataacttctaataggatagattaggtttgcccattttgttctttgtatgatttgatcaacattatgtttatgagaaacatttatattgttgcatgtagttcaatttcattcattttcattgctatcaaatatatacttttccattgtatgaataaaccacattttttttatttctacctctaatgggtatcttgattgttattttagattttttaaaaaactcatatccacagttaaaaggtgattacacttttctaaaggatgcacactacatattttggaggttttcctagagacattatctaacatttttatataaaaatggagaattggagagagggtagtagaagggcaatgaggaaaggaactaatatttattagaactaccatgtactggacattttggtaaaaatagttgttttcttttgaattgtggtaaaaaatatataacataaaatgtaccatccttaccacttttaagtatacacttcagtagtgtcaagtatattcacattgttgtgaaacagatctccagaacattttcattgtgcaaaactgaaactctataaacattaaacaactccttttttttcctcttccttttcttcagtcactggtaacccccattctattttctgtcctatgaatttggcttctttagatacttcatataaatggaatcatagagtatttggttttctgtgactggtttatttcacttagtataatgtcctcaaggttcctccatgttgttgcatgtgacaggattttcttcccttttaaggctgaaaatattccattgtatgtttgtacaacattttatttatccattcatccattggttgacatttgggttagttccacctcttgtctattgagaataatactgctatgaacatgggtatgcaaatatcttttcttaaaactgtttccaattgttggagtatataaccagaaatgggattgctagatcatacggtaactctatttttttttttttttgagagagggtctcactctgtcacccaggcatgagtgcagtggtgccttctcagcttactgcgccctccacctcctgggctggagtgatcctcccacctcagcctcctcagtagttgggactacaggcatatgccatatgccaccatgcccagctaatttttgtatttttttttttttagaaacggggttttgccatggtgcccaggctggtctcaaacttctggcctcaggcaatccaccctcctcggcctcccaaagtgctaggattacaattttacaatcccatcaaccttgcacaagtgttccaatttctccatgtcctcaccaacacttgttttcagatttgttgatagtagccatcctactgggtgtatgcagtaggaattttaccagtgatctttttattcctttaacaaagttgttgcaaagtataagtaccattttacatcaatgaaatcttagcacaaaaggattctataagagaaaaaatggggcacagggattttccagtccaggtgctcttgaacttgacaatgagcattttattctcaaagttccacataatcacaaaacaaattgaattcttttgttctgagctgcaagatataaggtgctctacaggattgcctgactttaaatatgaaataacagctttagttttagagtagtggttctcataacatggtccccagaccagcagcatcagcattactgcaaacttggtagaaatgcagattctcagatctcaccccagacctactgaatccagaactctgaacagccaagcaggtggcacacacctgtaatcccagctactcagaagaggggctagctctattaccgtgacctgacagtttagagaaagtacttaaatacatgtttcatttgtgggtttggggtctgcatatcatcctttaagtccaattactgctctaacttcatcatcatcatcctcatcaacaacaaaaaccatctgtcaaataagtaccaatagtctattatttgtattcttccctttttagtactcctaagagggccaggtgtttataaatcaaaagtctaatttaagataaatgttctctcacactgcaagtcatcctggaagcatcaagttaaaaaaaagagctttttaaagctattttttattgagacaggatccatgctggtcttgaactcctgggctcaaatgatcctcctgaggtttcctatgactgatttattttacttagtataatgtccttgaggttcatccatgctgttgcatgggccaggattgtcttcctttttaaggctgaaaatattccactgtatgtttgtaccacattttgtttatccattcatccattcatggacatttgggttacttccacttcttgatcctgaggaggattgtttgagaccagcatggatcctgtctcaaaaaaaaaaaaattctgcgagtgaggctcagcaatctattttaaaacagccctccaggtgacactcatgcatgctcaggtttgagccctcctgggtttagatcattaggcagatatctaaattattgtctaataatctccacactgttgccaaacagaaaactgacatattgagcactttcaggtttccagggcaacttaatagagtaaatctgtgttttgctctttataccacagttttcaggaaaatgttggattagcccagttataataatgctggaacactagatctctatccatctgaaagttcacccaaacactaatttatcagagttgcttctgaacaaatggccacctgagaatagccaccctaaccaggaagacttattccggctcagcagatatctgacttatctccaggattttcactccacccacacccaagtccccaccttttgtctcacttttgggtctagagagagccttgtaatgaatggaccaaaacagccagagatagaagtgaaagcaaacatgcaaacattcctcccattggcatcaggagccttcttcctgtacctactaccaaccgccgcaggccctggccccagctatcctcaaccacttccccagagccctgcaaagaaaataacaaagattcacagattagactttcctctgaaaagtgggggaatctgattttagtcctaggaagggagttgtggtttatgccttttttcttggcctaattattaataaaatactcccccaaagtatcctagcttaaggagtaaaattcaccctaccaaaaatctacagttagctccttttttaaaaaacagaacatttattgtgtgactaatcattgaaattcttaagataaactggatgctacaacagctgccctcttgggtttagatgttgttccttctcagaatccacgcctgaatctgcggtatacaatattcaggtgcctcattcgaccagtcctggtattatttcatctttaagccttggcacttcagttatacttcctcttgcacttagcagggtagccacatttgccacaggatgacttctgaaggtggcaggccttagagccacagtggtggcacaatgtgtgcgtcttactgcaacacttttcaaacgatggcgttcccttcagtatcttgcttctgtggccaagaccaaagagtgttgttagctcttaggtaggcttttgcctttccctaatgcttttaagtagaagatagatgatccttcagaggaacaggagacagtgcggctgtattcggtgcagcttggggccttgaaggagggaaacaagacaagggagttaattcctaggggtccttggagagaagaacaatgatgtctgggagtaggcatggactattgtgttgatagaaattgcagcccctaagaaaggtgccatggctcacacctgtaatcccaacactttgggaggaggccagagccggagaatcacttcagtccaggagttcgagaccagcctgggcaacatagtgagaccctgtctctaaaaaaaaaaaaaaaaaaaaaaaaaattgagaaaaaaagagattgtgccctgcctggacccatagctctgttatgctctaaagcttccacccacatttctcatccatccacccctctcctctatcctccacaagtcactgatacttgagacttaagtctcaagagtttttcctaaggtgaatcttgtttctagtacagattgagcatccctaatctgaaaattcgaaatctgaaatgctccaaaatccaaaactttttgagcaacaacatggcaccacaagtggaaaattctacacctgacctcacatgacaggttgcagccaaaacacagtcacaattttgttttatgcacaaaattatttaaaatagtgcataaaattactttcagactatgtggataaggtatatatgaaacataaatgaattttatgtttagacttggggcccatccccaagatatatcattatgtatatgcaaatattccaaaacaaaaaaaaaattacaaaacacttctggttccaagcactttgggacagatgataatcaacctgtatgtatttggtggtaagcctaacaaaaaggtaactgcactgctttgtatagcacatctttaaaaattgttcaaatctgatttaaggtgctaatagaaattcaagcctagaaactacatttaatgtgaaaatatgtgctggccaaagttgtgtgcacacaatatgttccaattacttagcaacccccaaaaatattttacctgcatgtccactcggcaaaatcagccttctctctgccctcttccagcatgcacactgacactctgacactctgacaatggcaaggctggctgaaatcagcagtgaagtgcaggaatctggatgcttgccctcaccatatcctgaatcttggatgctttttactcctcatcttaacacatgccaatgttatgttacaatatctgacatttggtttgtttcaacattaactctgcgataaaagttaatcaacagtcagcttcattttccccgcttcctgcccaaatcaatatacatgactcctttgaagaaaggggaatgtaaactaaagttgatcctatggttttaacttacctcaacctaatgtatgcttaaggaaagaaccaatcacttacctagataccattgatttagtttctttgtgttgttgtgaattaataaattacagtgtttccactttctaagtaaactttttatcattgattagtcctcagaggcgaatttacttatatttactaaaagaccaaatatactgattttcagaaaatgtaaactgcaagactagaacatggtgtacatgtgtataacttgttttaagtatagagaatattaaattatatgttcatttcaatcttacaatcctccaaaagaactgcatggtttagatctataaaatgaaagataagagaaaacactactattaataattatatttgtgtttttaattttttttttttttttttttgagacagagtctctgtctcccaggctggagtgcaattctcccgtgttcaagcaattctgcctccagagtggctgggattacaggcacataccaccatgcctggctaattttttttgtatttttagtagaaatgaggtttctccatgttggcctgacctcaggtgatccgcctgcctcggcctcccaaagtgctgggattacagttgtgagccaccatgcctagcctatgtttttaatttttaaaaaattttaaatctgttctgtagatgttaactagggctatttatagaaaaggctgctgttttcatataaagtctttgatggtatcacctaatttcccttcaggaacaatggacacatttctcatccaatcccagcattgtatttgcttgtttatctctgaaaacttactctactgtttcaactggcatttagacctcctaccccacttcaagactagatgaaaatcagaggaatcaggcaactttgcctgacattttcagagcaagaaaattggtgaataaaatgggcctttctgtgcctacacttataattctcccccaaaaaagcattgaaaagatcaacctaatatctttactttataagtatcaataaggcttaatatgtacagacagtttaccaatgtgataatcaaatagaattgttagtaacaatgaaatagagtgaccatatttagaaaacatatgctcataaatgcttctcattcaaaatgtatgctttcaatacctaagctcacttccctcttttaaaaatttaaaaaataaaaaatgtttaagaaaataattttataataaataatgaaatgctttttaaatgttattagattcacgggtacttagagaggttagcacaacatcttgcgattggaatttagctagttgtgaacttgggagagttaatatttggttgtaatcatgaagattaacatgcaagaattatacattttacttcacttataaaaacagcttaaccatctaaagggaagaaaagagctaatgtgcttcattcagtatatgtaattacaatagggcttagggcagtgctttccaaattttagtgagcataaaaattatctgaagtagttttaaaaatgcagattcgtggctccgacccccgggattctaaaccgtgaattctaggatgaagtccaggaatatgcatgtttaacacccaaactcaccctcaaataactcatacaaaattagaattcagacccctcttggacaacaccaacataagatgacagatgtacttgttattgcatccgaaaccacagaatcatcagataaaatacccatcttagaccatctttcatatactttatattactttgctaaagaaccaaggtagatagcatttaaagggctgctgataaaagttaaggtttattcatttcaggtactatacttctcattatggtccttaaaaattggcccacagcttttaaaattgatatttaaaagtcatgtggaattggaattgtttcttaactttctgttcatttttactgtcttcaatattcccatttaatattgtttgatattaaaatataatggagtcacagtatttatcatctattcttctttggtttcaagggaagacgagggaaaacaggacctcccggaaaaccaggacccccaggaccacctgtgagtaagcaatacaatgactgtccctttaaagagtctgtctttatgtctgtgtgtttacctaaggattattttactcccctgtagataatgatttcctttattctactgtttagaatgactggtttcagcatttggatgagtagttcatactctctatattcctaactccatcatcaccacaaaccaagagatgagggaggctggtaattgtccatacacctcacccacttctttattacacaaatggcaataacagtagtgtctgcttgaacatcccaagccaagtgtccagatagatgaatcctgttctgaacctacctgaacaccatcttctagatttcttaacatccaggctgttagaaaatcagacatctggggaagcatatccacttttcttgatatgaaactattttgttagtataatttcatgatttggtaaaaagtgctataaagatcatctaaccagttagcttatctggatcctttaccccaagcttctagaaaaaaaaaatattcaatttcttgtagttctggtaactctgcagcctatgagagtctggtttgtgtccaagctgctccactgacactgcactctctgtggtcaccaacaatctctgcattgcagattccctgagcacttttcaggcttcttcttactttactgctacacagaaatgtatactattgactgctctctccttgaaactccctattctgttggtttagcaacattgggtttttttctcctatgcctggggccatctttttgtctccattaacagcttttcttctaccccctacatgttggatggattaatgaatgccagttttttatttcaacccagacattgttgctgagtcccaggctggtacattcctttattttttagtatctccacttggaagtctcctagctaccacaaaagtataatgtccaaaactaatctctaaaaataatcctagatttttttgttcttcatcctcttcatctaaacagtctctaaatcatatcagttctacatcccagtagcccacaaatcctctccgtcttcactgtcaacggccttagtttagacctctgtcaatttgaacctatatttttgaagtcatctgagagctggtctcattgcctctaccttctccaagtggagcaaaacctctaaatcatgacagcatctaggtgggcttggatggcttaaaattctctaaaagcttaaaactatttgattttaaattcctcaatcgcttcttttttcttcaagaaagatggattccacatcctctacatgccattctgggcccttcatggtttgccttttacctgccttggcctatcctcctctatgcccttccttcttttgtaatcagtaatcttcgcttactatttcaaaaatgccatcacttgcaaatgttctccagtaggcctatatatgcttctctctatcttcatgactcagctcaaacatttctcctatagaagctttgccagtgctctcagcatttgaggtttcctcccatggtcctgtatcttacacctcggacagacacggcatgttactttggactcttattttcctcatctgtctgaccactgcactgtgacttttttgaacctctattttctcaccattgcttagaacagtctctagcctatagcatgtgattattgtttatttaatgactgagtaacaaatgaatatattttgtagacgaaaaaattaaaaccaggtaagtgacctaaagaccaaaaacaccctgcaccaccactagagggcctcaacccagtaccctaggaatctcttaggatgtgctcacctgccaaaaatgaacatgattgctgtcctgtcattgatttcatttcactttagccattctagtggattgtcctattaacaatgcattggtgccaattgatatttgttatataaaagcacattgggggaatgagggggtgaggaagcatgagctgggtgtctgcattagtccattctcatactgctatgaagaactacctgagactgggtaacttataaagaaaagaggcttaattgactcacagttccacaggttgttcaggaggcatggctgggaaggtctcaggaaacttacagtcatggcagaagggagaaggggaagcaagcacatcttcacatggcagcaggaaagagcgagtgtgaagcgggaagtgcacttttaagcaacctaatctcgtgagaactcactcacaagacagcactagggggatagtgctaaaccattagaaaccaccctcttgacccaatcacctcccaccaggttcctcccccagcactgaagactacaatttaacatgagatttggttggggacgcagagccaaaccatatcagtatgctagaatctagtcttttaaaggcatcagttttgttgatttttatttcaaagttttaggcaaaacagagaacacattgtaagatctttaaaataattgtttcatgctttaaagaagaaaagctggtgaatgctaacaggcaagattagaccttcgtgtagttttctaaacctatgatgctgcttttaagacaggctaattgttgtctcaaaggaggaatttgaatgttgaaggcctttatgacaagcttgccaaatgtgtaggagagaagaggattacaccgaattctggaatgagttctcaactatagatcaaatgagtttactgaagaattcagaagattaaaaaacatgtgactgtatgataggatttataatattcaattccgcagactttagtttgttgccagagtgtttgggggagagaggtgcttatttttatttcaaatatagatttagaacttaaactcagctatgggtctgacacacagtgttcattaaatcctgggaacataatatttgaaaaaaatggtttattaactttttaaatataataaaatacccaatttgttagaaaaattaggaaaaaatctatgcagaagacaaagtgtttactttggtggcatgatctcggctcactgcaccctctgcctcccagattcaagcaattctccagcctcagcctcccgagtagctgggactacagctgcgcaccaccacgcccagccaatttttgtatttttagtagagacagggttttaccatgttggccaggatggtctcgatctcttgacctcgtgatccactcgcctcagcctcccaaagtgctgggattacaggtgtgagccaccgtgcctggccagtattcactatttttaaagtatcagcagagcacttgttatctcttaggatttcccagggagctatttgtattttattacaatttacaaatagcttaagagatgttcccccttaattgtggacatttttagatcaaaacattattgtttttcatttatatttcttttccaacattgaaccctttatgacatgcatcttactttatagcaagaaggaagtcaagaagagaacaagagacgggttggtaggatctacagtttttctaattgttactggagttagtatatacctcgccccagtggccagtatgtgagaatcctgaagcatgtgttagaatatcttacgaaaatgtgaaatgtattttttaaaaaattttaattttgtctcttgtcaaacagtaattaaatactatgtaatatccctcaaataagtgaatattttatatcatttaaacattatgtttgagcaattagtctttaggaaagttggagggagactttattctagtcagcatgattgtctgcaaagaacaaaggaataggaattaccaggaggcatgatttttttatttttttaataacagcatactttataagaaaatgttcttccctttgggggtttaagatgtttctgaaatcaaacatagtgttgttattcgggggagtgtcagtgaagactttaaaaatcttgaattgaagggactctaagtccccaatggcctgaagcaattcaaataaagtgttttaaccagtccttctacttgattatttgttctgaagccaaattagtatattctcagtttcttacaaaatgtttgtaccaaaaggacaacttgtttaccaaaataatttctgacaaatagctaagtgtgtgcgtgtgtgtgtgtgtgtgtgtgtgtgtgtgtgtgtgtaagaggacaacgttttgtcccctgagacattatatctcctagggaaaaaagatttctaataacggaaaatttactaacactagttttattaaactaacattattaaattatctttgtgaatcagtgtttcatggaaagtcatgtatatcactccaatttagcttaactattattcaatagcaactttttgtgtctttaggacttatttgaaatttatacacatgcaatatgcatataatgaaactattcttaatcagagtgcttgtcattgaacagtgactaacctggttaacagagctagctacaatgtatttttgtaaagtatttgtccaattccttgttaaaaaccagagctgatcttacctatacaaaggaaaaagctcccaaagtgtcccatgtaacttctgctatcttgtcctaagcgaatattcttcattggagggaaactattacatagagatctcttggatttatttcaatacataaagattacgactgagaacagtttttcagtatgagagggctaagcatctccctcgggaaggaaatagcactaactcctgaggaaacaggttcagaggaaagagggatgaagcagaccaggagaatgtattaccatcacgagctctgcattaagtactgtatttccagtgtcttagggaatccttacaactgtcttgaaaagtagaaattatcttcattttataatggggtaaatgatacttggaaatgtcaagtaacttacccaagatgacacaagcagtgaagacagaactgaaacacaggaactgatccctaaacctttattctgccagacttcaggtgtgaaagacaagcttctagtttacagttcaactaagattattcttcctcaaacatcatacctagaacaatgtttgagttttccgttgcaatcaatggcactatcctgactccagacagcgagatggtataggatagcataggatggcggtgaggaacttagtccttctcctcactagcttgtcctggaacaattttcttaatgtttccttgtctccattttcttttctgtaaatttgaaataatagcacctaccccacctactttttcccacagtggctacaagagcccaatgtcattgatatgaaagaactttcttctaaatgtaaagctctatctaaatgtatcttagttccactgttattattctgaacacccattcacactgtagagagaagagattgtcttcaatcagtaattaaaccaacacttcttttctctctttacagttctccaaaaatctagttaacagaaatttgaatgtctatcaatgaattgctgaaataaaagatcactttgcatatgtcacacttattctagatacgtcatgaagagatccaaaagttattcccaattaggtaacaataacaaccaggtctaaagagtcagtgatgttttttctcccgagatttacagcctcttccttgcttgtggggcttgttcctttaccatctgagctgttgcattttattagttgtgatgttctctaagtctcaactgtccttcctcacactccaataaaagcttgtcttttttaaaaaccttccagttatctgagtagcataagcagtggaaagtaatagacttatgttatgataatgagacttggaaagtctcaagacttggaatgcctttgtttatttcaaagtattctggttttcagttcctttagaaaagagaggaaagcagctggaaatgaggcggagcaggagagaaagtaggagaatttaactaatgagccattaaaggaagtaggtattagcccatccatttgacattaactttacttctcattcatcattactggaaaaagcgtttattaaaaaccacactaatttaaaattgtgttattatttcttctgctacaggcaagactttttattttctttctttttttcttctggtattgtttttatgcattgtttcattattgcagtatgagaattgagcagtgggctccatttgtcacatttgtgtgcatagcaatttcagttgaaaacagaaattcaaaaaattttgtaacatggggcaacagctccatctactgtttccataggaaaagctctagtcaaagaatgacaatagctctttgaaggatgtcagaggaatggaaatttttcgatgtttgaagcttataaatccatatgatttttaaaaaattattttcaggattttgttacatttatgcttaccttgaaatttaaatataagtgctatttcatcagcagtcattttcaatgtcaacttgatgctcttttgaggtaaaaatccatacctacttcatggatctctaaaatgcccttctattgtacaataccaataaaactctgcagcattaatttttgggagcttactccaacaaaacatatgcttcttttctaaaacaagtctgatttgaaacatgtacattcatgtttctattttaattttaacttcagtgtagaacttcttctacctttaaagcatgaatcattgcacagtcctgaaagttacaattatacatcagtttgcacaattaaaagagtaaatttagggtgtaaaatttaatttatttactaaacaaatacttatggcctatctactatgtgttaatcactattacaaacattgaatatacagtggttaaaaacacaaagcaacaacaaactacagataaggtctctacctttctttataacttactgtctgtggtgaggcagtacaccaatggttaataagcagttaaataaatagacaaaacaatttcggtttagagtgaggtgctatggggggaataaactgggtaatgtgataatgatttggaaggaggagatgttcttctcattaccatctaattgaggtggtccagggaggtgtctctgagcagaagacattccttgagaaggagctggccatgtaagggccagagcaagaactttccaaacagaaatatcaggacttgcaaagagcttcaggtggggaaaagcttgatgtattcaataaacataaaggagctaagaaaagaatagtgccagaaaagatttgggagctgaatggcttcatcatatagggccttataagaatggaaaagaagggttggggggcaagtggagagatacacgtagccatgaaataaccagttacatctccgttttgtaagtgtgtgtgtgtgtgtgtgtgtgtgtgtgtgtgtgtgtatctgcagcggtttgatttttttatgtgatgaaattactgttcctactgattcaaataaattattctgaaggtaatattgtttttagcccattatctttagtctttgagtggacggggaataggcttgtttgctgaaagaaaacaaaattgacaaaggtttgattgtagcccatttaatttcagtcttgtctgaatccactggatatcactttggtcattagagatggagaatttcatcacatctaagtcttttctttttccccacagctaaatctgatgtttcctttctgataggctataggttgagtcagttgaacagttggggcaatgaaaatacataccctcaaaacgccatagaactaagtgccttccggcacttgtgcccccttatccatcgctgttctcaacttgagtatcttccgtctccaactttatttactatgcactgaaaactgaaaggaaagttattattttcagcatatagcaggacccacctctaaaacaatttagtgtcccaaaacacatttttggactgctgaataaagcagatgacaaaaactgtctcagtgaaacatttgatcacttgttaaaataccctcagaataccttgaatgtgactacatgcattttgaagctcatcatgtatcaatgggaatccaattcaaattcttaacatcccttctagaagcttgaactgatcagggcttagtcatgttgctcagttttcctttcagcaagagaaccacaatctcttctgttaaatgactaaagtctgtgcaatgtaatatcttcagagaaaatgaacctaacaatttatttgagtcaatgggaataggaatttcatttcttaaaaaaaagtaagatgacactttctcagatttaaaaatatagacacataagacctataaaatggagacatggctagttaatcatgtttattgccacttgtccctcatgggggtaatggtcccagacaaaacagctgttcccaacattgctaaaattccagtgtcaccttgtgtgaccacagaatacatagacatgcatgtgaggcagctggggatatcaggttgagattttgaaaactggctctcaggttttattttctaattatttctctttttctctccctacggacagcagcagtaggacattattagtcactttctgacttcctgtgttttttactaatagtggtaacattatggtggaaaaaatattatatttgtacagccactgactgcttgtttcatcttgtattatgttcttgaaaccaactattaagacatctggactgacatgtgttatttacagcaacgatgagacagactatttgaaatccttgatctgtggtcaccaaacttgtaattagttgtgatggtgcctggattcaacatcatttctttgtgttgggtaaacattaagatttgagaagtcaaaggccagtcagatttattagaaccttaattttcagaacgggatatttgtttcctaaataatcttatagtttgcatttgatgatatagtttccaagaggatctccatactgtatgtaattttactgctgtatatctttgtgaggtaggcaagaaaagattattttcatttaataagaatattctaggtcctgatgaataaggagctcagctcaatttttgcagtcagttttctctgcacatcagtaactatagcttagtatgatcaaagtaaagactgaaggaaattatataactagagaagcaacaagttttcagcattgtctaggggacctaaaacatggaagaaaagttggcagaaaataagatttgaagggtcttcagctatgtctgtaatgaattcattaaaaagtagaaagacccaaagcaaatatcgcaaaattgttaatatttgacaacataggattttggactcattgcaatttatattattttctgtacttttcagcatgcttagaatagttcaaattcattttaagaagcaggaaaaacattctatgggattagtaacagttaatatcactgattacttcttcactggctgatatcatcagtatcttctcctttgactgaaatcctttgtggaatggggccacgtgttttaaaactaaaattattaactattttttagaactttcctgagcacactgtctataaccatggtgttcagctgagccaagaattgtcatttgtagatttatcattagcacaacctatagataagggagagaccttaacatcacacatttgagttgaaagtgaggaccacaatcacccaattattccagagctgcccagaatgtccccagctattcaaattgtgcacatgctcttggcctctatgtaacttggcagtgtataagctagtgccaccagcctggttatcttaagtcccagcagtgtgccttgaaacttgcattttcttaactcaggaagagttgtcattctaccaacacttttaaagagaatgaatgttatcacctaattacagtaaatggaaactcaaagcattcataggtgtgggctgcctgtggggtccatgtaagccatctttcctccagattttggtggcatattgaaaaattcctgaggtcaaacaaggggatggaggcacagttgttcctaaggtatggtttttgttggtggtgatcttttgaggacaccactggatacaaataatttgtttcacacattcccctccttgctagttttcatgcccctgtggcttttatcaccttgtactgggtcattgatgttgcatctgtgggtggcaaggcactctaaagattcctgctgctccttatattgcaggacactgacaaataatatttttcctttttcaggacatactggggagagatgagtatgaaacattttatggatggataagcagaatagcagcattaggggaggaatctttttttttctaactatcatgccatggagatcagtcaaaatgtcccactctatcaataaggcagtgggctttacaccaattaggttgatatctggggaaataagtacctttaaatatatttttttctgccttagaaaacaaagtgttaaaaaatctacaagcttcctagcataatttagaaaatctgcttttatgaaatgggttaattatgcccattgaatgcattcactgtcacagtctcatcctcccacttctgttccaaaatgacaagtgaaaccagggactgtgcaattttggaagacaatcagatcacatattgagtattttgcttattcatacaaccataaacggcctatgcttgagttccctcaattacacagctcagtatgcaggccagaagcagacaagcccagctcaagtgagcactttcctggaatacacgggggaacgagtttgaaaaatgtccaaagtggcagatgtgaaaaattctcattcaacatccagagctgcctttgctgcaatccttcacctgttaatcgcactgcctctgaacttgtgaaccagggatgctagcgatatcttagactgagacacttaggagctatagatctttcaaggtatggtgccagtatatgccaaggtgggggaaaagctagcgagacaagacaagatcatggatcacagcactgctcagaattttcagacattcaccaagaataagcatgtcgctgccagcttccaactaaactgttattatcttttgtaggggaaattcccaaaagatgtccttgataaatgcttaaaccattgtactgtatcacttaaattcttcagactcctgcaatgctaatacacaatctctcctccacaacagaatacaatggcactattgtagtcttaagtgaaggatatttcattttccctgagtgagacaactttcccacaactgttatccactgcaatttcatgctccttggagtttctgtgcaccaaaatcatccccaagcaatatactctcttgattagctagtattttattccacctcctttgactatatttattttttcttttcttccaccatcttataagcgcgaaggctccttgcccttcatttggcattattgaaacctcaaaagttatttaagatgctggttgagattgttaacttccttccttttccatctcagcctaactctgatctttctttctcctgctctctttctagtagaagccctccatgattttgaacttccttgtgtctctgtgttgttcctctctcttatccttacccctctcccattctggtcactttcctcttgactcttcttgtcatccaagtctttcttttttttttttttttttttttttggagatggagtcttgctctgtcactcaggctggagtgtagtggcgtgatctcagctaactgcaacctctgccttctgggttcaagcaattctcctgcctcagcttcccaagtagctgggactacaggtgcacgctaacatgccctgctaattttttgtattttagtagagacagagtttcaccatgttgcccaagctggtctcgaactcctgagctcaagcaatctgcccgtcttggcctcccaaagtgctagcattgcgggtgttagccactgtgcccagccctttcaaaaggcatgtctacaccaagtctcagaccattcttttcttggcccttagtgattgtatacctcattaatcctgtgatctttcaccacacgatgccctgctcgattgtttaaaaaccagctttaagatgattggtattttattttcccatcatccttctcactgtgaggtggtttaggggaaagagttaaaagatcaaggcagtggggtcagacagacctgagttgaaacctagctcttgtctactatttatatgaccttgagtcagatatttagtcttttgttatgtgtaaaataaggaaacaccacctcactgggctgctgtaagagctaaatgcaataatgcatgtacctcatacagttgtcactttcaaagggtaactattgttatttattaatatttttgttatcattatcctcatttaatcattatttgccatcttctcattatttttgtctttctttcccaggatttaggaactgacatttccaaagcaaaagggttgatattttttctcttttattatcacctgcatgtaaatttttcttctatctgcttggctcccctccttcctattttcctctgttaaagtctttatagagaaacttcatccatctaagaatgttggcctaaatatatgcatatacatattcatcatctggaaaaactcattagattctattttcaatgtgaacaaacacacttgaaaacatctcttttaaattgagagcatttaagtttcataactgtattcttttgtattgaccaatgaatgaaacaggtccatcagattagcactgaaacatgaattttccctgagcttatttccatttgagtccccaccacttacaatccaagttaacctgaagacttggctcacaagtcatttctcaaagcctctttccagaaagtgaaagccctcagcctaacggtggtggaggcagagatgcagtctgcagagtcctcagcctccctttcctacttggtactgtcttctcctgtccttagcccccaagggccatccctttattcttctcctttcctgtcctacccgccttgctcttgggaaatatgtaatgaacaattcacatgaatctattagaatggaatgattttggacttggttctaccattcatgtggtttggggaaaaatctcttggttttcccatctgttaaatggaaaatataatactacccacttcagttggttattataagaatcaaataagataatgcattttacagtcacattaccctaccacccaagaaaatataagtgaaaatacttttagaattatccagagctgtgaaaacatgaacctttagtattatatctcccaggaacatttgcatttgatctggcagtaaaacctaacatcaaaaaaaataagacttttgttaggacattttgggcataacctggagagcaggcaagatatttgaaggaaaaagacctcctcccaggaacctttaaatttcacctatatgtggcccatgttctctagggtgacccatttaatcccaagtatgagagcttgaggtctctatattgaaatgtaagaataatataaatactcactgaatctgctcttggctttaggaatcacattttatagttcaagagtttctagcagttgttgttttttttgttttgttttttggtgttttgtttttttttttttttttggtggggagaaggtgttggtatccctttagtcactaaaaattctcaacagaagcattctcagaaaaaaaatccattacaattataactgcttaatttatgtaattaaaccccaagagacactgaaaaaaatttcattttgagtaaatattaagacagagaaaaggatgtgtgtcttttttaaaaaaagaaattgagtcccccaatattttctatctaaagaacattattgattttttcccccagaattactttacaacttatatgttgtaattctggtccaaaaatccatccatgagctcttttctacttaactggagctcactataactatgctttcaattaactagccacattcttaggttaatctaaatctgttggtcttgtcttttataaatttggaagaagcaagccctttgctctgtttgataccatttctaactaaaaccaaaaccaacaaacaaaaaaatggctttctccacagactttttcttataaaagcaatgattctaccgaattcaacaaacattgggtgctggtgatgggagacagatactgcagactgtagtgtgctgagtttaaaaggatcaaaactccttgccctcacaaagtttttgttgcaactgggaatacaaacatgtacataagccactatactcaatgtaaatgtgctttactaagttatgtataatgtgttatagatggaaacataaatgagagaaaaactcatttgacattaccttttccaaccattattattttttcatctcaccattcctatgtctgaatttaggcttcctaatgactgtttttttttcttgaatacaaagggaaaaataattactgatctctacttttttacaagccattagaacactggaaatgtttcttgaaaattagtccaaaggactttccaacaagcattctatctgttcttacagaaaagcgattttttagcacttttgaagagagttggttagtacaacttccttcacagaggtttttggtatttcaaagattgttcttgaatttaactgaaaacccacagggccaaaagcagctgtgtgtaacctgaaaacatgtaattttgaatccagaaaaaagcttccaataggagattgaagagctatggtgcataagtggcatctggatggctcaaggagactcagtcaacagagatgaagaggtacagggtacttttagagaaaagggagaaaggaaaatagttcaagattgaggatcagagagtgagcaggcgatttgactaaggagccacagagctcctgattcacaatgtgcagagtgtgctaaagctggatcagaaggctcaagctctgacttgcacagacagcttatggcaaagaacagtgagggaaaaaaaggcaaaaatattgctctttaagctaagtataccgggtgaattggctaaaaagtgaaaatgcagctaagactaggactaaggactatggtttttaacagagaactcttcccaacttttaaactttgggaatgtgcagccaaaactgaaatctactaagggaatgataatgcaaatagctcatcatttttacactacgtgtctgacaagtccggtggcagacatcatggtatttctgttttccacctccagcaagatttaagccaaaaactatttaaaagctgctagaactattgctgagagtatatacttcccaaattgaatatagctttaattcactttatcacacctgctgtagttctttgcagtaagaaacgacatcaggatctctatccacaccaggtttataggcctctcagataattatgaatcagtacagttaggttcagaacagttgtttctccctggagttcattagcatattttagctgctctgtaattgtatactcaccacattaatccagatgtcctatatctcccaatcccatacaaatagagtgaagcaaatctccgtaaaaaacagacattgtataggcatgacttgtgtacaatcatgttgtgggtcactgttataagcaagatattgggacatttttcctttccataaacctttaaccacttttcctagcagagctcctaagagcataagccaaggctgacatgccctctgcagttggcctctcttcaccactggacctgggtcatctaagtgtcttttgatgggtccttgtaaatgcaaacctcagagaaagggttctgtcaactgccctagagcatctacaccaccatgtgatgccgagagatctgtcacttaccacaagtctttaacttctttcttggagttgattggtagtctgcaggatagacaactcttgctaaacttggcgacaactccttggatcttctccagccatatttcataccagaatagaagatagaaaaatagcacatctcttgggatgtggctggtaggatagccaccaattctgaaaccccaaggttgtgttccaactgtaaacagagttgacttttgcaatttaaatgcttatagcttattaatgaccactatctttgacagtgttagagcaaccaagtgagacactgcctcactgactatagtcagagtagagggggacttccagaagactctaattggcatctctttctagtctctgaagggttccttcggaccgctaggagagtttgtataaagtattgcctgcagggtagacggttggctgtaaatttctgtcacattaaacttgcaatttgtggtacccaaactatcccagtgactaaaaaagtgagaaagaaaatgtcatcataaatactcatgatgagattaagtggtagaacctaaaacttcagatcaaacccatttcgagtactactttgaagataagacattttgtgacaaaagcagaacatatgaaaatgtagaagtaatttttatgggtttattaatcttgtggatatttgaataataacgttcaaccttttctgtagcctcattgctcttggcattgtttttagtgagttgtgcccttgcctttgtttttagagggagcagctgcactgagccgtgcatattctcccaccccacccccagtggtaagctcagcagcagccagatcaggatcctgcatgagaagtatatactttgcttatgaaatacagctatcttctgtgtgcatatgaccagtctgtaaaggatcatatcccatttcacccaattttttacaaatcattatcattctattgttttttactgttctcacttacactgctacctgttttattctgtgcaaaccctacaacacatttgctttcttgcttcttttccttactgcctcccagaaccctttgggaggcttcacacttcttgtatctcagaccacctgctctcccaacctctacaaacaaagataggatacatttgaatacagtcacagactaggagaaatgttttgtaatattcagggataatctccctaacatgggttaagagactgtatgaacatagatgggagatacaaggagtagataaagaggcctctctcaactacacggtatgactacagctaaaggtaatgtgttcactttcccgcctcctgcaccaagcactgtgaagtacctggcagaagtgctacgtagaagttttgttgattttttttcaatttcagtaaagtaaatagaacatagaagagtgatcacccagtattctctagggtacacacatcatcatgataagaaaattactgcaaaagtgatttttggctgagtttgcctttaagttaagatagtagagtagacgagaactggctttgggcccaatgctaatgttaaatattagccctgccacttaccagtggtgtgaccttggaccagttaaacatttccaaccctcattttctttatctttgaatcagagagaatgatgggacattcctcctgtcattgtaaggactaaattagttaattcctgctgtaatgcctagcacataataagcactatataaatgtttgctattggccgggcccgctggctcacgcctgtaataccagcactttgggaagccaaggcaggtggatcacttgaggtcaggagttcaagaccagcctggccaacatggcgaaaccctacctctactaaaaatacaaaaattagccaggcatggtggcacatgcctgtagtcccagctactcaggagactaaggcacaagaatcccttgaacctgggaggcagaggttgcagtgagctgagatcgtgccactgcactccagcctgggtgacagagtgagactctgtctcaaaaaacaacaacaaaaagagtttgctattattatttgactgattctgctactctatttgggagactgtattattaatttttatgctatatttaagagttctaataattaagaccctctcttttaactagattgaatatgtatgaagttaaatttacctacttcatcactgttctttgatctaatcagccttgtcatcaacacacactcactgaatgcctactatacatatacccctaagccacctcttaatgctactacatatggtgtctaaaattcctccttgcctcattatatgtttgcagaaggatcaacatgtatggaacttcatgtctcctgactttcaagaataagatcttaacttgcatgttcttggctagatactttgtgtaacaacccccccactcaatgattgctttctttctttacttcctctaactgacctagaattctttacacaatgctggctgctgaaaagttgcatgaaaaatatataatgccataagaattctcttcttacaatagctccgttattgtttcagcatggtaacagcatcgtttgtctttccaatcataggcaacaccattacttgtgaggcccattattttctcaagaattataccagcctgcttctaagtatccatcacctcattcttgtgccctttatgtttagtggcacaatgcaaaggttttatattagaagagatcttcagtcacaagctgctcataagaaacacctggtgtaaatgttaaccaacattaatcttttctgtatacctaaggtgttacctgcatcagtgagtgcagctaacgattgcttcttaaaatttttctccacttttcaaagctttcattccctttgaaaaatattaatctttgtataatggtgctgtttgattttggctaatcatcttccttctgtgtcttatcttataaggtaacatgttaagaacttggtctctataatattttctctcctcctagcttttgagttctggatgaaatgtgcaatctcttttctgagatagttgaacctatttgacttgaattacttaatctaaaataatgctaatctttgtgtttttttatggccctcaccccaaaatgtaatccctgaaaaacctggaaaagtcttctttcctttcttcctagaagctttagggacagccaaatgtatttgcttctttcctatccactccaagcccagcatagtgcttactgaattatttccaggtcaactgaaaactatcaatatttaaatttcttaagcctgagattttatagcacacatcttttttctggcccaaaagtccatgtgcatcccattttcttacaactaattcaaaaaagtaaagcaatagaaaaacattttttcccaatttactaagttaataacatgtgggaacacacagttctatagtacattgatcaaaatcctgtgagaagtgccaaaaataaactgaagagttataccctcttctctgggagggtcttatgggtataattcctttcaataaagaatatgctgagggctgaccttctggtaaaatgttacatgctcccacttaggacctctttttggattcatgcaggatttaacctagaaatatcttaggaacctgatgataagttaatgcccgtgtatttctctattaatcagaatatttgactaaatagacaagtcctttttcttcactatatgatttcaagagttcttagatatgttatttaaatattcattgttttggtaaatgtgtatatatttgtctttgatttgtttataatacagggacctcctggaatacaaggaatacaccaaactcttggtggatattataacaaggataacaaggtatggcttcttttttcccataatttataatacatagaaattttatatgattgtatttttgaaaaaaaacttattaattcctaacttctcagacttttatacatgatcacatgtatttaaacatctttccatactgaaagctatgttttcaaaaacaaaaataaaaaaagtattctgttcagtatcttacaaatctagggttttatcctaataagttttttaaaaattttgttcaaagattgttaatgcaaaacattgtgttccaccatcaataatatcatagatctagcctctctgagggcagaaagaaattatttgatactttgaagctctgggtagcacaacaggtgatagacttcttatcaaaaccaataggtgttgcgccaaaatctcaagcaaatatttgcatactacagttcaagaatgagagtccccacctttcatggggaattacattcaatttccccacggtttttttaaatcacatttgggataggcggaatgctgacgtggaagtatccaaatggcaaaagcaagggagttttgttccagattctacaaggagcataatagagtggcagccaagagaagatctaggtgagatcattgattgattcatcattcaatgacaaatatttggggtctgatcactttgtgtgaggcattctgtccactgattaggataccttgtatacataatggttcatcattgatttcttgcaccacagaaagaattggagacacttccctttatgtctttcttttccatgttcttactttcccttcctgtaattttttctgacagctgttactcctctttgtttagaaatcccaaagagaagtgtcaaaaaaatttgttaaatgactagctaattataaaatcccagtttctctctcttcagaacaaggtcaacataaagacttagataatttatggttgacaaatttaaaatcaaatatggaaagttttttatactttataaatttgatagtgatgctattttaaattatctcctttatttaggttttccagggagtattatattaggaagaatgtttgggatatatttcatgtttccttattaaacacttctttaatttctcaacctactcatctgacaaagggctaatatccagaatctacaatgaactcaaacaaatttataagaaaaaaacaaacaaccccatcaaaaagtgggtgaaggacatgaacagacacttctcaaaagaagacatttatgcagccaaaaaacatatgaaaaaatgctcaccatcactggccatcagagaaatgcaaatcaaaaccacagtgagataccatctcacaccagttagaatggcaatcattaaaaagtcaggaaacaacaggtgctagagaggatgtggagaaataggaacacttttacattgttggtgggactgtaaactagttcaaccattgtggaagtcagtgtggcgattcctcagggatctagaactagaaataccatttgatccagccatcccattactgggtatatacccaatggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgacttcatgtccttgttagggacatggatgaaattggaaatcatcattctcagtaaactatcgcaagaacaaaaaaccaaacaccacatattctcactcataggtgggaattgaacaatgagaacaacacatggacacaggaaggggaatatcacactctggggactgttgtggggtcgggggaggggggagggatagcattgggagatacacctaatgctagatgacgagttagtgggtgcagcacaccagcatggcacgtgtatacatatgtaactaacctgcaattgtgcacatgtaccctaaaacttaaagcataataataataaatttaaaaaaaaaactaaaaaaaaaagtggtttatatacacagtggaatattatttagccataaaaagaatgaaatcctgtcatttgcagcaacatggatggaactggagatcattaaaaaataaaataaaataaataaggaaaaaaaactgtactggctttttcaaaatattaaggcttagcacaagtgaaaaaaagaatgctgaagcatgtttaaatttaatcaatttaatgacacctgtaatgacacctgctgttataaaataggatttatcataaatgcttcaaaataatgagaataagttggctctgatgtcacagtgtcagctacaaaaacttaaagaacacactatattactatcgcccttggtataaaatatacctagttgctacttagctacttaaatatttgctatcccttgcaaaacttttaaagctcacatctttacaggtctcccaaccctacttctctatacagtttatcttgctgatgagtcagttttcccttaaatgaagatatatggagcatttatattttagagtctaaagttgagaatgtaaatttttaaactttaaggttatatttcaaaaaaaaaaaaaaaatgggcactgaccagagcagctgagtggaaaatcttgctagtaacaaaccagtactttgaacttaattattaactcacctaaaagaaccccagttattcttcttgccattacagaatagaggctcacaggtatttagtccacgtgttctctaaatgtgactttaaagctggaatatgactggataaacagaaaggagtatagctgttatcccaaatgatgcactataaccatttagcattagaggctttagatccatctgtgaattaagagacaataacttaccaaacactttattctgtttcctttgggagtagttagagcccttacaccaaggccccaccaagaaggatggaggtggtgggacccactttcccagcacccacactgccccatgcttctgtattgtaaccacctcctcctcaccctcagcttcataagggaaaagccaaatgtgctatgatgagcacgatgcatgttttccattggcattgtctccaccacctacccctgtctgtttttggacactgagattgtttcattttgcaatttgtagtgtgccagatggtctgactgtagcaaataagcacagagaagtggggcctgagtgaaaccttcctagagattaaataatggaccatgtattgagacatagcaagtgacactccaaggttaaaataatcttcccttttaaattggcattgatttatgtgatgtctgcactggagccctagacctcagctcttcaactcacagtggcttcaacagtcacacagcccagattctgctgaagcaactacccatgggagaatgagtaacagactactcataaactgcccctcctcattccgagctcagagagcccatggttcattttccggtcccaggatcctcacttgccctctggcccccatataggaactgatcttttcctctgctattttccttatgtcatctggagggagaagctcaggtatgagaaaccctctctcctcacagcacaaatccaaaaagggatggagaaggaaaaaaaaagcaaatgaggaagaaaaaaaaagcaaatgaggaatagagagacagcctaaggagtgaggtcaggaagatggatatgagtgtgtttatgtggatttttgcatgcctacttatggatgcaaagaataaaaggtagatttctctctctatcacaaaaataatgtgcaaaacagctgctcccattctgcaagattgttcgcaaagaagcaacaatgctgagcatattcttcccctcaaggaaaatctgctcatgttccagtaaactgcacttcattgtttccagctctgggggttttaataaaaatttgataggctctgtcaactactgaagccatcagacccacagttccttactacactttaaatggagaaaaaaaaatacgttttatctgcggaggccaagtgctggtggattttatatttgatgttgtttttaaagctccatattgaaaatgcagagttgtgttatcttacatcaccacactcggtctcagctgttggagatttatgctgtgcctcccagcaaccaattcttgtattcatttctccaaattattgatccaaaaaaaaaaaaaccaatttgctagcaaaataatctatttttcttttcacatattaaatcataacttcactttaatatccacagactagaaaggacagaaagcctttatccaaaatccaatagacaaggcctttccaagcagtgagttaaacccaacgatggcatataaagtgtaggctcccttggagacactgcaggcaaccttcctgggcccagaagattgagaaataaagtttaggttctaacttcattgctctccttctctgtgccccaggctccactggctttgaggaacgttgtggacttaggcacagacatatggactttcagatgttggtttgattacagacagccccccaactcacctgagtcttcccttcctttcatgaccctccacacttgcggctggtgaaatggttttttgcagataactaagaggttcggctttgagccagccttaggccttattttcaagtgagcacagctttcctagcccacatattatgttttaacttgctagggctgccacaacaaaatatcacaaactgagtggcctaaacaacacaaatatatcatctcacagttctgggggccagaagtcaagatgaaggcgttgtcaggaccacgttatctccaaaggcactagggaggaatatcttccaggtctctctcctagcctctggtggttccttggccatcttcacttcaaactatagcaatagtgatctgaatgggtacctctgtatattttgttgtctaaatatttctgtaccttttaagttttctatcagcacatgtatttttaatcagaaaaataaacttaatggaaaaaccacatgattagagattactggctcatttgcccaacagatatttattgaatgccaggggaggctttcatgaatggcatttcataatagttgagacttgattaatgactagtttctggccagacaaaaaggtgagggcaaagagtggtgatctggaggctgagatgggaatgaccttggtcagtttagggagctgaaaaaagaccatgacagctgaaacttctgaggaagaagagtgaccaacatgatgctggagagggaaatgagttcaggtcatgcagagatttgaaggtgatattaaagttttgagaaatggaggccagaatgtcttttgaaggtatttctctgatcttatgtagagaatatgtgtgtcaggaaagcaagagtggattgtaaaaggccagttagagactcactgcaatcctggcaagacatgatggtgggctgcctgggtataggcaggttgactctgtctcttaagagaagagaaaacatttggggagacagagtcaaccaaactggatgactgatcatatacaaggaataaggatgagggtgattatattagtctgttttcatgctgctgataaagacataccctagactgggcaatttacaaaaggaaaacgtttcatggactcacaattccatgtagctggggaggcctcataatcatggtggaaggtgaaaggcacgtctaacatggtggcagacatcagaagagtttgtgcagggaaacttccctttataaaagcatcagatctcatgagacttattcactatcatgagaatagcatgactcacacccatgattcaattacttcccactgggtccctcccacaacatgtgggaattgtgggagctacaattctagatgagatttgggtggggacacagccgaatcaagtggtattgagaatgacactcagagaggaagagttcaggttttctttctttccttaattgttttcaattgtagaatggaattcctgctcaatttaacaagaaaaactccagagatacattagaaaaaactgattctttttctcccatttctgtactaaacaatgttagcagcgtgatgtaactctattttgttctctcatatgtgtatttgttgcattttttgtttcagttttaaacttgttgactatgaattgcttctagaatttacaagtacatacatcaagtagaaaattagatatatgggtctaaaattcctaagggaagtatatgcggggaatataaattagatatatgggtctaaaactcagaagggaagtatatgctgggtttataaatttggctgtgtaaatattacctaagccacaaaggtaaataagagtgctggggagaaagtgttgagtcacaaagaagaaaatcctgaggaaatccaacctctaacagatgagggaagacgaagtcacagagataggaagaaaccaggagagtaagctatcatacaagccaagagagtgacaagtgtagcaagaaggtcgattactgaagagtccattagagtaagcagcaaagatattattattaacattagagggccacatcagtggactgatcggggccagtgtcaaatacatatgtgtttaggagtaaacaggagttacataagtggtgtcaaataaaaaattgcacctgacaaagttaaacaggcaaggaagacattattcaaggctattgcaataggagagagaaggtagacttagtctgagctcaattccactgaaacaaagttcaggagagtttttaagtattgatgtaagaaagagaacacacttccttgtgtttgctaattggctttacccaaaggaagagtaaactttctcatatctttgtgacaggaagaaggtttacaacttggcacaaggctgaagttaggctcctaccctcccacagagcctggaagatagtggcactatcttctccatgattacattttaaagggatggctcccagatccttgagaaagacgttcccagattgtaaaactaacaggaggcttttagaaagatttacatctcaaagggatagtgaaagaacttacaaatacagattttctaaagcgattggtctagaaaaagagagatcagggtatggaattaggaacaagcctgtccaaagttgattccagctgagggaaacattaaggctgtcttggtcagtggacgcaaaaagcactaactacccttttgagaaaattgtccagaaatgggaggaaagagagtaacttaagggaaatgtgtgctggggaactatatgctctttgtgtgttaagtttaaagaaggtagaataggtaggtagtcagagagagaaagagaagtgttaaagaaattggccaattttagctacattttacttaactttaccaaattggccaatttcacctgatagcaataggtaacattaataaggaaaatctcctaagaaggcagaaggcatgggaatcagaggatttatagaggaaacagccatgataagagatgagacagctcattaactacacccagatgtgcatgcacatgggttggtacattcattggcaggaattagaagtggtgactgaagcctggcgcagtcgctcatgcctgcaatcccagctcttacggaggcagaggcaggaggatagcttgagcccaggagttcaagacctgcctgggcaatatactgagacaccattctccacaaaaaggaaaaaaataaaataaaataagtggtgcctgagaacttgcatttttttcagtgtagttacaggcaaggtcacttgcccaaggactgtagagtctaatgtagtggtctgagaacaataaagaagacttgagaatagggagagcagatcagagatgctcagatacatggagaggccagttgaagtggccagatgtggatttggagtagtgagtatttatccccagaggtgtgatgtttctccagaagcaatctccttaagaagtcacaaagaagatgcatggggtgtccaaagctggaattatttagaagaatatttaacaggaatatttaacaacaggcgagagagacaaagatgtctgcacaaatgacctagtatccataaaaagcggttacagaactattatctgactgcttatactgttacagattgaatgtgttaaaaattagcggatttttcttttgtattttaaattgtttttcacccctagggaaatgatgaacatgaagctggaggcctgaaaggagacaaggtaatcagattttttttttttagatggagtcttgctctgttgcccaggctggagtgcagtggcacaatcttggctcactataacctccacctcccaggttcaagtgattctcctgcctcagcctcccaagtagctgggattacaggcatgtgccacctctcccggctaattattgtatttttagtagagacagagtttcaccatgttggccaggttggtcttggactcctgacctcaggtgatccacctgcctcagcctcccaaagttatgggattacaggcttgagccactgcacccggcagtaatcagattttcaaagtgaatagaagggcccagtattttatacggacttacacattcccacgtagggggcagccccctggcagcagttgggttgcatctctgggagggtgtccagcctgcagtgggcaggggcctccgcctgcctcctgaccaggcagtaggattcgaatctgcttcagggtccagcaaggactgctgagtagcagttggctataagaaagagaacatatcaaggggaaattactgtaataagataaatgaaatcaggacacaagacttgttttgtaattaaatgtgaatccgtgtaggtggcaaaaacaatctgaagacccctttggcaaaatgcctcaagcccaggctcactattttgtgtcttcctaattaccaaaacataagctgccctggcagccatttttggtggggttttatactgtccagtagtggtttaaccaaataattatttcaaaatagttttaaaactaagacactgataaatttccgttgcattccccttgtcatttgcaggtttaattatcatagctgtaaagatgacagattcacttccccattcaataagatgtttcactcctgtttgattctgaaattgtaatgaccttggattccatgtgaatgtgccattgtcagaaaaaaaatgcacattaaatctacaggcagagatgagtagtttgaaaatactctgagggaatgtggcctgtgagtgctactttcattcattcacctgtaaaaattctctagattgagggcaggggattttgacatgaatccaagaaaatatgacttctgtgtcttataaatcagtgcaaccaatccattcaaaaagtcgtacacccatcaccagaagttactgctaaaagatagtctcaccagaaactaggagcttcttacagattgatgattgaaaatgaaattttctgctaaataaataaataaaggcttgacattctgaaaaagacatccaaaaattgattatacagcaatgataagtcatttgtgtgagttagattttattgctagtacattaacattatttcctgtaacctaatagctaacagaaaccatacgccaccataaccaacgcattacattttaagcaatgacttctggacatatgcaggctaaggggaaaaaaaaggaaaagaaagccacaaagcttgtcacataggacagctgagcaaagaagagtgttgtgacttttaaagtatttaaatgatgattcatttcttgaaacaaaacagctgggttctgttttgctgtgttcattaggaaacatatgttacttagacattcttaagacctcactgatgagaaatttgattctgtaaaacaggtgtgtttcaaactctaaggaccttttctattgctcaaaatcttttctaattgcttcagaatcttaagtagaattaggaaaagccagtggcataactgttccctcctctcactcaaataaataacacagaaaagtctacagggaacttgatgcagtacatgatataaagagacacataaaaaaacttttaaaaagcgtgattaacaggaaattgccaataaacaatgcataaaataaacaaaaattacaggtggtagctcgcacctgtaatcacagcactttgggaggccaaggcaggaagaacctttgagcccagaatttagaccggcctggacaatatagtgataccccatccctacaaaaattaaaaatattagctgggcatgctggcaaacacctgtggtcccagcttcccagggaggctgaggcaagaggatcacttggagccaggaggtagaggctgcagtcagctataatcacaccactgcaccccaacctgagcaacagagcaagaccttgtctcaaaacaaccaaccaaacacaaacatgagcatagcagttgctggaagggtgaaatcaactctacctatgtaagtctacttagtatctcttctgaatcaatacattagtttttaaaattataatgtaatttaatgtaatgtaagtcaccacagtgaaaatttaaagctccatcaagctgttctcagagatctctgttgcacctgtggcgaaccccagtgcttctgaatcctggctgcacattggaatcacgtggaaagctttgacaaaatacccacactcaggctccatccacagagactccgatttagggtaggggtcttatctctatttagaagtgtttcagatgactctaatacacaaccagggctaagaaccactgagtaataggaagagcatgagctttgggacaaaaagttgattgtggcattaacagctaggtcaccttgggaaggccacttcatttctctaagcatgcatttcctcattcacaccatgggcagaattgtatctacacaaagagttgatagaaggattaaaattaaataagaggaagttactcaaaagcgcaataactaaaacacatataaagccctcactaaagatttgttcttttctattcacccatctcaatctttccttcctctcatgaggtctcatttagcacttttgaggattaattgttgttctcattcttagcacctggtcttgctcatctttgtatctcccaccataattttgacaaagaagggactcagtttgtgctgtagaataaaatatttaaccagaagaataattaaacacataagtgattcaccattcctttataatatgctacttctcaatgcactgaccagcaaaatagaattactaaaagagccaaccctttggaacccgacactacaatgaagcaccaggacaagcacaaatagcactggaatatacacaccagtcacccctggtttagcagccacatcctgtatcaagaacactacgatacagggagaaccacgacttgcagtaaatggccatggagaccatccacatgaccagtctaccagtgtggaaatgaacgatccctgctctgtggcttgactgagactgacaggatgtggtgaagggataatgtacttgcaagttacttgaggagaactgctgctttatagagacagtagaacaaaatatcagaatatcttagccctcctgagaaaatagcaggtgtcttgtgaggaagactgtcagggaaaaggtggagtcactacagcaccaagctaatagcatcgaaagtgtcaaactgaaggagagtctttcctaatgcaaagtaacttcatcacttgtgtttcaactcatctctacagtgataaatcactgaacattcaatttaaataaaaaatacaaacccatatgtgtctaaggttcaggtagaaaatgcttttgcttgcagaattttatgaggaaagaggtctctaagatttccttccagcccaatgtcatccaacgactatgtggaaagatggactgcaaccccttttttgtcctgcccctgtttacctgtagagcagctatgaatatacttacttttatttcaccatgtacattgtcctccccttcccctttgatattggcagatttgatttttacaagcaattgctagactccttctcagctttctacttttattttattaggcaagtctaactagtaggcatatttttccttcacacctatacaatggaaactgtagcacctaccagatgggtaacacgaaggtcactctgtacaccctaatgcctatacaagtctaattgtttattttctctatcaaaccaacaacaatttgttcctaaatgtatcccccaacttctcccttgccttaccttgaatataatttactatgtctaggaaaaaaaatggcttctcttataatgtggtaagaataagactgatgatacacaggatgtttagatactaccatagaaaaaaacaatacttacgtagcttcctctgaattaggaaaaagcctgtatacagcacactaaactttaaatttgatggatattgcttcaaaaggcacattgaatatttaaattaagaacgtgagtgaattcagagaaaaaataagctacatatatataggtggtatgtagacatagcgaatattacacagttgggatgcggatgactgaactttgggaaacactgctgtagaatatttgtactgacaggtctgcaagttggcttcttatccatttggttccttggctctccaacagggccttactattactagctgaaagcctaatggtataaaaaattagtactgaggtgagtcagaaaagcaaacacttctttcctagtatcaactctcacagcacaaaatacttctatgaccaaatacatgaatttttcacacacagcaagcaagcaatcagttttgcaacagacaccagctgattgtcttctaattccattcaattctgacactatttacctggtggtagcaacagatcccacagattgagggctcaatcccacaatgctgccttccacttcatatgccaatcgaaagccccgtgttgttttatctgtgcttttgaccaactggctataaatcggggtccttatgaccccgtccgcggcactaatttgctggaatggctcacagaactcagggagatatttacttacgctcaccagtttattataaaggatgttacaaagtttacagatgaagaactgcataaggcaaggtatgtgggaaggggtgccaaggttccaagcttccatgccctccctggtcatgccaccctccaggaacctctaaacttcagctctacagaagctctctgaacccagtccttgtggtttttatggaagcttcattatgtaggcgtgattgattaaatcatttgtcactggtgaccaagttaaccttcagtctctctcccctccccagaggttggaggtgaggctgaaaagactgtaatcaagccttggtccttctggtgaccagcccaatcccgaagctacctaggggctgccagctaccagtcaactcattagcatacaaaaagacgcttattgctttggggattccaaggattctacgagttgtatgccaggaaactgggaggaagaccaaatatgtattttacaatattgttatcaagcagatgggctcactgcccactgtgcaccgaagccaataactatggcaccagcttttcagaaaagaaagattgtattgcaaaatcagccagcaaagagaccggaattgggcttaaatttgcctcctggatttggggattggggcaagttttaagggatcagagggcaagggacgggatttagggatgttagtttggcagaatctgattggacagcttcaaatttgaccatttatggtaaggtatgttgaggcagatttttgccctggatattccaggctaatggacttccatgcttctgaaagagttcaggttctggtcatgtcccggtcttcttggttccacccagggggtggaattgttggttccagctgttgttacaagtcaaagctttttctgttatgcgtgcctaggctgcatgacttgcagttttgggctctgttataccttaaaggtaacttgacattttgttatcaacagagtaggccctgtttgggctggttccacagttatactatcacatgaggttttaaaattttagtaaaattaagattaaattaaacaaaacgtattccataaatctagaagactaattaatacaaacatgatcttgtctatccattacagaaaatcacaagacatggattaggatatacatataaaaataagccaaagattttagggctgtagtaaatttatacttgaagcactttttggtagctgtttgaggcttcaaaatgaacaattaggcacatccacaggggtcaggattagagatgttcactgcagccttgtttataatagagaaaagctgattacaatcaaagtgcccatcggtggggctgagataaacgctggtttattaacatgttagaatgctactcatctgttataatgaatgaatgagatcatatgtatcaatagagatggatattaaaaacaatgctgagtggaaaaaacaagtcatagtatgttatttatgagataaagctatttatggaatttgtttcaaatattcaataatatattgtttatgattccacatatgcagtaaaagtacaataatataaactgaaaatataaatactaaattcttgagagtggctccctctgggtggaaataggaaatataggggatttcttctttgtaaattttttaatttctttcattttgggtacctggtacatgaaggcttggtgtattctactttattatgttttctgtatttattcttttgaagtaaaaaaataggccaggtaggcaaaaacggtatatgctcagaaatgtaatggtgaacatcattttgcaaaaatgctcttgaagttagggaaaaaaaatcagcattacatatcttctagagactatgtttaatttaagaattgtgtaggtattcagagatcttggtaaacactaaaaggatgcacaatgctgagactcctctgaagtctcattagtgatataactcctttcttaagtattacttctcaaattatattttccaaaaacactctttatatgtcacatacagatctctcttcaaggtttttgaccagaacctcttagacatttctaagctactgctgtcaccacatctacaagaatgccttatttgcccacagccaatcatctaagtagcattataaaccctggaaacagctgagagactcgttttgcttcatataactgctgactctgcccacctaaacaaagaaaaaagtgcctgaaataaaatgagtctggattattgtgccagttaaacagtctgatgtctttgagatcacacacaaaaaaaattggttttggcacaccagaacaaaattataatttttctcctctagatagatattctttcctggaaaaataattaactttgtttcacattacatttaagtatcataatgaaatatatggatttctaaaagacataaagccattgtgaagtactgacaaacacattatcataaaaatagcctaagtagattcagaactttgcattgtctgttggatgctaatagataaattgtatagttagcaggagagcaagcaatcattctgtatctgacagtcacaataatgcttctctaaccatctgcaaaatctctcttctgctttgtcttgaaagggtgaaactggactaccaggatttccagggtctgttggccctaaaggacaaaaaggagaacctgtaagtattttagctttgaggacagaggaagaatatctaaaaaacgggattaaaaatacgtttccaaatcagccccaattccacgtgccttggttgatcctgtcatgggaaacaacagatcagatcttcaagcaagtactagctacgctatgcactaagtctcttacatgtatttacacacttaatccataaaaagtttccataaggtcatctattatcacctgcatacttcaaatgatgaaagtaaggcataaagaggttaaaaaactttgcccaaagtcacacagtactaagcattggagctgtgaatcacacctaggtgagttgattctagaacctaaagtttaaaatcacaaagctcctctggtataactaaacactgcagctaaaataataaaatcaatgtatcaaaagactagtacaaatttatccaaaagaaattggaaacacatctttctgctcaaacaactgttctcagtgtaccttctgaagttatttttctttcttgatttttgtatgatcaaagtggcttcccaaccactttttggtattactgtggccagtttctttcaaaatgtagttctttttgtggggaaaaagagaaaaaccctacagtatcatttatattcaaataggaccacctaaagtgattagagaaatcataggtacaaaaaatgacttgttttaatgcttcttttaaaaaagcagttttcaagaatcagtgagaatcaggcttaacaaatgtttcatctttgtttaaagaaaagtaatacatcttattaaaccactctacccctttctttacgagactgaataaaggatattggtttatcaggggataaaacatgaagaggtcactaaattgcctgcatgacaaacaggaacattatttaaagtattcagtgttacaaagccaaattttccctatgcttcagctttaaaaaattaacaatgacagtaatttttgcagctttagaatcagtctgtggcctatgtaccccagttcttctaccttcaggagtcgtgcttgcccttagtattcagttcaagccttcttacacaactacaggatttggcagtctttaatgaggttctccaactgagtatttgcaataatgtctggaaaatctcatgtctcagaaatccagcctggtgcatgcccctggtacctgccaactctctaggtgctccacacttggaggttcctcttaccatctcttagctgcttctctaggtctccactgtcttccctccaaacctgaacactgacaccaaccttctcttaatttccacatgatgcatggaggaccctgcagtaagattaataaaaattttactggaaaatcgaggatttttagagcagaaaggagaaactttcagtgagttagagcggtgcttctcaaatgtgaacatgcacttgaatcccactgattctaagtcagtaggtttggaagcaggaccagagagtctgtgtttctcataagctctcagtaatgctggtgttattggtccatggaccacactttaagcagcaagggttgaaggagttcatagttcctaggagtcataggccttttcctcctgcagggatttcctctggctttctttctggctaactttcaagggcagtccatgtatctcatgaggactgcctttagccctgttttccttaaatagagcttcttttcctcctaactcttctccataccaggtccctattcatcccttaattatcccaccaccccatacatctttacttgccaccttcctctacccctacattaaaacaacgcaaattttacattattacggagagcagtttagctttttatggtctcaaactttctcttccagaacaggatgtagactttactttgcataataatcagaaggcccaaacagaagagtagtattcattcaaaggtaaattctgaaccactgatcccgaatggtaactaaaatggcaaattttcccccaccataggacattcagaatatggtttgatgtgtaacacatcagagctaaaatatacttaagatcacctagttgaaccccatgattttatagataaagaaaggggagctctaaaagattaagtgacttgcctcaaatagtagccattggagccaggactaaatatcaagtatctagacaactaggctcccgggtttttctctttttttttttttcttttataaccagttactttagtcaatgtggccactaaactttacagtggctgtaaataagcaatgacatgagcagtgtcatataagcaaaaacaagcagggaaataagaatataaataaagccttgatctaatatatagaaatcaaccactattaagatagttcatcatgttgggtagatatgggtatatagttgtcccttggtatctgtgggggatgggttccaggactctcagaggataccaaaatctgaggatgctcaagtccctaatataaaatggcctatttttatttgcatatcacctatgcattctcctgtatacttcaaatcatttccagattacttataatatatattacaatgtaagtgctatgtaaatagttgttatactgtattatttttaaaatttgtataatttttattgctgtattattttttattgtttttctttttcaaatattttttatccacaattgcttgaatccatggacacagaacttacagatatggttaacctcttcaagtcattttcattaaagtaaaaataaaaactaggaaactatttttaaaataatgagtttgtatatttaagcacacaattaaccaactggaagaattcaagtgaatgtctttcccttcaacgtttttatcaatttcttgctgtcattcccatttcacattcaattggatgtgtgtgtgtgatcgttttctatgtggactaggcaataggaagctttggccttgggcagcattccaatttgtcagccacttgggattttataaatgatgttagaatgattaactcattgttcatttgggaatataaaggagtttttaaattaattatcatatatttcctttaagctgcaaagacagactgtgtgacactctgggtatttttggaggtctgtttgcaatgggaatctgagtttggcctatagggtttatccacaccccggtttggagagtttatttctaagagcgtttaattctattttctaccccttctccttagggagagccttttacaaaaggagaaaaaggagatagagtaagtagatattttatcactaccttgggttttctacttcattgatttgtttctctctgattttctggtatgtttactttggagtctaatagatttgattaaataaggtccatgagcattttactttttcctctgtgatttttaactcttttattttgataaataagaaattttaagccttgttaactgttgtcatgcaaggagacttcaacattggtttgagttttctaatacattgtttaaccagttactaatagtgattggacatgaatgttatacaagacatccatgtaggatatcaaaaatataaaattaaaataaaagatacatttttttccaaaaattctgttaatggcacaaagtggatttatcaaatatattaataagtcacagaaaatttaaaaagcaaacttattatagccagtatcatcctcttttgtataaccttaattttgttgtgatttttttcattaagcacatataactaaccattaagcacatataactaaaagtagaatcaccaacacatattaccttaaattctactctccctcattctttctctgaagttttaattctctgggacatgagattagttggtgtcaaattataactatgtcagctaagtagagaatgcagtgattgctaatgggacatgataattagtgtcaaaaatggcattgggggaaaaattattataatgaagaaatcaagaaagtattatttattagtagtaagtattttgaatcatgttttagaatgaactctccttgattttattgtgtcttccataatttccctttttattgtatgttaattagtagaaattcaattaaagtatcagagatgtccatttccatctgaatttaagcattacccttatagtaattattttatttacagggagaacctggggtaataggatcacagggagtaaaggtaatttcctggcattcttcaatttcctctccaaccttaatgagattatgaaaattaaagaaacattgatctttccttccccccacgtgtttagggtgaacctggagatcccggaccccctggtttaataggaagcccaggactaaaggtatataagaaataactaagatttcttgggaaataatttgggaattgtagccattctgtgtaaaacatggtgctttggtatgccactcattttcttcacaaatgctctccaagactttatcctgtttccatggtgattttccccactggctgcatttattacacgcatagtaactgtcttttggttttcacaataggatttctatactctttttcagagcatattcacaatagcatccctaaaagccttaagagtaaacaatgtgagctaaatctacgaccttgagctatattctaaaaggaacagaattcaagtttcagtttctaaaccaaaattatgcaacgttgagttgcttgagtttcccaagtgggattccacaggagtgtcccaagagagcagcttttggaaaatgcaggagaaattaatgtggtgtactcccagacaatgggtagggcaagttaccaggtatcacctgctggtgagaacacataaattaaaagtatctggaaactatcttggtaatcacaaagcacatttcagtattatacagataaagtgggaaagtgggatggtggaaagttggtcttcctatacatgaagatcacactattctttacaaatactcaggtacaatctatctttttttttcttttttagcaaagctaaagtatataccaccttttattttagggtcagcaaggatctgcaggctccatgggacccagaggaccgccaggagatgttgtatgtataatgtctttgatatttctggaattgaaattgagactaggacatgtttttaaaaacatcaacatgtgttcaagtaactgagttatccctcatttcccaaagacatgggtcatctatgccactaaaactgatcatacctaatgtcaggagctattgggaagactagacccttcatataatcatgtgaggtccttttgagtatcattagcctaataaattggtttttggagctcaagttaatcaaattgtcattttggacatgcttgtcagtgctgtaccagcagtagaggagattggaaatgtcaaaagaaataaagaacaccaaaagagaaagcaaacattttcaatattcacagtttttagttcaagtctccatctaaggaagacatttcgaaagcttctatcattttctagcaaaagccttccaaaaaaagcaagtcttttggctaaaagtatgtctggaggaagatcgacagattgcattataacctagctttagtggacttaaaatactcaatacacctttctattcattatccggatcagctttttgttccttggacaactttctagccttctgacaacttgggagctgcgagctctccatcagttcacacttgagcaaaataagaaaaatccttggccataactccttggagactgatcactatctgactatgattagagttccctccaggcaactcttaggatctctccttttttcatgccctgggaacagccccttaacctcacattctattctccatgctcaccgcttgagcctctcctgtctactagtcggtgcacatattctgcttggtactttgaacacccagtttatagagcaaagcttttgatcactcccctatgccaagtaatgggccactgtagataaacctagtggacagatcttatgaaaagagagataatcctggtggcacaagtggagccacaatgctcaaaaactgagactaagtgatagtggccagagctataaaaagaacaaaatctaaagggaaagagccactgtttctaaaacatagtaaaaacatatttttctagttgccctagagttctttggaatcattatgtgatgctgccaaccaccatccttcctcgatggcaataatatgggtgagacgttcggttcaattcgactttagtttctttcctatggcatccaggtggcttcacttgaaacaacaaaccacgtagaatcactaatatttttccaggtcttaaaggccaaaatcaatccaactccttctattaataggttatatgttaaaattctgttctcttgacagagattcacagatatagggaaatgttattgtaagagatgttctcattactctttcctattaactctgagttttctagggattgccaggagaacatggtatcccaggaaaacaaggcattaaaggagaaaaggtatagtttacattttcctcattttatatgttaagtagataggaggaagagacagaggatcataagggagatgaaaggacagcccagggcttctgggattgtacagattgtgcacattaactacaatgtaaatggcaccccctagagttgtgcatttggcagccctggttctggcacaggaatgccatgtgacaaaatgaactgacagatgaagatatcaggagtctgaaagtcaagctcagttaccaatcctggtataaacctaagaagtctcttaatcttgcaggatctgtttcttgatatctacatggaaacagtgcattaacgttgaaccattattggagaataacttaaagaaaacataaagatcgtctatagaaatttattaatagatatgcccttttgtgcatacacatgcatatgtttcatgatactgctaacataactaactgcaaaatctaaatgcactgaacaggcatgaattaggtactcaataaatattattgagtgagttggtgagtgagtgagtgagtgagtgaatgaatgaagtttgactggctatgatgacaacttaaaacaatggaaaccactacctcctcacttcccaccatgaacctgagcatcaaagtaagaatcttaccttgttttctacagggagatccgggtgggatcataggccctcccgggcttccaggtccaaaaggtgaggctggtcctccagggaaaagcctgccaggggaaccagtaagtattagcccttttgttaatatttttcttgcaagttcattaattactacttgtgggttcctagtttcagatcacaagtatgggaataagtttaggtctgcaaaaaaaggaaaaaagaacttaaaacagaactaccatttgacctagcaatcccactactgggtttcttttcccaaaagaaaataaatagttctacaaaaaagacagatgtattcgtatgttcattgcaactctattcatagtagcaatgagatggattcaacctacatgcccatctacaatagactagataaagaaaatgtgatacatacaaccatggaatactatgcagccataaaaaggacaaaatcatgtcctttgcagcaacatggatatagctagaggccattatcctaagcaaattaatgcagaaacagaaaacgaaatactacatgtcctcacttataagtgggagctaaacattggttgcacaccaacatagtagagatgggagcaaaagacatgggggactactgatgggggagagttgaagggaggcaaggttgaaaaactgtcaggcactatgcttacttccttgggtagtgggatcattcacacaataaacctgagcaacatgcaatttactcatgtaataaacctgtacatatacccctgaacctaaaataaaagtcaggggaaaaaagaaatattcatctattcatcttattgtttcttttttttttttttttgagacagggtcttaatctgtcacccaggctagagtgcagtggtacaattatggatcactgcagcctccacctccgggattcaagtgatcctcccaccccagcctcctgaatagtggtgacaacaggcacacaccaccaagcctggctaatttttatattttttgtatagatggggtttcaccatgttgtccatgctggtcttgaactcctgagctcaagtgatctacccatctcggcctcccaaagtgctgggattacaggcatcttactctataaatcagagataaaacctcttaaaagtttgataagcaaagggctttcttctgaagaaaatatacatgcatacaacattttgcatatgattttggaagattcctaggtcccctgaatcctaggcatgaattctgtagagatctatggatcccagtcaggtacactggttttaaaacataaacgttcctagggcagtattgtaaaacagaaaaactacctgaaatttctcttccagaggttttgcagatatcatcatggtttgtcatttgcagaaaatgtctttgtgacccagactattcccaggacattgaaaactggactgccggaaaatctaaataaccaatgtttttaaaatatgttttatatgcctttgtttttcatctcctttgaactttttatgtattaaataataataatatttctcaatatcaggtgcctcattttataaataaaaatattttatattttaaagcaactatacaaaatctataacatattgaaatttttactccccgttccttattcttttatagaaaaagatttattcaagcaagatgaagagtgatgaaacatattttagttataacttctaatgtgtttataacttttctagaagaagatatgtattcatactttttttcttttagggattagatggaaatcctggagcacctggtccacgtgggccaaaggtatacaaatattatagttaatttttaaggaatgaataattaacaaaatacagcagaaaaatgtatgtctcttgagccttgcagtaacagaagcctttcatttcacagggtgaaagaggacttccaggtgttcacggttccccaggggacataggcccacaagggataggaattcctggcagaacagtaagtgaaattcattcgagtccttgttgattccaacattgtgaaacaaaatccagtgtcaaattttaacaaggagaaaagaatagaaaggtcagagacggaaatacaaataaacactatccagagatgactgatcagcattgaggttgtatcacttaagcacagagacagtacccactgtttgtttattaacttacagatgctggtcacacatacactaagtttggattagaagcagtcatttaacccttatacctctattctatatattaaaaagcacaaatacatgtttgtaagatagtaagaatgcctaatattaggtcaatatatattacagcttgtttttaattaagttaaaacaagaaattaatatttaaactggatggagtatgcataagtgaaatgacaccaaaaaggtctgagtaacgtcttcagagtgaagagatgatgttttcaatggtaaaaataaataatgagaagtttttaaagtatttaaactataaggacagagcctagaacagcccctattaataatgaccactatatccacacttgtagatcaaataatagtaaatgtacaatttttatttactatggaaagacataaaacgtttttgaacaagaaaagtggaaataaatggttattctaatgacattaatttagaaaattggtctgtgtggtgtaatacaaaaacaaactaattgttttcatattatgctcttaacattcaacataaatacaattctgacaccagctgtgtggggttttttttcccctactcatcaattccccaatggacatcaactgaatgttctattagtcaattcatgtctgacactatctacctggattaagagtcagatcccacaggttaagggctcagtcccacaaaactgacccctacttcagaggccaactgcatatctggaccttcatgacttctgtccaaccagctataaactgggagcttccatgacccccacctcaggttctatagtttgctagagtggtccacagaatcaagtaacgctttcttacgtttactggtttatgatatcagtaaaggatatgataaacgatacagttgaacagtcagaagagatacaaagggagaggtctggaagggtccctgagtgtaggagcttcagtccccacggagttggggtgtgtcactctcctggcacatgggtgttttcgccagcctggaagctctctaaactccatattttgggattttatagaggcttcatcatgtcagcaagattgataattaactatatttccagcccctctcccctcttcagagaacgcggggtgggctgaaaggcaagcttctaactgtggcttggtctttctggtgatcagctcctatccaggagcccaccgagagtcacctcattggaacaaaaggctctcctatcacccaagaaacccaagggattaggagctctgtgtcaggaaccagggtcaaaaaacaagtattagaacaggactttatgttagcaacctattgttaaggaatttacgagggttttaggagctctgtgccaggaactgggggcagagaacacatattattttatcacaatatcacatccttatattgaagttatcatgaaaagttaaaagaaagcataagcagtgaagggttatgttgtgaatgagggttgtctgatttgccagggcaagaatgtaaaagaacattggagatggaaattaagccaagtaaaaacttgtatcagaaaattattagaggctgggcctggtggctcacacctgtaatcccagcactttgggaggccaaggcaggtggatcacttgaggtcaggagtttgagaccagtctggccaacacagtgaaaccccatctctgctaaacatacaaaaattagccaaacgtggtggtgggtgcctgtaatcccagctactcaagagactgaagcaggagaatcgcttgaacccgggaggcggaggttgcagtgagctgagattgcaccactgcacttcagcctgggtgacagagtgagactccatctaaaaaaaaaaaagaaaagaaaattattagggaagtgatggtggtcgaggaaaaaatcactcagggacacaggataaataggaagggaggaaaaagtagctttggcaagagcagtgatatgaatatttatttatttaaataagaaaagaaaaatcagtgagcagttactgaagtcaactgctaagaaaccagctcttgacttacttaggtgaacattcctcatgcagaagttcatggttacctaagagcggtacaactaccatcgttaagttccctgataatctcccagcctcattttatttatccgaaattctaattttctaaaagtagaaaaaaaaatcattgattagtgttttacctcctactcctgtcactgaacactgtttctggtgatttattccaagagataaatgactcaaagttgaaagcagaaaagaatccctgagccagttacccctgtgggtggtcagtttctgacaggtggaatttggatgcattctttgtgccctcatgaatgtgcagtgacagattatggtaatgatatagatgtcccaagtccctgagcaaaatcatgttgatgtttccagcaacaggtatctgattaagtattcacctacgacctgaaagtcttggccgactttgcagttttccacgtgtgtacggtggcaaaccctgttgttcctctaagtaaactacaatgcttagtcttttatgtcacttggataatttatggacattcttggtggaattttaataataaaatctcatttgtactcagggcgcccaaggaccagctggagagccaggtattcaggtaagctatttaactaattttttagcacagcaaagccagcttgcttacttgggggaaatgactgaaagaccatcctcataagtaactgtttttatttccctccttttccagggtcctcgaggtctccctgggttgccaggaactccagggactccagggaatgatgtaaggactttctttatctaccctcccccattttaatctgcacctgtgccacgtgcaaagattgaacatggatacctctgttttcagggagttccagggagagatggaaagccaggcctgccaggccccccaggtgacccggtatgtagacaaaccttgtctgatttatgtatcttaaatgcacccagaagccaaacagcctaccaagcaagttttgctgtccaaactaattagaatgctcggtgactgcttggtgattttgtttatccccattattttgtcgagtgaaaaaaaattcaggctggatcagcatttctgtgtgtgtgatgaatacttatttcctaagggcataattcaactgtacaattttgccccaggctgagccttggcatataatgtctcaatcccattgaaaattgagataaaatatattgccacgatttctattttttctaatgctagtggctaaatgaatttcatttttctaaatgaaattttgcaggtaagttgcctacaatatggtatagatccattgattctgtagctttaaaatgttgcgatgattaaattatgaaaactggcttgagtaggctcttagaaaaagggttaggcacaaatgtgtgtttcaaagttttattttaggttaaaccttgctttgagcaacagtgaaacccctttaaatagcctcagactcggcagttataatttgagaggccatatggtacatgacattgtattaagagtcttgtataataaaatccaaatctggcttctcagttctaagcctcacaaatcctttctacctcccacagtgtttgggccttatgtgcctttataagctatgtgtggaggcatattttggcattactttaacgccactgttgagtgaatcacttgtgcatttttctgggaatcttgcaaaaatgttgcttgggtttacacagtgtctctctgaaagaacatctcaagacgtgtggccaaaaggtagcccaagttccttcagtgtttgtcttgcctatcacttaagccaactgtaggttctttgaacttccatgagaaataactttaaggcaaacttatctggtacttttcatatttctcaacagcctgatagtgtgttcgccagaggaatgatttccttttaataaataatttatctttatgtattatttaaaaccaatgatataccagggacagcataaaggttgccatgaaaatataaaatagggatgcacagtcaaaactatgatatgtgtgtttgcacattcaagagagaagaatagtgaacatttttcaaaatttgttctgaattctatcagtgccatgtgcacatttctttatacgaaacataatgttaagccagtgattctaaagtgagacaccagaagcttcatggcattttgaggaaaaatgtctacattatactgtatgtttatattgtattgtgttcatatataaatgcatgtatttggttttatcttcttaaccacagattgcacttcctctcttgggagacatcggtgctttgctcaaggtactctattgctatgtaagaaattatgtgttaatttccaggaaaaattagaaagaaaaatatttagcagaaattgagtcaattgcttagctggaactaaaattcaatttttaaatggcaggacatctttaagataggaaaataaacatgtatcttatatatcttgtgccatttatcctaattctttcactctcttcttctttaccagcctctcattttgggtggggcaggggtggagggcagctggtaggatagttatgaattggctacagggaaggaattatgtcattagcactctggagtagattattctctcctctggaggaacatctttctcttaatgggtgttgactcaccctggctcactactgtgaaacctaatctttctcgctatatctggcctggtcagtcccaagatgaaaatcagtgctgctctataaatagccacttacaaggctgaattttgatgtcataggattttacaaaattccacagttgacaagtgccctaatacctgttactctgttcaataaaaatcacctctacctattatcgtctcagggaattaatcttgctacctctttttttttttatctctaacacttccctgtattttatcagtaaaacaggtagggggggatgataatggcacatatgtaagggtatgtatttgcatgtttctgcctgatatgctaagattgagtgaggccacatgaaaatcaggcccttgacttcatactcaaacacagtgtgttgtatctgtctttgtatgaatggacgttgtgtatgtgtacacacacacacgcacacacacacagactacagttatatatatataatttagtttgtatttctagcatttagcccagtgatttacacaattatttgcacaatagtaagcaggcagaaatatttgtttaattgaattcaaaagactcgagttccggcatatacatttgtaaggtagagttttgagaatagatatataaacataagtgtaaatatgaatataaatataaaaatatattaaaggagtttctaagacctccaaaaccagcagtttttataagccagagaagaatatttgtggggatttcaggaaaatcttatatttattgagttaaaattacatgccactcaatatgccactttacttatatcatcttatttaatttccttaataatcttatgagttcaggctgttgcgcattcccactctatagatgagagaccagaagttctcagcagttaagtaactttttcagtcatagagcaagtaaatgtaacattaacacaggaacataggtcctcagacattaagtcctagattctttacaagacagtggtgctggaaatagcaggattgccggagttatatcatttcagaatacttagggttctttaaggatgagaaacttgtatgctttagtagaaatgaatatactggtagaatatgggatctcacagaacagataaaaggaccatgaataggctctgacgggaagtggaaccagggctctcagaagtggaactaattgacaatctcgcccgggaatcatccctctaatgagtgtgctctgccattgcaccaatccctgcatcatttcactaaggttctgagtccataacgagcaggacatcttgactgatagtctccacaaactgtatacaatagaagaaaggggaggtatgtagttccccgaacaaaatccaaatacaggaatttagactgtgggttggatctgtcatgccaatgtaataacatcatgttaaatcctgatcttgttaccctatatgttaacactatctctctctgccttgagtctttagacaatttgatcatcctgctttctgttcgcaaaaatatctttgattaaagtattaaaaagaactggcataattacaggcaccttcaaaggccttcttctagattaatcagcatatcaatccctctttgaacgactttgtgtattggttaataattgatgcatctttattctttccatgagaaaatcttaagacatttttccaagaatgttaacaaaactcagttatttaaatttgccattctggtaaccctaacccaaagaaaatgaagtcagtttcaaatgactcttaaaaattatgtttatcataatgattatcattttttaatgtttcacttaaacagtctattgaataatctattctaaaatgttgctccatattgatatgccaaggttttgctccatattgagatgccatgtttgtgtctgcagataattatctttttcatactttttgaaatatggaaatcattttgtttttcttaagttctcaagtgtctctttatcttcatagtttttcaggtgtcagtaatagttctataaatatatatatttaactcccctgccaacacattaccacctgtgaaataatccaggtggtaaaattcatctgggaaacattgcatataaccctagttcccttttatatattcagactctaagaaagaccaccatgaagagagctttttcacccagcattttttttatgtactttaagttctggggtacatgtgcagaacgtgcagctttgttacatagttatacacgtgccatggtggtttgctgcacccatcaacccgtcatctacattaggtatttctcctaatgctatccctcccctaccccccccaaccccccacaggccccagtgtgtgatgttcccctccctgtgtccatgtgttctcattgttcagctcccacttatgagtgagaacatacggtgtttggttttctattcttgtcttagtttgctgagaatgatggtttccagcttcatccatgtccctgcaaaggacatgaactcatccttttttatggctgcatagttttccatggtgtatatgtgccacattttctttatccagtctatcattgatgggcttttgggttggttccaagtctttgctgttgtgaacagtgctgcaataaacatacgtgtgcatgtgtctttatagtagaatgatttataatcctttgggtatatacccagtaatgggattgctgtaacccagcatttttgagatgatttgcctcatgtattcatcagggttctctagagggacagaactaatagtatatatgtatatatgaaaggaagcttattaaggagaattgactcatgtgattacaaggtaaagtctgacaataggctgtctgcaagtcgaagagcaaggaagccagtagcagatcagtccaagtctcaaaacctcaaaagtagggaagctgacagcgcagccttcagtctgtggccgaaggcctgagagcccctggcaaaccactagtgtaagtctgagagtccaaagctgaagaatttggagtcttatgtttgagggcaggaagcatccagcacaggagaaagatgaaagccagaagactcagcaagtcaaccccttccaccttctgcctgctttattctagccgagctggcacctgattagatggtgctcacccagattgagggtaggtctgcctctcccagtccaccaactcaaatgttaatctcctttggcaacaccctcacagatgcacctgggaacaatactttgcatccttcaatccaatcaagttgacactcagtattaaccatcacaccttgtaagcttttcagtatcgtgcaaaattagtgttccaaggagcccatgtttgaaaatcagatttacattgctattcattaggtcaaaaatattgaatttgaatagccatgggctttcttgccagcttcttatcaataacaagcttcacttctttttcatgtttaaagattcttccctttagggaaaaggatggaagaatggaaacttaagttgtcctaccttctgtcaactgttaaactatctcccccactcagtggcccttattctgtgcctttcttggtcatattcttattccaacaatttatttaaaaataagcctatatagagcttttcacacacactttctttagctgtgtgatgagagttatgtttatcttatgagctcagacacttgaagtcaagccttcccagatcaactaaaggttgcagagaaggcaatggaaaggtcatttcacttagatttcctattgtcacttggatatgacctaggagtcaagtttatgtcagtcaagtaattatttctctcgagtgcctccactgacaaaatgttagtaaactgtatgtagttggagaactaattttgctcccagaagaacaaatcctttcttcacaattttttctgttgtttttaaaatggtttatgctataggttgtttgaattctgtaatcttgctgggttttctaaactttattaccactcccttttaaaacattctgctaaacaattgagcctcagtttttgttcttgacttatgtgtcttttccttatttatttggaattttctatttaagtgtcattggagacctgttttaaaaataaaagttcatcaatatcataaacagatatcactgatgagctttgtaaacagtttttgcctcacaaaaattaatgtttttaaattggatacatcaagtgtctgaaagcagaatgacctatctatatcactcatctccagaggttccaaaaaaacttcacatcacatgaaacctcacctttatagacggcttttatgactccctcagtaaccttatctttatactcattagaatttctgtggcaactgccaagccagtgtcccagggctgaaaagcaacaaaggagaagaaggaggtgctggtgagcctggaaagtatgattccatggcccggaaggtgagaagcctggctgaatgtttacgatccctgtgggttacatgtagtgcatcctctcagttctgttcttcctctgtcttctagggtgatatagggccacggggtcctccaggaatcccaggaagagagggaccaaaggtaagaaattctctcctccactttcccctgtgggaacctcaatttagtatgaaaaaaagaacccgatttgaaaatagacaacttttaaaatacatactatatatatatatgtatgtatgtatatggagagagagagagagagagaaagtgatgtaaaagtcacttgcaaatgttgccatttatttgttccctgaccctgtccaaattacatgccccaagtgttcttagaagagatttttttcatttccaaaagataagaaaaatgattgcatgtgctagctgaatgtattgtctttttagggaagcaaaggagagcggggctaccctgggatacctggggagaaaggcgatgaggtaacagattcttttctgattatatagtcctaatattgattctctttacgtggctcaacagagtaaaaatgttaatttttctatagctcagatctgatgctataaccaataaaaacaaagaccacttagagcttttaaaatgctgacagattttaaataacatatttatgtttattaccaagggtccggttttagagacaaggaaattaaggcacaaagttaatatgtcagttataatttttctgttttcatttaacagataataattccagctctctcaaaataaaagtaagggaaaggaggaagggaaaatttactcaaaagaattccaaggtagctaagagatttaaaggaatagtagttggacaaccagcctagcagtaagggcagctcaagaacccagcagagcttccctgggtaccactaaactctgattaaacttcagcaaccttggattgtctgtgtctttgctcagctttcaaattcttgggagaaaaaaaaactgtcagaaaaatcttcttgttctagtttacatcagctgctcacccgttggactaaggttccaagtccaatgtgcttttgagataatggtataattttctgactgtaagccatggtgatgctcaggacatcatttttttcttacataattcacattaactcttagaaaaaccaattagaatgatgaattgctgttagtttaaacagttttgatactactaattcttaatgaaagtaagtaagccatctggcatatattaaccttgatgttattgtagaaaatcataactatataaagaaaatctatttttctaggtggagttatattttacattaccagtaatcatcatgtactattgtttctaattaatattgcttgtaatctagaaaactttgaggtttgattttttcccaagttaaaaattgaataccaagtatattcaatatttattttcatccataaataaaacattatcttcaaaataagttattgtgcttttgcttcctcatgttccacagaaggttttactaaagtacaagcacaataactgattttcatagtccaacagctttgaactacctccacccaaaaggtaggctttagaggcaattgagaaggtaataacaaaaagatcaggaaataattggaattcaggttttgtataagtaactctaagttaaagtcactagaagttaattttcattgattctacagggcacttttctctcttggtgaactgaaatccattgctaatattcctccacactttagcgggctttttcttcggtacccctcataaattctgtaacacagttcacaaaattgtacacaattctcattacatggggagttccagcaagttcaggagattcttttccattgtttcttcacactacgtgaataatatgaataaatctgaagtaaactattgactcctttaggccttgtagggggaataaggtggtgcagctttttctttagcagatgggaaataacggatataatcttgtcttctacttggtctcagatattatttgaaattacaatttgttgatttgtcaaagtgaataaaactttgaccaaaaacaagtgcatttccaactggccaatgaactataccatttcaacatacagtatggacttgagatctaatcttatgaaatctcaaatgtctattgtactctaagtggaaaagatacagagggacaccccatctctttgagacttctaattattatgtctttcatctgtttggaaaatgagagagaggagttgcctgcttgtttgttactcttagaaaagcaacattttcttccacatttttcacagacgttgttgcacagctcaaggtagcaacttggaagatgctaatagaacacatgctaacctttgatggagtgatttcttgcttgaaatgcaggtcttcctataatatcttgggataataattgataaattagacatgaaaaatatcatcagccagatattatagcaacagaaaatattcttggtagcaactgagctaggatttgcaaaatgaaatatcagagcagggtaagaacatagctccaatggtctccaaatatctctgcaataaattttaatttgtattttagtttggcactgtatgttaaattgactgtcctactctttaatatgtatttgtcttctttaatgatcatcttgtcttctaaaattatcttattgccctttatgcatccatagtaactttcacttttactacagaatttcagctttttcagagaaaggctgatgggaatgattttttatttatggactgaggtttattttaaagtttaatgtggtcatcaaaggttaatgaatcccaagcttataaattagactatctaaaaactcactcaacatctctggactgattcagtgttgagactaaaagtagcaaaaaaaaaaaaggaatacatatatacgtatattttatgcatgtacatatagaaagaattttatggaaatatgggtattttgaggtaaagaaatttatggtataacatttataatctccagtcatttagaggtgccattatcaatgaaaatttttttactttgcatctataaacctgcatacaagttaatgttaggggaataaaaagaatgagtaccacataccgatatgtagagcctgcacatgcacacatgcccatgtatacacacatacacatacacacacacacacacacagcactgccaatgagattgataaaattttgaagaaaaatatgtcaacattctttaacaccaatacacacaagatttggcccaagacttatgaggaattctagcatgttcaagtagaatttttaagcccttcttcatatcatatcacatgaatagacctgaagtaacacatgatgccatttggcattgaatggacaaacctagaagaacttggtccttgatcccactgatgcaaagaaacttgatccagctcacagtcctatagaatgctgataatcaatatgcagtaatatttccatggccacatcatctaatatttataaagtatatgaaaatgcatatatcataatagtaaaaggtaaaggaattgtatgatgacaaagaatggtatggcaatccagaaagaatattttactcagtaaaggagactaaatcctgaaagaatggaatcattcagtctagaacttgatgtatcacatggttatctgaaataacaaaagcatattttaaaatagttttttctcataatagaagtgatctcagtccactattgaaaattgggaaaatacaaaaatgcactaaaagataaaatttctccctattcccactacccaggagggacttctggcaatagtaatgtcatggtccacaactctattagtccattttcacactgctataaagaactttcctgagactgggtaatttataaaggaaagaggtttaattgacccacagctccacgtggctggggaggcctcaggaaacttacaatcatgacagaaggtgaagaggaggcaagcacctttacgaggcagcaggagagagagcaaaggaggaacttccaaacacttacaaaaccatcagatctcctgagaacttactcactatcatgagaacagcatggggaaaaccacccccatgatccaatcacctccctctctctacatgtggggattacagtttgagatgagatttgggtagagactcagagccaaatcatatcaacaacacctcatctataaattccaaaaccaaagcctctgaaaaccctggaaatgtttcccaagtttggctttgtttcccaagcaaattcatttggcagcccaatctggcctaactcacacggagcttgtctattccactctgtcagaatatcatgttttgccacagaaatatttgtgtgtttattagagggcactgcctcaggcaccactgcagtgtgatataatattcagtatgtatatcatgttacctgtgaaatgaagtgataatccagaattctaaaacacatctaacactaaagtttctgataaaacttatctatttgtcgtgataaaataataaaagcctgtatgtatcattcccatcttttaggaagtacatttaaaattgtttaaaaatttagaccctgtgctatataagatttgtgactttatttttacatgttttctaacttttttaaaacatgattttaataattgcaaaatatttcatgttataaattgtatgtaatttatctaacaatattctgttgttggcaaatgtatcaaagtaacaaaactaattacataagttagctaatcttaccatttcttccttgatatataaatgtatcagcatcttaaatcctatccggtataattagtgctattctacaaatctaaggaggggagggaggggaaatctattcattattatgcttaagccattaaagcgttccaaatttaaattcaccagtgagccaaatttcttcttataataaactgacaagctaaaataaatattatatcataaaacatattccatttttccctagctgaatggagcttaagtgtaatcatctatttcttcaatggcattctgccaatctaaaatttgtatttccatgttttaccagtacgagattcttagatactactgctgacggagtggccctataaaataagaaatgctctatgaatcaccagattaaattatgtttgcttcagattccatgtcatggcattttagctcacccttcttactctttaaaactgagtattcacacatattcttacttataagtgagggctaagctatgagtacgcaaaagcatacagagtgatataatggacgttggaggcccagaagtgaggagtataggcgaggtgtgaaggatgaaaaactacctattgggtacagtgtacactacttgggtgatgggtgcactaaaatcgcagacttcaccattatacaatttatccacataaccgaaaatcacttgcacccctaaagaaaaatttttatttttgaaattaaaaaattagaattaaaaaagtatatttgtatatgacaaacattatgtttctcgattagctaaataagtgtttaatgttcaatggtcaaaatatttgattaactaaaatgccttcttcccaatgatataacagattttatgatgggaactatcttttccagggtcttcaaggaattccaggcattccaggtgctccaggcccgactggaccccctgtaagtatttgttaaaacgattgcactcacagcttatatctgctggtttgatgcaaggtgaattaattttcttcattgccttttgttctctgtgcctctatgtagattgtccagatattgcctggaaaagtagcctcatccaagctctcagattttcatttagtattacttaaggctactcagtgtcctggggacttgcctcagaattccaccagaccagaaagcagtctgcgattaagctagtgtgtttgaaatagaaattgcatataaaagagcattctattttttatttataattttttggcactaacctttagaagagatagtcaaatggcaccacaaactgagaatttattttctaaaggaaaaaaaaagtgtgctaaggattatcagatttcatttatttttgttcctatgtataaattaaaatacctctattttagtcaaggctttcactgcccctcaaacacaccatcaaagccttcgtgtctttcactgtcttgttttcctagaacagaatctcttttgctttatacttgccaaacccaatctctcattcaaacagtttaattctagagtcatcagataaaatatagtgcatgcagttaaatttgaatttcagataaacaaataattgtttaatataagttcatcccaaatattgtgtttttatttgctaaatctggcaacccagcacatgcttcaacttctccacctcatcctttcttagagttcctatgccaatagagtctttaccacaccagtaggaatgtaattatatattttaatgttctgaaataaggattttccataattaaagttgtgtcatttatgcttccgccacagttatacagaacaaacctggctttaaattgttcactaaaattaaaaacgatgaaaaagagttgtgaaagaaaccatgaaaattatagctaactctgttcccaaaggattaaaattaaattttatttttcagtggtaaaatgcagatcatagaactcaatatgcacactgttaattctgccgccttgaagtatttaaaatgttgatccctaccaaaactatagctcatttagaaaggcataatgttatgtaaattgccatttaaacagcaagactagattcttaagtgtatcaaaaggttccaattaaggtcattaaatgtggttgacgaaggtgaaaaagcgaccacaaatacaaattttacccttccaagggcttatcagcaggatacagctgctgtatcagccagaagaaacataagcttctagggcttatttaattaggatcaaatgaccttcaaaatgtgtaagttttagtaaccaacttccaataccctttggccatttaattgttgtttctgtaacaaacttagttttgtgttttacagggcttaatgggaagaactggacatcctggtcccacaggagcaaaaggtgaaaaggtacaaaggaaaagcctcacttaccatccaaactggggcttgaagtgggagcaggatgagactcttcacagagagagccataaaatcaagcaaagcctaaaagtagaaatgatggtagaaagtacctattcttgtagtggatttggaagaacacaggtccaaaggttattctaaacacgggagatattttcctaggagaaaggataaatagaatattggttccataaaacaaaagttcaggctggattcagaatcctgggcaaccatctatgtggaaggattgggtgggggagcctcctggaaggatgcaagtaatgtggtgtctaccagggagttccagccacaggggctgtcagttttctatgacaaaataccatagacggagtggcttataaacaacaaacatttatgcatatttctctcagttctggagtgtgggaagtccaagatcaaggtgctggcagaatcggtgtctgacagagtctgccttcttgttcatagatgtcacctactagctgtgtcctcacatagtagaagggtgaccaagctcccttgggcctcctttataagggcactaatcctattcatgaaggctccaccctcatgacctaatcacctcccaaaggccccacctccaaaagctccagacagcagactggctctcaggaccaagattctggtaaccaaagagcttgcagagacagtcgagaagttctgtccctagacggtcatgggggaaatttactgaagaaccaggatagcttgtttcctggggagatcagttattggacagatgggttgccatggtcagaaaggaggaccagcattagatgagtctcagacaggacaccacacagttttacatgtttaccccatttaagatctaaactggctctattgtactagtccaggcagatccagcaagtaagtggaataagcctagctatttagatcggggaagtaagaatcaagagtccacatgagccactcaagcagcttccacccactcgtcaggacacaagttccctgaccaacgtggaacataatgacatcaaggagcaaaggaatcccaacacattttgaaggaaacaatgactttattctagatagtctctgcacatttttttctgattttatcccaaggagcttgcccaaccccactagccttttttctctgttctctatggaaattattcagtcatagacttgcctttgaagttaatgggaattccacactgagatgagctttggggcacaaatgagagtgaatatatgacttttaattgtgccgggggaaaaaaaagacttttcagtaggcacatatttttccttgtttgttgactcattagaactatgacataattctttgaaggacactgccagttgtcagcagaatgtgacatgtcttagagagatagccacatcaaagcagtttgggaaaagaaacaatatgcttgttctttgttatatattctcaggcagaagcattgcaagaaaaactttacagtttatttttattgataaacatgaacaaaagattttatgatactttcgttacaaaaaatggcagggtattggaatgaagtccttgattacatttatgggaatggactaaaatccctcaaaattcttggacattgtgagtagaaattttactctatctgaattcttttttaattaaccatgtcttgccatttcccctgctatagagggacttaagagattttatgaggctattattctgagagaaaagcagagttataggaagaactgctgagagacaccagagggacttcaatagctctgcttattatggaccgataaacatctatggtttataaaaatagaagtgaaatacatttttcaactttcaacttgaattcattttcacaaattctattttcagtctgcttctcctgtaagtctaagactgtttaaattgtagtgactatttgctttaaacagtactataccacagttgcttctgctcaggaagatgtgtctgacttgggtgtaaagtcagatattaacgtaggaaatggaagatgaagtttccctcctgcagacacaacacaggttgtgatttttttactttcgtcaaattatgtggatgtcccctctggttcccaaaagatgaaggtggtagaaatgaggctcaaagtgaaggctgactcagagccacaatcccagagcccactgcctgcttgtaggagagttccacattgggagagttcctccagctgcactggaagtccaggacatgagcacctgggttgtctggctccatctaaaaataagcttcgtttctagagctcacacagtgagagtcagaatgggtatgggaaaagacctttacctgtcctgcggtctagaaatgtatttcctgggtaaaggagagcccagctgaataagactacaaggctgaaacaacatggcaagtcatatcgatttcagaagatggctctgtgattaatttcagaagatagtttgtaaacctggggtagaaacgtctacgccgctgatatgtctatatatcccttgcagggcagcgacggaccccctgggaaacccggaccacctggaccacctgtgagttgttctaggcttaaaatttaaaattcatgtgtttacttaagacttttataactcagaggtaagactacatttagatgttttcaaagataaaagtcttctgaatttcgtgtataaatataaatgatagccaatgtagctttaaagagacctgatttgttctccttttggttcagcctcaatgtgcaatgctcagattggcatactgcgggtctccccatcttggatttaggaatctgggtttgtgctccgactctccacttcctggctcggggcccctgggaaagtcatttaaccttaatgtgcttcattcacagaaaggagaagggccagaaaaatagatcctttccgctgatgcgagttggtagaaaatctgatattatgctatatgtgttcattcccattcatgatgtctgagatgcaaggaaactctatttatgtagctcttagtgaacaaaaagtacaagaggcatcgatgttttcattattgtgattgagacagatgcacgctccgtcagggaaacggtggagaggagaggagcctctctccgtggcaagtctgccctcatgtggggccacgctcgaatcgcagccgagccgagctgagatatcacgcaaaacacccttttctaccccacctcacaggaatactttaagaaaccaaactcaccatagaaagggcagaattgaccgtgactttccgaagacaatgaggattattatcagtctgcgtgcagttgcatgctttgtacacgtaaatgaagagattagcactctatttcctaaacttgtttcctaaatctgttcatctgtgttactgaccttttcccttgacaagaaagcaggacggaaagtattagggttcaaatcctaaaattcactccttcccccgtgggcagaacagcaaatataacatgagttcatgaaagggacctataattttataatgcacttaagatgtctttgtcttccctctgaattctccaaaaccatccatccttcaaaacacagtttaaatgttttcttccctgggaaacctcctttggaaatctcagatgaaaatatcctttgtctctccaggacgtagcacactaaaatatggcagacattcagtcgctgtcagataaatgagttaaataatagagtaataaatggatggagcgtttgtcttccatcactagtgtttggaagatgcatgcaaattgtcttcacagaacactactggccaccatcatacagaaacaatgaaacagtgacttcttcaactctgcaactgatatgtgaaaactgcagaaaggaaaaggcagatttgactattgattctatacaaatgtttaaaaagaaagacaaaagattctaactaaaatttttatatggaaatttttcctaaatgctaaaatgtatgatttttttaaactatagaataagttctcctttaagtgttggttactctaggacatgtcaatttttttcaagatgttcttattctcttttatcctaaagaatttatttttgtagaaacatccacacagggttgtggataatgtcatctccccatttaccttaattttctatttggtatgaaaagactgtggaaaaaaattacttttcagtagccaaattgttccctattcacatcttcatcagcactatggcattatagcctgcaggttagcaggctgtaaacagttagtataaattgacaattcagaaactgaattttaatgagcaaatattttcctccaaatgcattagtgtctcatctgtcaaacctgaacattaattaaaccccaactgaaagtatccgtgtgcttcaggtgtagctcacactcccttttcatttccctgcatttgctttggaaaagctaaaaattaaaatgtattattttacttagagtattaaattccctttgtaaaatagaatagaaaaaagtaaaaaatagaataggaatagtatcatttggtaaaatgataaaatgtagagatgcaaagtattaacttccaagaataattctgtatctcacctctttcctaagggtattccatttaatgaacgaaacggcatgagcagtttatataaaattaaggtatttatatttgtaattatttaaaatccagttatagactgctgtaaattcgtctcatctttctctttttcttttcttttcattttcttttgaagggaggtgtgaatgttcccagttacccagggccacccggtcctcctgtaagtacagttgtttatcatcaaacacactttagctgaacaaccacaatgaaaaacaaacaataaaaacctcttaagttcactgaaaaacgcatgttatgaatacagccaaattttacagcagaaggaaataagtaaaaccaattataataaaattgagaaaatgtatgcagccaaaataatggaaaacagcatttttcatggtggtgtcacttttttcattgcaaatctaagaactaagtcaatgtccaagcaatcatttttatgaaatttccatcaagttatatttattcatcttattcttcaaattcaaactgtaattaaagcaaaacttgctaatattcgtatgtgtattaaggcaaattggacaacagtgtttcttattctgtaactgctttggtcattatttgaaaaatgactttccatgtttctcttacagggcccaaaaggcgatcctggcccagtggtatgaatgttcccatgttttgtgtcatttagaatattggtctttgttaaattttgaaagaaaagcatcgggcaaaatggcctgccttcttaggtgttcatcaattaacatgctggtggtgacaagcaggccacaatataaatgccagcaatatgttctctgtttctgagatgcattagtcctgatgttgtcactgcccttgaggtttgtctctttccgtcagtgtgtttttaaaatcatcctgtgatggaggaagacacatataaactctgataaatggggcactttcttctaatagccctcttctgataattgattcaattttaagtagattgtggaagagaaatacttactggaaagaaatcccttaatatatctgccatctccccaacaaaaaaaaaaggaactgtttatttgctttaaacgtcttaggcaattattttgcaggagatatgttttgtcataaggctgcttattaggaggaatgtatcaggaggttatgctcagcatggaaggagatcatgtcctccagccgcctaaaggacgataattgttctcagcatctttctgaaccatggagcctctgtaaaagttctgccaaattcaattagatgccctttattgctgggcattttctcctgtcatgtctttttcaagcatatccttcatgtttcatttgtatatattttaacctttgggtatatacttgaaactcaaatgtacctaaagctgaaataaattttcaaaccactttccattgccatgtgaaaaaaaatttaaagccttttcattatagtacagtttgttaaaactcaatgaataaattttaaaccagcaaagggacaagtcataacaagtaatgtttttatgtctaaaaacatattttaaagagatgcattaaagagctgtttgattttgttattgggcaatatatattaaaagccaaattgttatcccctgaaagcattgtttcaactagttaggatcatattctgtaattcagtttcctttgttttactattcattcaccctgtctaccctatctttacctgaaaccaactatacgcttcattctaattttaattttcttacatcttgttgataaaaatttcctcctggtctttccctctcatactcatacacacaaaacagcttctctgaatcatttaaaagcacctaggcttctcactgactttttgggaacattctttgaagttcttgcattaataactgcagattaagataagaactttttaagtattataataaaggataaattataatttactggcattgaaaaggggctggcaacaaaaatgtagacctatttgagtagaatttgaagagattagtcttcaaatttcttagctacaacaaaggatgaagaataaaaactgattgaagtgtgttccttgcttttagagatgtgaattgagtgagtgaagcacagaaacagaaaaatgcaatcatgaaatgaaatacacatttagtgtacacattcagcctcatcctggatgaaactttgaagttactcttttgggttctctgtcagcaccaccctgcaactctcatcatctcccaccagctgtcctgtagggaaaaataatagttcctgccatagaaataatccaggaatgatagaattgtagatcacagagcaaaaacttgagaagtctttttgaggttggaaatttactcttccaacattcttcaaatcccatgacaatagacctgcctcactatttctaatcttctccataaacctttctagaggaatattacccttaattgaatttattatcttctgaggcgctccatttcattcctttggtattcagtttataaatgatgtttaattaaatatttaattattgctactttcaaacaaatgttgattgattgagcacctctgtcttaaggactgttgagaatgtaaacaaggagaatcaaagagtgtgtttcctttgtcagcaacctagggcctcttatacagaactttatgcagaacagaatctgaacttttttttttgatcagttgtcaagttacatattaggggacattttaaaagatttctgaaacatagaaagcatatcagttcatatgctcactcactaagtattctgtaataagggcaatgttataaataataatgaagttatatccctggtaatatttttgaagcagattggaattatgtatgcaaaaacacacttacagagaacacaatttgaaagctcttgtttctttgtgattatgtctaaagcatccggtgtcctaagaaaatatttgcagtgaacattaatttattaacaagaaggcatcaaacaactccccactttatctcttttttaacttaaagccctaatgcaagcttgtccaacccatggcccatgggctgcatgcagctcaggaaagctttgaatatggccaacacaaatttgtaaactttcttaaaacattaggagatctttttgtgtgtgattattttagctcatcagctatcgttagtgttagtgtattttattggaagacaattctttttcttccaatgtggcccagggaagccaaaatattgaacaccccttccctaatgctttttttgttcagagttagcaacttccttcaccacagcttttcccaaagtgtttcttgaggatctacaggctccagctagcctgggaccatacactagaaaatgtaaagatttttaaaaatagaaaacactaatctacccccttccagtgactcatcaacttgagcaataacttttagtgttattggagataatgatcctggggtcaacttcttaagcattcacaattcttgtccagctgcagagaatacttaaagatgataaacactgctttgagtgctccatcttcatctactcttaaacagtttattcttattctctgaaaatctagcagcaccaggtagctcacaaattggcaaactttattaaagccccatctttcattctagttcttattgaaattggagttatcactgagtagagggattcattctgattagattctcaatcagaatgaaaatgattaatcagaaaatatacctctctggagaatagcttttattctcaaactattttcaaacatcaaatgcaataatacattacttaaaaatagggcatatcatttccttgctaaattacacatcaatgtttggggtgggaaggttaagcaaaaaaatctttgctttggaaaccaatgcttaaaaacattttgattattgctcctgcatttcttatgttcatatttaacagggagagcctggtgcaatggggttgccaggattagaaggatttccaggtgtaaaggtaagcacagaagttagaaatgtgttcatttattcaacattcaaaattgtttactgagcacctaatgtgccaaaaactgttttaggttagggatatataaaggaacaaaacagacaaaaatgtatgtactcatgggacttacattctagcaaaaggatatagaaactaaaagaataaacattttaaaattacatcttattgttggggctatggaaagaaagaaaaagtagaatgggttaaggaggatcaggaatgctgacggggtaggagggcagtatctgagcaaagacctgaaggaggtgagagggagagccaagtcccctccagtctggaggaataatgttccaggaagaggaaacagcaggtctaaagagtctgagacataagatttcctgatgtatccaaagagaccaggggagggagtgaggagatagtcgtaggagatgaggtcagagaggtgggggtggaggtgggaagtggccttgtcatatagagcagtactactcaatgtatagccagtggagaaccagtgccagtctgcagaccctttgttatgggttcagtggcaaggttattacagagactgagagtaagcacctaaaaacatgtccagtaatttgtctaaaattgtctagcaagcatgtgatggtagaattatctttgttcatgatatgttagaaaataaataaaagattgctcttttaccacaggaagtttgagaaacactaataaaaaggcttaacagctattgtaaggcctttatctttcaatctttgtaaaatgcagagccatcggtgatttctgagtagtggcatgagggaacttgcagccagagagttgcaagggtggaagtagggaagccagttagaagatatccagtaatccaggtgccagttgatgctggctcagatcagagcagaaacagtggagatagtgagaatgcctggatttggatatattttgaaggtagcactgataggattttcagattgattgcattattagagaataaagaggagtcaaacacgaacttcagttttatgacctgagcagtttgcaaaatagggcggacatcatctgaaatgaggacagctatgagcaaggcctattttgaaggggtggaattatcaggagtttaattttgtacgtgagaccaaatttggagatatctgttagacagcaaagtgaaggtattgagtaggcagtctgatataaaagtaaggaatgtggaaaagaagtctaagtggagatataaatttggctgttctaagcatagagatgctgttgtaaagcggaagactggataagattaccaagggaatgccaatagagtttttagaaacagaagagtcaaggattgagccccaaggccctccagtattaggagatcaagaaaaggagcaaagagcaaggaagactaagaagtaaccagcgaggtaggaggaaaacttggtatcctacaatccaagagagaataatgaatcaaagggaaaggagtgatctcctgtctcaaatactgcaaataggtcaagtacaatggagatggggccaggtagaatggtcaagtattgaacattggatttagcaatgtagaggtcatggatgaccttgaccagagaaattattatttcactatatggtaggaacaaccgtggacttgaatgggtttaagagagaacgaggaaaaaaaatagagtcagcaagtcagtataaataatgctgacagagttttgctgcaaacggtagcgaataaataggccagaggctgctagaggaagtagggtcgaggttttataagatagattttgaagataataaaaatatcagactgcttatatgctaaaggaatgactcagtagagagggggaagatggggatgatgatgctggagagaaaggagagagtgctgggccaatgtctttaagtagcctagagggaaggggacctagtgcatatgtggagggtttggcttcagagaggatagtttatctacagtaaaaggggagaaagcagagtatggggacagaggctgataggtgggaagatgtattggatggagtctacaaaagttgttttctgattgcttaaattttctcagataaagaggaagcaaggccattaatctgagagcaaggtagggtaagaggttggggagaaggtccatagttcagggaccacagaagtgtgatgactgctcagccctagggaccctcttgaggttcatggtcatgaactgaagtgagacctctcaacaagactatgtgtgctggcaaggcacagtggctcacgcctgtaatcccagcactttgggaggccaaggcgggcagatcacctgaggtcaggagttcaagaccagcctggccaacgtggtgacaccccatctccaccaaaaattagccaagcgtggtggcaggcacctgtaatcctagctactcaggaggctgaggcagaagaatcacttgaacccaggaggcagaggttgcagtgagccgagatcgtgccattgtactccagcctgggtgatagagccagactccgtctcaaaaaaaaaaaacaaaaaaaacaggactacatgtgcttttccagccatgttcagacattcaggtaaagacacagaataggaggggagttggatttcaacaatgttctgcttttgacggtgagtactggacggaagaatgggaaaagacccttactggcttactggtatacacaagggaatgattctaacaagtaaccatggaattttaactaggcaagagagagggagaggccattgagggagtgaaagataacaaatttgtaccatcaatggattagggtttaggggttcaaggtactcaaagagtgaattagaatgatgtggaatggtggtccaaagttggaacgcatgaaattgagattatggatgggcagcaaatatttttactgacaaagtgtcaggtgtaactatgaaaataagaggtaagttcattcgagaatagtggttaaggaatgagaggcatgagacatgcaaatatttcattgaatgaaaagttctagtatattaattttaaaaatgaaaattttgtaattcaaaaggaacagagggaaattgatgtgtattgcctgtttatgtcctttacccatttttctatcagttatttttttctttttgatgatggctatgctccatacgttaaagacattacttctatctcatgtgttggagttttcatcctagttgatctttgcctttcatttttacgtttaatcttattgtaaatataaccttaatgtagtcaaatctaacactatatttctttatgatttcttgttttggttttatgcacaaaatgacttctacttttattttcaaccaaaatcagaatgtcactaatatattctttgagctcttttataatgtatattattttatttttatataaatctatgtggaattcatatgggatataatgtaaagagaagaagcaaacttttttcaatgaaattatccaattattagaactgtttgttaaataaaatcctattataaatgccggtctgtttctgatatttctgttatagtattttgatatgctgcttaatcttatgccaatattccattatagctttatttattatatgtttaaatgttggtattactagtatctctttattattattcttttaatttttttatcctctcagttattatcccaagtaaactttagtatcatttgatcacactgcaattttgtaagaattgcattaaatttataaattagtttagttagcaatgacacctttacaacattgtcttgctctccaagaacagagcatatctcgtcattcattaaatcaagccttttatgtccctgagtaaagttttttaaattcagtttctgcccccaaaaattgccattttattatcccatatatatagtcgttagtatttttagcattgtcagctttatctaaaatatcacattggctcttaaaaaggagttgagtcactctgttgttcagagcaattcaagggatcttctaattggccaaatgagaactacaaatcattagttgtagatcattttattctaactctatatccaatgagacaaggataggaaaagctttttggaagacactcaaagtgcttaatcttttaagcaagagtaatgatcttttgaacatgtagaataaaaatattgactaatttaactataagtatgtaaggggacattaaaataggtcacagaaatgattatgcttgctttcattaaaactattatttactttagttttatggaaaataaaaaagctgtaacgagttcagttgtcaattagctactcagtttgctatttttccatctacacactagcttcaccccatctaatatcaataacacttatcagatccaaaggaaagctttaccaaatccaaattattatttgagaattaatttcataactaaagacttcattgatgtcattaaagtagcaatgtttttaaatcccaacagggagatcgaggcccagcaggtcccccaggaatagcagggatgtcggtgagttcagattacttcacatcattttcacaggtaaacggttctatctccatgatacacctgtggccagggatcaagacaggcaggagagcataccataactcccatggcattaggttcctgacaattctagtttcataaataatgccacctgtattttccacctccacaatcctctatttcttttgttttgttttgttttttgtcctcttttattttcttcccaagtcactttcatggaggggagaggaaacacagttactatacattaatttatgagcacagctttggaaagtttattgtgtttctctattcttgtcatatttcaaggtttctcagtcttcaaaagacagagttcttatcctcaggcatgtacttcaagttccttgtattaatgcaatctgcctgagttattccttagcccagtgttattagcagagctttattgctgctaatgtttcctcataaactagcccttcaatcctctcaatcatttttgttgctctctggtgtcaaatgttttaatctcatcaaggccttttcaaatgaataggaagtgttccaggaaaggttgaaattatttctctgagccctagagatcattctgatcttcattcatgatgctctaattaaaattttgtggtcacgctttatgaataagaggccatttatcctcttgctaggtgctcctgcagggcaggtccaggataacattacaggaaagtcaatggaaaccatgggcttgtatcacaagaatataagaaagataagataagataaaggccctacaatcaccacccacagtcacccaccgagatctactgacacccaacaccacccaaagccctgctcatctcccactgccatcccacaaagtgctcagagccactctacttcactccattaacttctaacaacacaaaatagagccccatccatcatctgcatccttcgtagatgatgacattcccttacttagccattatagatcaagtcaaatattcgtatgactgtaaaagtagcatgaaaatatcttctttggaaagctcttccaaattttttataaaaggaagtattcttgaaagttgactacacacttaattctattccctcactactgccccactcacagccattcccagcaacatatttggaaatcagtttctggaagtgtccttagagaacctttacaacctgttcctcttatactcacatcctgtgatttgaatttttgtttccttgtgataaaataaagtctagtttttttcattgtgttcacccaggtgtgtctacaaattacattttgctattaccctaaattaagcttatcttctaggaaaaaatactggccaccattgcaagtatttaaaagatgtgcaacagtggccacaggcaatccaaatgagaaattccaaatatgtttttcaaagaggaagcattattgagataaggggctagcctgccacttagttggatgtctaagatctgatatatttactaaaaaagcagttttcatatgtcataattaaaaacattaactggctaggcatagtggactcacacatgtaatcccagcactctgggaggccaagatgggcagaacacttgagcccaggagttagagaccaacctgggaaacatggcaaaactcttgtctctgcaaaaagtgcaaaaattagctgggcacctttagtcccaactgcttggaggctgaggtgggaggatcacttgagcatgggaggcaaaggttgcagtgagctgagatcgtgtcactgcactccaaactgggcaacagagcaagaccctgtctcaaaaaataaaataaaataaaagcactgactgacaattacataaataagaaagggtaaaaaatttacatactacaaacatgttcagttaaagatgcatgttagatttttataactggcccttctgcggctcagaagataaaatagttaaaagaatctagaaatagacaatggtgatggctagatgacagtgtgaatgcacttagtgccacttaagtgtgcacttaaaaatggtttagagggtaaactttaggttatgtatattttaccatgataaaaattttttttcgaaaaatggtgattgttctagttgaagcagggctggggcctgcccacacagagacactggtaactcagctgattaccaaggggacccaatcctgctcttcctagaacggaccggtctatccctttcctgtatattcagggctaaccagggatttcccctagagcttctttctttgccttactctgaggaaagcgtgtgggtttacaggaagaagtgcctgtgagtgctggtcgtggggtggggcctccggtcagcatgctctcccccggatgctctgagttctccactggtcctacctgaccttaggaatgacttccatcaatgtcccttatctctttgtctcagatctcaaggcccgagccctctatacccgccatgtcccacaataagacccttcaggtcattggccttctcagctctaacacatcttcccactcaggcccctaacaacttcagcacaggcaagctgtggggacccagggatgctctctctaacttctgcctgcctagctttgccattcagcaccgtatctctacctatggagggatctccttccggaattctaagcagcaagttgaaaaaagcccatttcttttcatatttctccaaaacctacttggctttttcaggtctcagccccaccacacctacatcccacgtcgtctatctttcccagccacattagaccaagggacaggaggtggttccttctcagaggcaaccaagccttgcctgcacactcaggccttgtgtgcttccagtctccactggaccgtctgcccctctcgtccctcgctgtggtctgtctgctccaggatcggtcatccaagccatggtgtagtgacacaaacttatctgtttcttttcctgtcaacaaaacatggcttttcaaatcaaacatgattttttcaggttgtcatactatgaacttaaaagccctcttgtgaatctcaaagcctagaaaaaaacttatttgatgctttgtgcccatttctccactcccaaagtaaagaagagctgccaggaaaataagcacaagagggatgtccaataatgatgatactttgggctaatattttcaaaaatattctcctctcctactctccaccatccacacaaatatatattcgaagaactgcaccccagtctgaaacttatggcctgcggagttgactatatgttccccagtctctgtccccttagaaatgccactttatttatttatttatttatttattgagatggagtctcactccgtcacccaggctggagtgaaatgtcatgatctcagctcactgcaacctccgcctcctgggttcaagtgattctcctgcctcgggctcccgagtagctgggattacaggcacgtcccaccatgcctgggtaatttttgtattatttttagtagagacagggtttcgccacgttggccaggctagtcttgaactcctgacctcaagtgatccatccacctcagcgtcccaaagtgctgggattccagacatgagccaccacacctggccagaaatgccactggagagcatcacccttgggagcactataaactcaattggggttgggggaagagaagcatatggtgtcgttcagcaatttggctcctaacatttctcttcaatttgccttgccagggaaaacctggtgccccagggcctccaggagttccaggggaaccggtgagttggcagttactttcatgacagttgtacttgtgttgtacttgcatgcagttttaaaacatttgttggcaattaatttgtgtctgtggatgtgtttatagggtgagagaggacctgttggagatataggtttccctggaccagaaggaccctcaggaaagccagtaagtacttcttactacttaaaatatgccacctagagaaatgctctaacattatctcctcatctaccacctcagaaattctgagatttgaataagcagtttccaaggagtaagaagaatgcacagatggatttttgatggcaagggcaggagttcttattgagttccctagatctgtgtgtggtatctttatgtcttaaacagtgttgaaaatggtgagagttttaagtgtcaggaaatctgactcatcatttcttaagcctaatgttctcaacagacttaaagaaaatataatggcctgtcatgtcctaaagtataaagaaaccaaagacttatagatataatacctgtatgttaaaccaaatcctaaagtagaagttattttctcaaatttcctcctttgtatacaggccttgttttcttacactttcataaatcactactggtgaatgtctcatccccttgtgtcctaaaagagctcttggttactgatctgtggtattgatgtgacattgtaacaatcattctgactaatccagttccacataaattcatctagtcactgctgtttgctaagaatgtgctgggcccttagggaggggatctaagatgaataagacagatctcactctcagagttatcctttacagaaggtcactgctgatttgtttgctgtggtgtgtatgggaaagaagtcgaggtgaacaaacagtgcaaaattcaggaagccagtttggcacctctgtgaaaccttcagggttggtggccaccatttcctcagagaagacatgaaaaaaatgtaatttagagtcaggaagatctgggtctgaattatggttgaaaggattttatgagtcacttaagtgccatgacatatggaaagcatttccagtgcctggctatgggaggtactcaataatattagtttcattccctgcctcctcttacctcctcattcccatcccctgcaaggcatatcattaaagcctgccactgagttcccaggagattatgcaaaaagcaatttgttcatcaccaaatatttcttgagcacctcctacatgctaggcactgttctaggtggtaacaactcatagcttttgcattctaatataggaaaacagataaaaacaacacacacacacacacacacacacagagtttcaagtagaagaaggtataagtagagtaaagctctggaatattattcaaatagtgggctcagagaaaatttgcctgcaatttgagcagaaacctgcataaagtgagaagtcaagccatgggaaggtcagaggaccattgtttcaggaaaaagaaatggctaagagagaagtgagcccgatggggtccaggacctcatcaaaaggcatgaagtcaagaatgaacgaagtgaaggaagagttggaaagatacggagggagatgtaggcagtggccagaccatgaagaacttccaagccagggaatgaagtttggatttcatttgaaatatgatggaaatccactggagcttttgtagcaaataatgaaaatgattgaacattttgaggatcactctgatattgtgtggagagtaggctgtagggagtggggtagaggaagacagaacagtaagaaaacatcaccatcatctccacgagaagtaatgacagtggaaacagccatgagtagaggaacttaggatgtacattgaagagagagccagcaagcaacaaaacttgctgatggactaatctagagaagtgtgagggaaagagaccaatcacagctgtggtgtagggtctgagcaactatgtgagagtgctgctgtttggtgaaatggggcagactgaaggtaggtggatttgggagggagagccaagagttctgtttgacatgttcatgatggagcactagcaggtattcaggtggagatgtcaagtacacagtggagacttaggagaggccaagattggtgagaccaattagggtatctaaacctgagcctggaaaagtggagtcactgtggataggaagggaagagagtgcttcaactgttaggaagacaacccaacaaagaaggctgtgaaactgcagccagagagacaggaagaaaatcgggcaagtgaggtttccttgatgtcaagtgaactgttttaagagaaaggagaaagcagtaaggagtgatcaacatacaggtaagtaatatgaggggtaataattctctactgcatcagaaacgtagaggtcattggtgggagagatcaccacatgttagtatcttggtaagaatgatccagttgagagaggaaaatttgatgacacaggagagtgaagactactttgagtagaactggtatactcacaagtgggaattggtcttaactaggaacaggggcagttcacccttcctaactgtggagtgtgggggtgccaaagttggggtgcaaatccatgaagattgacgcaactggtggagggatggtgagaggggtctcttttgtttgttagtgaaagaagaatggaggttgtccaagtgtgaggagtggggaggtgatgctgaagtttggaagagacaggaaaatgtgtgaaagagtacttttggagagatagaaagggagtcaaattgggaaatacagagggatggcctggtaatgctgagggtgctgcttgcaatctgctgttgaacatttgggttggaacaagcgagcaaagatacgtggttttcttcagccaatcagctgctcagatgcagatgtgaggtaggcagaatgtacccaggaaaggggctctgccaggtgaatgagatgagggtagagaggagcaaatacatatgagttattgtaaaaatctctgaaagcagggctgccctgtggatagaaagtaacaccttcctatacaaaagagaacactgatgatagtctttgataaattactggagataaaaaacaggttatagggttacgtattttcttatattgttaccaaaaacatgaactacacttttactctagatttatcttctcttattcaagtgacacagctgtttctttcacatcctctcctaatcagctttatccttgttccttgtgtgtctgaatgtaataaattctttgaaccatacacttcaggtaacatgttcttatttaacgtactctcaataattcccaggatgtttcagaaaggttggcgaactatggttgggttgtcaactgtgacagatttcagcataatttatagcagtgaaaacacgcagttctttgcagttccatcccacagaatccattccagcacaataaaagtcccttgggcttttagaggagcaagtccatgcaattgcctgctggctaagaaatcatattcctcaccttgatcttcctcttcaaatcagatctctaaaacacacttgctgttgggccctgggtatttgatttgacctcgaatacttttccttcttatatctcccagccaatagttctctcagtcttataaatctttaagcaggactaggcttcgttatcacttctagaactcccttttaaagttcaagaaacttccagttttctaataaaaagtgactaatactgtcaaaaaccatgattatacatttcttgcttttctttcatatttccaactgaaaaataacaattgttctctgactgacactttatttcatagtaggatcatgctctggccatgttatgaaatttccccagcagcaactgagaccatttactgagaatgatactctgtgctggaaaacctgttagaaggtaacaaaaatgccatactccagccacctatgccatgaggcaccttcttatttctcaggatgacctaatagaagaataagaaaggaaaataatctttgttgactatttatagaggaccatgcatttttcatgttatttcacttaattcttagttttgaggttatttattttcctcactagtgaagagattgatgctattgaggttaagtaaattgcccaaaaaggttaatgggactagtaagtgacagtgtcagaatccgaactcaggactgtcagattctatttatttgttttccattttaccacctttctttaccaagctctcagtagaaatatgattaaggaactgtcctcgaaaccttatgcttttgttgtgtttaactatgttaatgcagagttagaaatattaatcctttttttctttatagggaataaatggaaaagatggaataccaggtgctcaggtatgggaaatatgatttaaaataaaagttataatgcatactgcatccagaatacctaccaacatttacatcaatcagactgatgaaaaatcttggcaaggagtgattttcatgttgacatctgtttttcagggcatcatgggtaagcctggagacagaggccccaaaggagaacgtgtatgtatattactattgtgattgttattcaagtctgtctgttacaactgtcccatcatttgagttacacaattatgtgtgtagacccctgcaaatcaccaaatctataaaggctagggtgtaggcgatcaaagatctctaccagacattaaatatgacaacggactcagagcaagttatatggtacatctatgtagttggcctttgtacacagccaagtatactttgctatttaaatttgggaagcttttattatcctcctgtctcagacatatatctctactataaccatcacccatgttctttttatctagagtaaggtttctcaacctcagcactgtgattattcaggggcagataattgttgtggttggctgtttgggaattgtaaaatgcttagcagcatctctggccttcatccactagatgcagtagcgccaccatccctccaattgtgacaaccaaaagtgtctccagacatcaccaaatgtctcctgggaagcaaaatcactgcaattgagaactactgacatgcagaaaaactaagtagagtaaagaaggtggtgtgaggggttagagaaatggaaagtgtaactgaaagtatagtgaagttactagtaatgccaattatgttatatggttttgtgttgtttggagcgttaatgtcattattgcaatttctctttatttcctttaatgaacctcaacattttctagtagaattgatttctactagaattaacttctactagaattaatttccactagaattaatagaattaatttctagtagagtcatgccactgcaagaagttactcaaacattgttactcagtgtaattctattaagggttgctattgtatgtgagtgtgggcacatatgtttgtatactggtgtctagttcgctaacttttatttatcattatacaagtaatctataataactgaaggaaatgtgaaaatacagatgatgtaaatttaaaaggaaataaatctaccttaccccactacacagagataagcactgtgatatttgtacgtatttccatctctctcactctaatacataatatacacatatatttatatgtattaatataaacatatacttttccaaaaaggagcttatgctgtcttgtaagtgtcttttttcacctaacgatatatattgatcttttcttgtctgtaaatatagatctatatctaccttttaattgctatatgttattctactatttgaccataccttatttcacttacctagtccgctggacatttggattccttctagttgtcataataataaacatcactacaatgaacatctttgtacctaacttataaaataattttaatatgttaaagattgcatttatcttgcacatgatcagagtattaatcattgatcaaagtgtgctaatattttttcttgtcatctcagaaatttctccaaatgtgagctggagtgacagacctgtatgcagatatatttttataactaagacagtagcattgataccaggcctaagtgcttttatttctttctacatggcttatttccatatctgattctatgatcacacaaatctctgtaactgttcatttatttctgttaatttttaagtcaagagaaattgagtttgcccttctgcagagtagtcatagttaaaagaataatataatgagatacaggaccacttcaagcatcattccgtcatatttggtgtgaggatcacttcctggagttatgcaactgaatatttgaaaatttatgactgaagcaactgccatgatctctctctctctctctctctcattctctcttgcacaaacacatacagtagtagacacattccaggataaaaaacagcatcaagcaaacttcatatcacatttaggcacatctaatataatattttactaattaattatgacatcttattcaactgattcttgtttttttgttttgttttgttttgagacagagtttctctcttgttgcccaggctagagtgcaatggtgtgatctcaactcaccgcaacctccgcctcccgggttcaagcgattctcctgcctcagcctcctgagtagctgggattacaggcatgtgccaccacgcctggctaatttttttgtatttttagtagagacagggtttctccatgttggtcaggctggtctcgaactcctgacctcaggtgatctgcccacctcggcctcccaaagtgctgtgattacaggcgtgagccaccgcgcctggcccaactgattcttccatagttcatttatactattgagtaaatgatgtcagtgacatcctccccccagtcacctgctttgatcttttcaatggttctcccttctcaccatcccgtgggtatatatttagggcacagtgatcacactcaacgtgcacacacacaaacatgcacacacatgcatacacgtgtaaagcacaaatacagaaaacaaacctgaagagtctaataaagcacaaacaaacaggggaaatccaggggtggggagagcacatgatttaggagagattttgaatgtcctgaagtttttttaagtgaaaagtctcagtaatgagatcctcttggcaatcttcctttatcattgcaaaggagacccagacctcaagtgacagctggtattgactcaaaactgccatcatcctagatgggcaaccaagcacacctaacattctctctatcttttatgtattaagtactgccaaggtgccaggcattgctctgagcactttacttgggttaattcatttagttctgaaaatcgccctatctaatggatactattaatatgcccactttgtaggagaggaggctaggacacagagagtttaagttatttatacaaggcccaacagctaataagtgccagtatgaatccagaacttttgctctcaactacagctgatgctagaagagattattctttgttattattttttccttaacagggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggtaagtagtgctaagacgctttagggctcctggcttgtaccgaccatgtatcccttttacaatgaaagcaatgatactgcctttcaaataaataaaacaaacctaaactggtccccgtgagggcaataatagctgtcatttaaagttatgtgccagatcctctactaagcacttactatacattacctcatttgatcttcacaatcattctggaaggattggtgtccttttcagcccagttttataaacgcataaaatgagcattaacttgcccaaggtcacagatttattaagtgggtcagacccaggtctggatggcttcaaacccacgcttttaacatacaggtactgtctctaatgtctccttacactacacagaaaccacatatgcctgtttcatattgctatgaaacatgtccatttcatactctattttgttgaatatcagaacaacaaatctgccatgagtagtgccttgaagtagaaaccacttaggccaagagtgtttagtaaaggaagcccatatctttattaatcctcaagaggagtggtgagtggctattctgcagagaaatttaatctgaaaatatccatgttaggaagaaaggagggtcttgaagtgaagtagggcagttaaagacacattctcctcagataatcaaccaataccagatataaagcaaaactgagcattcatgcaattttcatacttctatatttctgcccactgtcctgaaactctacttgaataaagcctgtgtaacttcactcttggggttgtgtcagtaattggtattagttgcattaattaaagttcattaatgaaatagagcattcttggaattattctgtcctaccggaatcatcactttataagcccatcatattggattttttttatttttattttttgtcattctaagtcagtttgttgttacaaatgaactagcaccattatgttaggaaaccccacaacaatactattatcacatatctacacacagacaggatagaggaattttcagtgaagagcgatgaggaacctacccaagaatgtttataataaattaaggctcactatctaagtaggctctgcttcattcttaaattcacattgcatggtgattttccgtagagcttccaactctctcatctgaccatcttctgttatggtctttgttcatgtttatatctcagagtggggcttattgcctttgtcacaaccgccaatcttcatcatattgtctttaatgccacacatatacccctggataataatcaccaactataaagagtaataaaatactttgaaattctaaccatcaagaaaaaaataatagctcctttaaaaatatcaaggcactataataaaacattactgttataaatgttaaattctttgtcaaatgcatgtggatttacttgtcaacaggtggaaaattcagctgacattatttgcctgcttccttttaccagatcccaattaagaaaagaaaattacttaatacctatatacttgcaatgtgtaaattacagaataaactttatgatgaaatgggtaaaacttgcttttatcccatgaatacaacattttttaaaataatccagcatacttggagttctgttccaggttgtcttcctttgaaaatacattatatcaattagatattgactttgccatccagggattggttaaaagttaaattgtgattaggctactaacatcatgtttatactttttagattatttaaccttataaaatgaagtcataggaatgtcttccctaactgtataaagccatgtgtctccatttaatgggaaacctgttgataccactggttatgatcccagcccatagcttttaaagcaattacacacttcaacttcttcccagaatttggtcaaagcaacagatatttattgcccaatataatcaattgccaaaagcatttttcttgataaatgcatccctacagaagtttcaaataggcaagccaacccaatatttctattctttattcatttgtgctatgctctattttaacaacctttttttttccttcttcaggctgatgcagtttcatttgaagaaataaagaagtatattaatcaagaggtcctaaggatttttgaaggttagattttcttaataacattttcgaatttttcactgattcccacctcccacctactatggggaatccctccagcaacattctcgaaagatggccatgccacaaaaaccttaaggggcagcccattttatgatgggacagctctttgatgaaaattcttctttatacaaagttaacttttgcctccctggaacttcctttcattatacctggtctgtaaaacaacacaggtaaagtacctgcttgtactcacatgacagccctttgagtatttttcaatatccctcatactcctccttagttttctcttttatggagtaaatgtgtctagctcctccactattatcacccctgggaaatgtttaatttataaatgactctcatttaccaaggaatattttgaccaatgcagagtagtgtctttttatttagaccaaagtcagcaaactgtaccccctagccaaagctattgccacctgctttgtacagcctacaaactgagaatggtttttgctttttggtagggagcagtgggagtgagttatatttttaaacggtttttaaaaatcaaaagatatttcatgatatgtgaaaattatctgaaatttgaatttgtttccataaataaagtatgcacattccttcgcctcttttctctggctgttatcccactacagcaacaggactgagcaattgtgacaatatggtacataaaggcttaaatattttctatctggcccttgcagagaaagttctgacccctgctctagatacttcaataattcatcctaagatgtattgctttttggaaaaaagcatccatattattctgttgattcattacgagttttcagttaactaacagccctggatcttccttataaaaatatttttaaatgaggtgtttctcattatggactgtgtgtttattttttgaatctaagtgtgtgatcttatgtttcctcttattaatttcaaatcatttgtgttcatatcttgttccaacctgaagatgtcttttgaaatgttgtctcttgaagagcaggttggctgaccctataactttgtgtcatgctaaatttcataagcatgtcatcattctagctgttgatagaaatgttgactaaaaaagccaagagtcaaggattaggtctttccaaatgccatgggattctttctgtccacttgtaaatcatcttctaatctattgtttagtgagctctgaatccatttcattgtcctaaaactcaccctacatttctttgtctatttgcaaggaattgacagtatcacatgattttgacaaatggtttgctaaaatcaagattactcttctgaactgtaagatttaacaaatgaatccatgttggttctcatggttcctacttcctttgcttagcatccataagccaaaaatagattgttgaatttttttaaggaataagattataagatgccccaagtcgatcttgactccattgcttcaaacacggactcaggtcttctccaaggagtcttgattattttaaataataattagcagtagagactgaaatcttggtgcttggatgcacgttatcttactttatatgagaactagaaatacagtagagtaacactgggacttgtagctactttaatgacaaaacagaaaaaaatggggttttttgttgttgttgtttggttggttggttggtttctgaggagtctcatctgtcacccaggctggagtgcaatgacgcgatctcagcccacagcaacctctgcctcctgggttcaagcgattctcctgcctcagcctccagagtagctgggattacaggcacccaccaccaaacccagctaatttttgtatttttagtagagacggggtttcaccatgttggcaaaaaatgtttttttaaaggtcgtgaatttatgctgttgattttaatttaccttgatcttcactaagtatctttatcttgctctgatatgacagtttactaatacatttgtccactcttttgttgagctaccagtaattttaatgttgcccttaaattttgaggtcttttctttcattctctttcattctttcttcttctttctttctttatttctctctctctctttctttctttgttttttttgacccttgaatcaaacattgtggactagactctaaactttgctttccaaacactcatttccccgtcaggaagtttgaaaaaaaggcaactgtttgaaaaaagacatctcaagctcttcaggggaatactgaagaatatacccatggctacataatttgcggtgttcagtgcacagtgaaaatgctggcacacttgttaaaaaatgattaagaattttaagacagcaatagtaaagccgtaaactaaacatggggccctatgtgactgcataggtagcccggacatgctagtcctggggacaggacatctagaatctcagatagtatccatgcatttagttgacctcaaccatgaaaagagaaatgccagcgtatgtgtatttttgaattgcaatctaaagttttcctttaactcttaatccctatgggctgtagtgtctttatttatcttttatctaagagagctttaatactgaacttcagtctcttaagaggctttagataaaatcatatatttaatagtcagtaattaacccatctttttggaagctgattaagaatgtcagaaaatataaccaagcattttcagaaaaaaaaaaaagtgacatgttgagatatagaaggtgttcgttttacaagtccatcagacactggatgaaggtgtggcccctggcagcctgccctgtgcattcagcaaaagagacacttctactccctcctggggaaggctccgtcctgcccactcccaggccattctgtggctactctcatgaagggctatcagtcttcagaggaggcaggtcaggggagttgggccactctccatctgtgttggggcaggctcaccagacttctgctttctgagaagctcctcctctgggtctggatccttcctctctgagttcctgcccctccttcctctgtcacagcccacctgcctggaagctgacaggtgcagagtcctccccaggtctctggcttcacacccatctctcttactgcgtctctgtctcttccagcctggccaggtccaggtgagtggctggacccccaccagagccagtactccctcagaaaccacaggtgtcttagccttaagacaatattttaaagcgacccataaggaaactattttctgagacttctaaactctaagactccatgtgtgatagccctttccttttgtctctcttgacactagtccagcaaaactgtcttctcccaaacaaaactgtgcctgaaacccagaatttagttatttagcatttaagttaatttgtcccaagatcatttcaattcactccatttaattttccacttagaaatcactttttccatggcttctgaacaccatttacaaaaaagaaaaaagaaaactccattttcacaaatcataaagctccaaggtcacaattaccattttcggaaagttttttctctaaaagcaaagattaattttcacatgttaaaacagttacagttaagtagtacagacagctaactgctacagttaagtagcacccgtctccttctctttttcttagtggtttcacaagagacagtgtcaataacagctaatgctatctctgctgcacgcatccctgcacatctgcagcctcgagagccattgtctccgagcggcaagtcgcagactgtcagcagggactcgaaggagtccttggaagatcctgctctccaactttatcatcccaagtgtccagattacaccctctagtgaaaccctagaccaggatgacccaaactttgggctctcctcttgtggctttttaacccctttggggcttcccaggtgacccacctggtgatacaataccctacaaatctcaaaccttgatctattttccaggccacctaacctcccttcaacatcctggtgccccttcccaaacctaactgtggtggaaagaggtgtcttttcaccaatcccaagtctaggttccagattgatcactatgcacaaatatatatcctctctgaagttcaattaaattcccaatttgattgtccaacaagtcaagtccttttgctagtaaagtgaccacacaggacaaggacagatgccatccatgtgtctcagcttagcatttggctttagaagggcttcccagctgccagtgatgctgcccacgcaaatgaggctcttgccagatctgagaagtttaattcttgctattacactgtcctattatgcttgggaatttacatcaacatgcaggaagaatttaccaacctttgcagaaatgtgtactaacatctggctctctaagttcttgagtcaaacatgggaccaataagcccacacctccagctgtgggagaaaagaaagatttgggctaagtattcccgaacaatgtttctgcctccagatttccagtgttcagaaaatccccttacctatgttttctcgatatgcatttcatacatatatttcatatatatatatgcatatatatatgaatgtgtgtaaatatgtatgatcctattttcttatcccaaagttgtaacatcttttcttacctctctacaactaagatattaatttttatgtatgtgtatatgtacttgttatatacacttcatctgataaatatacatcattgatgatatatatatatatatatatatatataaagagttaaaaaatatattttccaccacatagtctctgtttcttccaatttgcttctttctgtttttttggttgcaactctgttgttcagtttgtaggatttcctcagtgtccagtaatccttggctgtctgcatacataagagcagggttttaaaaaccgattgaaagttgtgagcgaacagtggggcttgccaacctcgagtttcacttagggtagtccagatgggctttttaagtgagggacccttaatttcagtgtctttaagtctttactctcagtctggtcagattctccagtggagacattccatttcctgcctggctgtgagcttagctacttcagattttcagtttggaagcctgagtctcaatggagtctgggctcctccatgcagaggcagactacttacccttttaagataataataaaccctcagtcttttgctagggatggggagaggcacctgcctagctgtatagagaaaggaatttcaacaactactaaaacaggctttcaatcagtgctccttattttagttcccctctttcacccccacttccagaggtaacttgtactgccaattctgagccttctgaggattttgtagtttaggtcaagttattcctctacttctagtctaagagtttagttttcttgcatttgttaagtaatgtatcactcaaccgtctggttcttaacttccaaaattgtgctgctattgtctcctttcatatgctcccccattcttgtctgtttaggcctttaggaggattgttttgctaggattcaggaggtagttaaagcagatccatgtgtttaatccgccatctttacccatgatagttcaaagcaacatactcattaaggtggcaaatgattgagacagagacaagtgaagtagtaaccacctttgggtcataatgaaccacaaaataaatatgaatccaccaaatgatgctgttgaattaacagtgaaaaatgaaactagaatataattattaaaatatcacaggaaattactcttctgatatttttgccctttaggagagaactatatttaattttggtttccacatttaggagacatttatggaaaagccctgaaataatggaaccaaaaggagatttacaaaatagattgtgaagcctatgagtaaaagttatttaacctgaatgctaatatgtaacaatatgactgatttcccaagggaaatactcattaactgctctctgtttccataatggggtagcaaaataaaataaattgaagttataccaagaaaatggataattagacatttccatgggcattaggaggagaagaatttctgtctttgaaatatttacaaattttgtctgtgaaatagaagatagacatgggccagatgacatgtgtgtgttccttccttctctaaaatacgtagtttatcatcatattaatattaatgtctgtattatattaaggagcccattctccaaggaagccaagccttggtctcatttgttagagtgactgctgtggctttgccttggcagatggaaaatgtgtgtttggtttatgcatgcttatatcggaactcttcaattcctgcctcattagaaagcatagccaaaaacattttaattgactgaagatccctgaaaacagaggaaaagcaattaagaataaaggcctttacaattcatctggatgctctgaaacatattattgtaaattatagagcattagggtagggttcagaagaggtaattacccttatgctaaatgactgtttctgagtgtatttcaaagccagataatttacagctagaagtagtgaaaataattttctgttttgctaaaaatattaaaaaccaccaaagtacttctaaactcaattcatatattaaagaggaaaaattagtactgtgaatatttgtgtttcgacattgaaggtatttaaacagacatgtttcaaattaagaaaaattgtgaccggtctcagtggctcacgcctgtaatcccagcactttgagaggctgaggtgggtggatcacgaggtcaggagatcgagaccattctggctgacacggtgaaaccctgtctctactaaagatacaaaaaaaaattagccgggcatggtggtgggcgcctgtagtcccagctactcgggaggctgaggcaggagaatggcgtgaacccgggagacggaggttgcagtgagctgagatcacgccactgcactccagcctgggtgacagagtgagactctatctcaaaaaagaaaaaagaaagaaaaattgtactgaaacacatctcttctttgaggtgcagaacagcaaatattcaaactgtgattattgaatttcatatttattgtaatgccccaagttcataatttgatgtaataaagatattatatgtacattcagtatgatgatttgtaaaactaaaactatatattaattacctatttgttttatctattagttactagaataagatatagtaatatcaaccacacatcccaggtagatagtgaggtagtgatactcgagggcaggtgatttcatatcactccttgggaccagcatccattagatccctgttggcctcccattcatccttcagtctgcagccagagattctagtcctgtgcgggttgtggtatatttccattctgcatgctttgtgacatgagaatgtgaatgtaggtgattacttttcggataatgtcagctaatgctctatagctattggggcttttctcttaataattctatatgaaaaaacaattgtttttctttcttaaccagtatgggcctacattgtttttaaatgattgttttaattgaaaactcatgggaaaacagattttcctcagaagtaatttactctttatttaaaaatttacataaaataaaagatacatatctgtttaagtatgcctttgcaattcaactaaatcaactaaactgaatgaaaagactggagaacatggaagtaactctttacaagacctatatcatttgggctttgtgttttctaactgacggctatcgtttctactgcgttgttgtctgtcatttggtctttacttacaaaataaatactaatttcctcagtaaaaaaaacttttctggaagatttgtctgcaccaaacccagactaaagtttttaaattgaatatttatttcttactacacaaaagtgtctttgaaaaattgtgtgtaaattattttaaaataaaaccatttaaattactaagagatttttgaagaagttatgcaaaaagaaaaagaaaaaacaatgcgattaacttcttgtcatggcaaggatagagcctcctcaggttttctgtttgaaatctagttgttcatatattagattttttaaatgtgaggtatactaaatataaacaaaccaagcaattttaagaaagactccagtgatagattgtatttataatggccttggaatgagttaatgattttaccaaaattaatttcatatagtagtaaaatattcgatatgctttttttagttatctgttgctgcataagaaaatacctccaaactttagtggcttaaaacatttatcttacatttcacattataaatgtttattatctcacattttttatgggtcagggacttgaagtgttgcttaattgtatggatctggctcaggatctctaatgaagttgcagtcaggatgtcattcagagctgcagtcatttgaaggcttgactagggctggatgatctgcttccaagttcatgtgcgtggccactggcaggtagcatcagttcttccccacatgggcctctccacaggacttcttgggtgacctcactccatgtcaactgccttcctccaatgagtgatctaagagagaaagcaactaggaagccacgatgtcttttatgacctcatctctctagttgcccactgttaattcagcctttttcttttcactagaaatgaaaagtctagcccccattcaaaactaggagaattaaactccaactttggaagacagtgtcaaagaattcatgaatatattttaaatcaccacacatacgttcacaacattcctggaaagtgccttaaagttattatgaaatcattttttaatgtgaacctaaactctctccacatgccattaccagaggttagattccatgctagtgttctgtccactagattgttacatctcagaagcactgaaaattctcagactttctgagtgacacagctggtctgcatctatacacaaacaactttgcaatcgatattatttgtctaatcaaaaaactcagcagtcagaccagttggtaaattagatgtgcttaaattaaaaactaaatctttttgtttgtttgatttcatgtattttgaaattttttgacataaaatatttctgttctatgatatattattttttcttctatacatgaagagaggatggctgtattcctatcccagctcaagctgccagcagcaatgttggctgcccaagcttatgggagacctgggccaccagggaaggatgggttgcctgggccaccaggagaccctggaccccaaggtaagtcttcaagtgtaatattggcttattgatttttaactctctgtatttataacatgttagtcacagttaaggaaaaaagtatgtatgtatgtcctttatttatacattacatatataaatatatgcaatatataaaatggtttcatatgtaatctctttataatatttgacattctagaagtagatgtttaactattactacttcaaatttaaaaccaaatgagagttacctggtattctaaatgtattgtaaaaataatatttattataacaataacagcaataatgtgtgcttatatatcattattatctaggaatcttagaattttttaggcttccccttttggtgtaagttaagcaagtctccatcatctgagtgtcttaaataaactggagaaagagttttaggtgactcaacgacaaatagttatttggttctaaaatatatttttaagaaattttagaatctttctgctttgaatacagcttgtggatggtaacttgaatgttaaagaatttttcacatgatttctaaagttcttaaaacccaacttatattggcaaagaattttgttccacttatgacaacttgacgagagacataatcttaagtatagcttaactaaattaatctgacaaggccatttgctagaaatatgattagcaatccagcaaagtggccaaataggcccaggcttagaagagtcaacaactctgaaagggaaatattaaattcagtgaatatatatcatgaaagataagaccaggaaaactgcttcttattgttaaccatggaggatctcaggttccttccttgaaataatcaaaagcaacttgtataaagaaagaaaagtggaaattaacactaaaattaaataagaatgcagtccaaaataatatatatgcaaagaagtgtttttctgtcaccagtttccttcctactgctattctgtaatattgagcctcattttctgaagtgtcccaaggtgactgatgtgcccttcctcttctgaaagagcaacatctgttcagttcccaatagcagtgcctgttagtatatatatcttaatataaccttataacctatgaccatgattgccaagtctttgcgtttaattagcacaatataaaacaggaacagttaaaatctctctagttttttttaaacgatacatatattccaccattatctttagattatagtgaagtttggcagattgatgaaggaaagagaaaagtataggatgagaagtagccctctatgtatacactattgtgtagagggggctaattattatctttcgctggttgggtctattctgaagtcagagtatatgagactggcatgcagatctcaaaagcttatctgaaaatgtgtaatgcctcaagccacgtgaagaataagcagcgttaacaccaataggaagaaaactttggatagatccttcaaacagtggtggtttgagaagacaagaacaatggaaaattgagatgatcaaggaaaacagctctggaactggggtctcctgttccactcaaacacctggcttcagacacctcacaggtgctgcgaaggcccatttggaaggctgtcagtcagaggcaattctaaacccacagtgtcagtgaagcttttggaaacaagccttctgttcaccactccacttgcccttccttttgcaaaggatttctatggatttcatctgctcttgtgcctcaaagatattatagactacttctactcctgatagggcttctggatgcaattcttaaacttggaagatatccccacatgatttccagtttttttgtgaaccaaggtttactaaaattgtcaaaacttttgtctccccattgggtttctgacaacagacatatcttgactacaacttagtatatgtctccttaacctttacataatactttcttttcagtatttgttaaatttgcctaaaatttagcaaaaaataaataaaaattgcaaaacatagaattcatttttaaggaatatgtgtttcttaaaaatatttgtttttaaggaatatcagtacagtaggcatgctgtactgataatcctgcctaaaggcacagagaaatctcactgaaaagaaagaaaatgagaggctgctgtttaatttttggtgcctctagagaagtgcacaggaaattgaagtgtttttctctagtacataaataggtgtgacatgctcagaagatgaagttatacatgtaacttataagctttgctctgctcaatttaagtgtttttttccaaaaaggaaagaaaaaaatgcatttaaaatcaccagtgaccacgcaaacctcggatgctgttgtctgaattagtcctcttaatgacacagcatgactgagtttaagaaagggttgaagtcagaaatgcaacataggttgggaagaaaagatggcttctgaatgtgacacagtgtgttctgccactcattcatcctgtctgatggtggctcctctgaaatttctagatgagacattttgttttgttttgttttgttttcagtgtttgtcaggaaagaaatccatttggttctgaaatacatttttaagaaattttagaacctttctgctaatagagcttgtggatggtaacttttgaactttaaataatttttcttatgttttctaaagtttttaaaaccaaaagttgcttatattggcaaaaaactttgttccacttaggacaatttgacgatatatatcatcttaaatattgcttaactaaattaatctgaaatgtaaaattaaaattaaatggttggtttgaaatgtgcactatggaatgagtcctttattatctttaggaaaggacaaaagtataaaggggtttcataaggtttcctgtgcttattctgagaagccggagacgtatagaaagcagtgagaaaatcgacgtcagactgtgagaggtacacaattcatattgaaaaaaggaagagccgctcctaccaagattctgatcatgaaagcttgaggatccgccttcagcaccctgaccttcttaaagtgaaaagaaagaccttttggattctgagttgcatcacttcatttgcagtttttctaatgtttccaaaggggtgattgtcgatgtcttttttaaattgaaaacatttccagacagcttttagattttagccgtcccatggggttctgagtattggcttcctgctgtgccttgagagaactttccttggtgtccattcccacctggggcttgcagcacagggcctcatggctggttctcccgggtatgagctaaaatgtgccacatcagaataaaagaaaccccaagaagcatgattcagctgagttcccctatataaacaggagaggcaaattttcctaacagacgttattctttcgagtgagttttatgagaaaacacttcatttaaacttcttctcaaacacagctgattctccatcacctattccacccgaggaatagataccacacctaaagccctactcatttcagaaggaaactcacatgtggggtcagtaggaaaaaacagctacatccatcgcatgcaccctgcatcagttccaaaaggacagtagtgggaatagttgttcttacttgtgcacttttaaagtaattgatcatacatactgtttgtaggaagcacttgtgatgtatagatttgacctttcaaatttagtagcattaggggcatttggatatgggaggacatgtgtgtgtgtgtcaaaatgactgaagggcactgctatcaattggtggagtagaaccagggaggctaaacaacttgtaaggcacgaggcaacccctaaccccacccccaccatgcccaccgtaaacaactatccctcctaaaatgccaatagcatccatttactggcctttttccggtatgtatacaggcgcacagatttacaactttagaagtaaatctctggagtcaaaactgaaatcttcctactggaaataaacacagtctaccacctgaaaaactacaccaagcaccaggtttcatcaatgactagtacctctagatgctttcaattaggacactgctggtgttttatttgttttcctacatgagctgcagttttatcaagctgtcatcctgtagaattttttttttttgagccggattttcactcttgttgcctaggctggagtgcaatggccataatcttggctcactgcaacctccgcctcctgggttcaagcaattctcctgcctcagcctcccaagtagctgggattacaggtgcccaccaccatgcccagctaatttttgtatttttagtagagatagggtttcaccatgttggccaggctggtcttgaactcctgacctcaggtgatccacccatcttggcctcccaaagtcctgggattgcaggtgtgagccactgtgccttgcccatcctgtagacttatcgtatatggaaatacatgtctctttgcagatagaccagcctcttccaaatttaaagacaggtccacgctgaagaggtgaaaagcttaattctataaatggggaaagctgttattgaccttgttagcattcctacaaggagttttgttatgaagtaatgataaaaaagaaaaaaaaccctacggctttagggcagccttcataatgaatgagcttgggaccttaataggaaattcaagagtagaaagtacttgtgcaattcagtcgctttatctattaataacaggtaattattaacctaatgaactgagaaatttgtacatggaaattgttacatttgacaggagaagggtaaatgttaccttatgcaaatacacgaatcacagtttcttaatttgtaataccacatgaaccgaaatgcatgcagaataatatatttctgcattatattgcaaatctgagagctgaacttaaatgaaatcgctaagttttagccaatatattcttcatttggaattgcgttacactcttgttaatcctcttattaatcaaaagttcatgtatcttcagttattattcttcctcatatttttagcctgtaatcttaagtacttactgagatagctgaggatcaactttataacttttctgtaatagtgggacctgagttaaactatcaaatatacctcaggaaataaatattattttactccagaaatgtttaagtaatggatttgggagggtggtttcaaatgaccctaagtatatacatttttttcctgctgttcacatacgttaaatgaaagtcacctatatcaaagaaatcctggaaacattttaaatttcaatatagatcaactatggttattatgtcacatgtcaaagccactgttctctctagggtctaggattgtactgaatatctttaacacaattttcaaatataaatatgtgaaggtttcctgctggtgggtgtatttctactatatacttcaaaatatttttaacatatattcttttttccactagtttcacatttatgatcaggtcttacataaaaagcaaataaatacctgtgtggtgattacattgccaatgttgttcagataataatgtgtacattgtatgacctagtcaaagtgaaaatgataacccctgctatctaaaaactgctatctaattctcaacaataatgggaaataattgatcatacatactgttcatagggagcattacattttctcctcctgccatgttctactgtaacagcacacctttatgaaaaggcacaactaaatcacagcctactgtttcctactgagatgctctcctactgatatctttgctgtgtgtccacatgagtctgcatggctgctctgtccatttaggacaaggagtgatctttaaggggctgtttaagtatgaaaaagttggaaataaaaactctatttgccatcactgtgaaactcttacagcatggaaccttttattcaaacaaagtattacatgggtgccaatatataaaatgcagataaaaatgctttatgctttttataagcagggataatgacttccagagacacaaatttctctgtactcttgtagctcagccaatagcaagcatattagatagtaagaataattttgttttaaaatatagacagatcttagacctaattcattttggttaaaatatcttaagttgatgaagtacatttgggagactgtcagtctcctctcttgtttcctagctttgctgaagctcctttggagttatacactgccatgttcaaacatggggtggatgtttaaacgttacttagagaagatataatgtttatagttgatcatttgaacacagacctgactttttagatgagttaacccacatatactcatgctcttgctatcatctattagaatcttgaattatttgttcctttcatttcctttaattcttggaataagatccgtattcctattatattatcttgttctcattttaagcaagactctttccatatacttctttcatttagcctataccttgccttcaatcagaattcctactgaagagggctcacacagcttgtcatagctatttgcaagattgatttatttaggtgtcattttcagagccaaaatctcgctatcaagagtataactagttggggctgggcatggtggctcatgcctgtaatcccagcattttgggatgccaaggcgggcagatcacctgaggtcaggagttcgagactagcctggccaacatggcaaaaccctgcctccactaaaaatacaaaaaaaatagccaggagtggtggttgagtgcttgtaattccagctactcaggaggctgaggcaggaggatcacttgaacacaggaggtggaggttgcagtgagccaagataatagtgccactgcactccagcctgagtgacagagcaggactctgtctcaaaaaaaaaaaaaaaaaaaaaagtttgactagttggaactttttatagtaattgcatgttttttaagatcctcattgccctattatacccaatctgtttgatatgtaagtttaatatgtggttaatgcaaaacagttagctaatatactatttattttaagcaaatgtatcacataattatcacagactcagaaaatggttcttctctgtgctgtgttgccatagaaccctttttgtgtgtctcttttttatatatttctcacttaggctacagaggacagaagggagaaagaggtgaacctggaattgggctgccagggagtccaggtcttcctgggacttcaggtaagtgggatattgtcttcacaacacaagcaagcctttacaaattagaaccatgcttctcccctagggtccttatatgtcaagtcgagtgatccatgttggctagagggtgggagagaggaagggccatatgtgatctgcattgtaattttttttttatgtcgttagctctgggtttgccaggctcaccaggtgccccaggcccccagggccccccaggacccagtggaagatgtaacccagaagattgcctctatcctgtgtctcatgcccatcagcgcacaggtgggaattgaacacacctgaagaagacttggttcctggtaacatttccttgccactggagctctcttaataccgtcaaaccctcatcatctgtgggttgctttttttttttttttttttttttgggagtaagccaggcattaaaagcaaccgtttgaatcctattcctatagcaattgcaaatcagcattttttgatttttcccaaattcattccatatgttttgctttacaattgctatgatttttactcagagttttatatgaaatatgcaagtaaatcttatcgttagttcttcttcaaaaggaaattgcatcttgtgacttagtagactgatgatgatatccattttgtagactcatcaacatgtggttggcctttgatttctgaattttaaagtttcagacttatcttttccttggtgtttaaatttactatcattgctaaacatctcgtcaacttttttgatatagtgcattgctcctgttgaatgttttttgactactttttataacttaagaatttttataccatctacatctatcctacttatgcagaaaaataggcaataagaacttcattttacaatttatgttttcaaaaaaaaaatgcaggaaactgttttatcagggagcccaaacacccagcatagccaactactgaaatgattttgttaattctgtataatgagctcaattcaaagcaatcaccactggcatgaataagtactgcgtgaaaagggagtatcaaattccagttttgtatgagttctgcaaaaaaagcctaatattctgtggtcccctcactcagtctctcatttggtaaacagaaagctgttttccctacaaggtgcttggtggtgaagccaccaagctgtctttggtactcttaaagcttcagtggcctagcaagatctttgggcccttgtatccattatccttatgacctcatcaccctcagactttaagacaagaagccaccatcaaaacaaaggatgggatacgtaaagaatggactcacttgtcctagaagatgaatgtgtagtgtcagcaaatgcatgttaagaaggtgaagcccaaaagctcttaaggagaattgtatttctccagaagctgcagcaagaggtacagctcaacaaaggaaaaccacaggactggatatgcaactagtgctcagaccaaagagttcacacccactctaaaaccatgtcctctgaaaagaaacaaaaatacagtgatcatcaaatgcctaaacagtctttctgttggttagctgtacattcattgaggaactgttgattggcaggcactgattctctagaacactgggcatgaggatgttgcagaaatctagatggtgggtcccacagatgtgagaacatgctgcaagagcctgccagccacagcaatcaggactcacagctcttcaaggagcagtgcagatttcaatttggctaaaacaggatgattgcttttgtctgtttactgaaaaatgagtttagaaaggctagcccactgacattggaaaaagctgtgaacagagttgtgtctgaggaatgtgcctaatttaaggcagggtttgttccaatgcatccgtgatttgaaccggttttcattatagattaatgaactgctggtcaggtactgtctacaatggctgtgcatacctataacattttaggtatttcatattgaattatgctgtatatttcaattccaagtttatttattttccaaggttattttatttattgtaagcattttgacattgattttttttttttcgttttctttcttgtgcaatacctacaatggtgctgtgttttaaacttacacaattgggacatacgtatgtgttttcttagtaaaatggtaatttatcccgaaaaagtgtacatagatctaaaatttggtgctatgtgtatatcttgagcttttaatttgttgaattttctaaacgcttacaacttatctgccactcatattaatttacttgaatttgtcataaagct

SEQ ID NO: 12009 - DNA, 76221 bp, Human
ttatttaatgtgtgcggagcctgtgagtcttcttaacgggaatgttaaaagctttttttcctgtgctgactgagacagaacacattttgctaaaacagtgcctgagttcaaacatatcctcccatctcatatacttgtacctgctttatcaaccacagcctcttgataatgccaagcttggcaaggctggcattcaaaagtgtgaaaattagagaaactggagagaaaatggagtaagaagtacagtgagagtcaagccactgttccccagaacgtgccaaaggaacgttatctgagggtagacagtgcatgtgtctgccgctttggtgagtgtggctggcagccctctctctggtactcccctggacacttctacaagcacagtcttatttaagcctcatagtaactcccattttccaaatgaagacacagaatcagataccttaagtattgtgcccaaagtacacagctgtcttgggtagaaaggaaagattacagctaaactctgagtctaatcttcttttcaaaatgactcagattgagtttctctatgaatgccgtctgtgtgtgtgcatttgaaattccatatgcattataaaatgttaatgagtagcagtgtaatacagtggctaacacttcaaattctgcctctattactttctagctgtgtgaacttgggaaagttacttaacctctctgggcaatttcctctgaaaaatgagaatattgccagccatgtatacaacatataaagatgactgaaaagaattcatatattaagtgcttagagcagtgcctgacacgtagcactcaatagctgttagcttctagtgctagtggcagtggggagtcataaataactggatgatcttggcaagtggcatattctctctgagccttagtgtcctcacttgtaaaatgagtataacagcagcactttcaccagtttgcaaaagtaacttgagatgatgttaatgactagtactgtgtctaacacagaaaaggtgcacagtcaaacttaacttttacacccagatacacctctccctattcagtgttggttgttgttgttgtggagggggtaattttcttattattcagctcatcttagatctagtgttgatttctccggaagccatgggtatagacatatatacaggcccaggtctttctacacccctggggaggtgagatttcttgctgcgatgggccctttctgggctggagtagagccgcacacactccgagcaagtaaacagtgccacaggtattgctcatggggaggaacaaccagccaacttcaggacttggtgcttccccagttccgggcccgtggctctgttcacaggaaaacctgtcgttgtgtgtgactctgatcacgagaaaacctgtagttatttggggctctgctcacaaggaaacctgtagttatttgcagacagacgctctgggatttagaccttttttttttcttctagtgtaggtgctagaattgccttcttagttggttgtttctatttaattgcttttctttcatgggtgtcctgaagaaaagcagaaaattatagtcatctggcaaaaaagactaaagagaaattagactttgtcccctttcactctctctctctctctctctctacacacacacacacacacacacacacacacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtacgtgccaggggaggagagggcacggttcccttttggggaccagtgtcaaatagcagggaaggtctgaccttgtcactgacagactcacctgcgtgtcctgcatgtggtagtgaggggctttctcatcaattcttagggctctgagaagggagctgtgggtgggctgggtgccttccccaggactccaggagacataaaacttgaaacgggagacttcgtgcaaatcctgctccggacgctgctgaagctcagatttctcccactgcctgcacagggtgctgcctgctggcgaatgtgactctcctcctgttcacccacaaggctgatttttccgtgttcctcctctggaaagagcattgctttctctcttccagcactttgtgagttagatatgtgtttgtgtgttcattccttctgaccagaaaagaaaccagcttcccatagcttggctctgtggtttcttcaacctttacaagtttgccagttaaacctcaatttagaaaactaaaaatctgtccccattttacagttccctataaattttctgcatttctcattgaaatcagaggcagctggtggcatgaatcaggctatgaagtacaccaaatggctcttaaagagatatcatacttaaaaaaaaaaaaaggattttagagttctgaaatcaagaacttcaaattctaattggttttaaactctttaacctttcttattcctcattatacttgacactccttaccagacctttcatacaagttctatcctgcaagtctgaaaacccaaccaccctagttatttttattagttaagtgttaatgctgttacacacacacacacacacacacacacacacaatgctctgcagatgtgtaagtccctaaacacatcttttactattaattttcttttcacttgggaaagtgtttttatttgtttctcttctgcaaagtaacctagcaacttttctggacctgagaccaatgagaggcttcagactatgttaactctttgaactccgattacctgtggttcagagagataaccaggtccttaaaaagtgagtgcaataattctgttcttcttaaagccatagtaattttaaacctgccattaaacatcatttttctttctccaaaaaaaagtgatttatgtcaatctacattgaatgataatctcatttatctgtcaatgatctggtctgaatcccaccctaccattcagtgccccagcccatatcaaactacttggctgagtaacaattctgtatctttgcatatgctcatccctcaacctggagcaaccttcttctttattttccacctagaagacctgattgttcaagctggcacaaatatctctttctctctcctgaccaccatattccagagtgagcatcccctcctttgtcctttgttctgtttctgtcccttgaagctgcatctcttattgtccttgtagtatccccttgtttaaatgtccacctccccttacaagtctcagcactccttaagttacatgatctatgtcttcatctttgtatggccagcacctagcataatgtctatttcctaccagccattcaatacctatttgttgaattgaattcaatttttgaatagccaagcaactacgagaaaggtgctctgctagaaaagtctccagcaggtcttgtctcacatggatacagtatttcagtgtttgcagagcactttcaagagcactgtctcatgggggtttcagattctggatgaagtaaggatttatggataagtagtgggtataaaagcagttaagcaacttgcccaaaccacactgatgatcatgaaaaggtccagattcaaatttgggtcttcgggctccaagttcaggattttttctactatattccactagactttcagccaagtgtattattctaaactgacggctcataattctgactgtacgtcggaatgatctgtgctgccttgaaacatgccagtgctcaggcctcaccccagagcaattaaaccagaacctcctgaggagggactttggcattaatatttttaaattttttacgtaaagccatgggtttttcaattatttttcacaggattaattgctttggccagatgcctgggcatgatatgggcatggacccagcttcttctgtgagctctttttattcccttcttctgttgaagttaattcaccatatggtattgagcatgatgtgacatctcttggggtatccttttcatcgtctgtcaaattagggtgctctgtaaaggatccatgcagtcccttccaactcttcaattcaaaaatggagtcttggtgtggagtgggttgaaacaaggggcgtgtacggacagtgtatggaaaagatagcaagtgccgttcatgccgcaatcatagatatatgcaggcatttttacagagtcctgctagcctgttcctacggggggcctctgaaatctcagctctatatattacttttgacatttctgcaatgtagctaaactttttgattagccggaggatagatagcaggtgttgggaactatacagccggtgcctcgtatacaagaagccaaaaacattcagagagtgtgacgaggaatgaaagctgccacttatattcttcaatttacagcccctaacgcaagcaggcaagcatatgctcaagcccattacatgaagggagatatttgtttcatatgtttgaaaccgttttgagatgcaaacaaagtagaagggaaagcttcctgggccttcctcccacgctgaccagttgcctaccacacatggcaccgggcttctgggctacacagggctgtctgctgccagtccttgacagaaccggcctcaggaggctcagtgtctcctcgatgtggtctggaaaaagcagtcatggaggaagttgacctttcggccttgcataatttgggtgtcgctattatagggaagtccggtttaggagccaaagctcattcctgactcttgctttttgggaactggcaggatggaataattataactaatgtttggctagggctggacagttaacaaaatacttccccatcctcctttacgctgatagcagtgctgtgggaagtcgttattattactacttaatggatgaggaaacaagacctcccatgacctcctaaaatggaaaggataaataaagtcaaagctggagctgaatctagctcttttgacccagggccagtgccctcccctcctcagcagggctgaacctgaactcccagccctgttaacactggttcatttcctcacttgaaaatgggatgcctgggccctgccacctggttttttgactcagctttccaactaattcacaggttaacttggacatatgccttcccttccttctgcctctgaggccctccttccacagattggtttaagaaaatattgacattggctatgggattaagacattttgttttcttaatagaatctcacatattgctattgtagggaccttgaaaaaaattaaataaatgtattttctttttattgaaaaaatagtacatggtccttcttgacaaatgtaaacattttatatgcacaaaaatggaaatacttatattcccatttcagagataactactgtcaataccttggtgtatatcctttcagacattttgtacttacctatttacactttatgtaaatattaacatgacatagctacataatctatgtatgtagttaacttgctctgtttacatacccaaaaactcaaatgtatgcattacacagatatatgcatctgaatacatgggcagactgggtattggagagaaacaacgtcctgattagcaaatatatcattgttaatctgaagatgctggtatggtttcccagcattgactttttaggctatctaagactcaggccccactttcatggattcattcatttataatctgttatatatcagactctgtactgggacctttatatacatcacctttagtgctcataggagccttatgaattagatattataatctccattttacttctgaggaaactggggctcagggagactagttgcccaagttttcacagtcagtaagtgaaagaattgggacttaaatccaagtacatttcactccaaagggtgtgtctaacgtagtgcaatgtgatacccacaataatagagaaatgtgcagggagcagtggcttgtggaggagtgaaaggatactccatagctgggaagctctgagctggatggtggaggataagcaagacagtggaggataagtaggtgaggagtgagcagggcacatgcaatgaggctggaatggaagggcatggtgtgctcccagaataacagggggctcacagggctggctactgagatgaggtgggaaggacagatcagccagatcaaaagggcctcaacagccatcccaggagcagacgctttaccctgcagacacagtagaacagtgtggtcctatctgtgtttgagaaaatcagctttggcagaagactgctggtgggtgggttggggatatcagttaggatgctatagcaataagccatataggagaatgtaaactatgtaattaactggagaggaggagagatggatttccaaaacacaggaagcagaataagtaggacgtggtgactcttgactctggggtaaatgaaaagatgaatggttaaagttcaggccagggaactggttgatggtagtaccatgaacagaaatcagaaatgagagcaggaaaagattaggagaggagtgatgaggcaagtttgggcccattaagttcaaggttactggacctcacaggggaatcggtctgttagacagaagcctggtgtggtgagtacagactgaccagaagggctttgaccagccttagtcattctgcctcgttattgcgtcagccatggtgacgtgctctgtaagttttattgaattttccttgtctcttttgcaactctttattagtctattatctctgattcctacaggaataagttgtaggtttttgatccttttaccaagaggaagaaaacttgctttgcttattctttctttattaaagattttgcatactttgactgagtttgtggtgaaataccattttcaacgttaaatctgtttaaggtactacagattccatcaatgcatttaagcctcacccagtatgataacatttactttttcaaaaagagaatcaagagttaaatgaagctgagctaaagaaatatcaacttttacttaattatgaaaattacattttcaacagtaaaatggaaatgtcagactcccaaatgtgatactttctaggagtttaagttaacactattatcagagctttgaatgagcaaaaccagaagaaatcttagaaattatctagttactatattcccataatacagactgaggaggcaaggtcagaaggggaaagctaattacggcaggccagagacagagacatgctgagatcttgttctcctggctgtgattgagatgaatggcaggggcctgtgtttataaatgtaagtagacctacattcatgtctttcaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtgagactcctgatgtcccctaactgggccaggctctcttctgggatttagacaaggcaatatgaaattagacccttccagggtggcatatagtaagagagacacacaacatcacaacggtatgaattcaggtcaaggtggaaagctaagtgcaagctgatgggtagaactagaaaggtccatgaaggaaactgaagctgattgatagagtatgactcagcccaacacaacatcccttctttcttcctgttctcaaagcctttagtgtttctaccagcctctgttccaagatcacctttaattcaacaagcagaaaagggcagagacctcagagtaagcagtaatcatggaaagagaaccataattatgtccaaagttgaggcattagaaagcattgtccaatttcccaaataaagatcaagtatttgggaagtgcaggatatacagtagtaaagagtcagagatgaagtaggaaggtgagtggaggcgagattcttaagggccttgaatgtcatgccaagtagtttgcattttatcagcaaaaagtgtgggtaggaaggggacggtcaccatcagaagtagatgtaaaaagtaaatatgggggaagagcaggaccacatcaaaacaatataccctggaatttagagaaccccccacaaaaaaaaaaattccatgggtgggaagctgttcttcttttaaagtgaggctgaaaaaggtcagaatatttctaagggatcaagtttattgcagttatatctagttaaaaaagacgtggagacctaagaacctaccttctaagctctctccagcttcctgaaagaggttctcatcaaacaactctagagcatttagatatttttagtattattgtagactcattattccatagccagtaattcaacatgaattaaccttgtattaaccagaatatttggtcaacagcagagaagtgagtttacaaggtgcttttacaattataatctcaatcaaactttaaaacaattttgagacaggagccatgaccccatttcacaggtaaagaagtaacccaggaaggttaagcaactcacccaaggttgtacatctggtaagtgatggattaaggtctcaaacccatgccttgtgtttttgaatcacatgctcttttgtctacaccaaacaactcccaagctattctccactgagcctaagatacagcagaggcatacaaaggcactgtgcttccgcttattttatatgtagagtattgtcattgtatatgttgggtctgcctgcaatgtcccatttacaataggtctctgcgtctaaaaattttccaaaattggtgttccatggtagggatttttaacctcagcactactgatattttgaaccagatcatttgctgagaaaagctgtcttgagcattgtgggatttttagcaacatccctagcttctaccctaactaggtgccagtagcagccccggccccaccagttatggcaatcataaatgtgtccagatgttgttcaatgtcccagaaccactgctatatgggatgatgccctcttagaatgccctgtgctagggacggtggaaattttaggacacaaaagatctggtcccttaaaaagaaagatgagtcttgaaaatagccattgcacaagatagaaaacagtgatggcaataaagactaactgataaagaatgagaaaatgtggaactggttgctctaagagacaacgcggattggtaatctagatgcgatttctacaaattcattaaaaatagaacaaatttctcagggtcacaaggatcaaccaggggggtcttcactgaggccatgagtatgtatcatcctaaactgaactttctgacaaaaaggccagttacgcttttcaggataaaagggttatccagagttaaactccaggataagatggattgtaggtatgggtcctcaggctaagtggaatctcccggcccattcccccaaataatgttggtcacaaaatcatggcattctttagtattttggttggagagttgtcttaaccggaagaaaaattaccaaacactggtttaatatgacaataagttccatggatttagacaaggctagatatgaactttctaaccacatttttctctactttcaaacatgctaaccatctagaaattttgtcagtgccaatagcttttattggtacctgaggctcaagatcacagaaattatagaatttttttgctcagttgtagggatgacttcttctcataatttgccccctctcctccttaagatttgactcttaacttcatagtcattgagaaactctttctcttaagtttgattctttttcagacagaagacaaatttaaccttgttaggtctccttcatcaagatgataaacacacaagagaggatttagctcatttctttgctccaaataagtggagtatccaaggaaggcagatgaagcagctgacataaagcagcattttgttaatgggaaaaaatgatgatacttttcaagagcaataatataatctgaagacctcttctaacactgaattaaagacactggaatagatttctatccaaagcttgactttcttggctagagaatattttggaaattggttgatggtttctatctagagtggtgagactccttcctgaaaccacaagtagatggacatgggccctctggaaggggcagcatggtcctgggcccttacatggaattcaggaaatgccttttctggtctcagatctgtcactaactccccaaatgacatggagtggagaagaatattattttacagcaccctctctgctccaaaattagacagatgacctctgggcataacagagaagtagtctacttgaggcaacttagggactgagctgcctacctgaagtgccctacagtccttgcatctgtgagttgggacaattttccagttcctttcaaagaagagattaacatggtggcggcgggaggtgagatagacttctccacttgtgcttgcacagctgactctcttccagaaggccaccctaatgtcagcattagccttctgcagaggttccaacagccgtggggcaccagcaggcctcccctctgcaggatgctgcatgctagttggctgactactggtgctcatgtggaaaccaccctgtgcccctgcctacacacacccagtgagttgccctcctagagctgagaactcacagaatgtcaggctgcaggggccctctggggacgcatctcatcttaagttgtggttttcaaatatattctccccagtacacgttttcttcttcttcttcttttttttttttttttgaaacggaatcttgctctgttgccaggctggagtgcagtggcgggatctcggctcagtgcaaactccacctcccgggttcaagtgattcccctgcctcagcctcctgagcagctgggacgacaggcacatgccaccatgcctgactaattttttgtattttagcagagacggggtttcaccatgttggccaggatggtctcgacctcctgacctcgtgatcctcccacctcggcctcccaaagtgggttacagacgtgagccactgcacccggcccacattttcttcttgaaaatcttcagttaggcccaacgtagagaagagacagaagtgagctgctctagctgaaggtggttttgcttgctcatccttcttggttaccctgaagcaccttgagggattatggcttgaatcttgctgctctggccacattcctattggacagaagaggaggtcagagttcagagagtgggtgagcagtctgcctctgaaatcccaaacccagaagtcttccacactgagttgaaacccactgactttttctaatcgcctggccaatgctagcccctagcatatatgctttttctggctataaatggaagagaagcttttccctttccatctgaataaaagcgcaaatatgccatgtggcccccaggtaaatccacatccctctccaaaattctgttttttcctctgttcagtgagaggatggaacaagatgatccccatggtcctttcaattctggaattgtaatcccaatcctcctcaccagaacttccaagatgaccccaccaaacactccttatcatagtcaggataacaccagaaaacagaaatcgtatgtttacagcagctgcttctcaatgttgcataactgcaagcactccagtaggagcctgcagcctgctggggatgccttggtggtatgtcatcacagaacttgtaaacatatcatgccaacactgttctttaccaagaaacttaaaatatcactgacttgcctttgacaggataaaattccctgttttgaggcatttttcctctatgactaaattctcctcccaggcctacataggagtaggtttaagaaaccttccaactcacaggaacattttccagcccagcccaaccccacaagctgcccttcccacccaggcccataggggcgatgatgatggaactgctcatactgctcatcagtagcctgaagaagagcaggactcccaagtctgtggtccggatgctcacatttatgaaaattcctctcctgcctgatttcccacagttcttggtcttcaagactcatgcacatctgcacagcagcatctgcttccttggcatgtggctgcaatgtttagattcctgtagtgtacggatgaggcatacgaatcaaggctggttaatgctgcaggcaagaggcaaagcacagatactagtcagggagtcaggcagcctgggtcctgggtgtcattctatactcattaaccttgggcagatgactgcacctaaaatggactctgtttcctcctctttcaaatacaaacggttaaaccagatggtctctaaggtctactttgccttgatgttctgtgcatctaagaccttagaaatcatgatccaaccccatgatcaacatgtccaaagtccagggaagggcagttgattggccaacatcatgcttgtattagaatttacatcttaagattctcagtcttttcttctatttatttaacagaattatttaacagattaaaaaacagcaaagtcccatcttgtgaatgactagtttttatgttgtaacataagacaaatattgtctctagtcaaacttaccattaaaaaatcccttaaatattgcaaagcattatcttttagatgcccagaaaagaatttttttccaaaaatgcaagaaattaaagttcctttggttgagcaccagatgaagtggtccatttatacttacaaagaaactatgaagctatagttatggagagagtctagatagttagaaaccagaaccaacaagagaacagcagattacacgttccaatttcaagttcatttcatggcatctattcactgtaaaaggaagcataaatcatctgcatttggattgcactctctttctttctttctctttatgtcaccatgtgtaatattttaatagcatctgtgacatgtttatgtaatgcaatgccactgttctccttttaaccctatatccttgatgtattcgacatttcttccatcctctccactgctaattccttagttccaattcttattcctctcaactagtctattgtaatagccttctatatgtctaccagatgtcagcctctccccatctagcctaccttctatgagtatccagaaggatcttcttggaacatagctttgattatgctactctaaaaatctttcaatgcctccccattgtctatggaatgaagcacagtaatcctattgaaaatctaccataagctggacactatgccaaagactgggtctgcaaagatcagtaaaaagaattcttcgcagtaaaatgaactataaagtcctcaaggaattcacggttccatagaatataatgaaataagtgcataataaagccagacaaagtaacacaagggttatcagtcagtatataagtttgggagtggtcatttttagatggccagggagggctttggaaatagttgatgtttgagattagtctttagaggtaaataataatttggcagtgcagttctctaagtaggatttcttagcagagctaccatcaaagcagggaggttgaagaggatgggaatgatgcaaaactgagaataatcagagttggcatgttttggggagatgtaaagcccagaaaggttatctgagggtcaactgagaaatgtttggtaaatttgggtttaagcatgtgctccccaaatcacatacgtgtggtcaaaggttgaattaatttcacagatggattttgttggccagcctaatattaacttatactatgatttgggggtgtaaaaaaagaaagaattatgacaacataaaatttccgatctcacacaacaatctgcatttccaagttctcttagaatattagaaaatctggcaactcttgcagcttcctgccttcagcaatcagccaacaccaggaagaggtggccttgtgggtagggtccccaccattctctatagctcccccatgctaatgctttctggcctcttaatggcaccattgctgattttacagtaaagaaagtgaatcatttttccccagtgtctctatcaaaagtagaaaagttgaaagttcttgagaaagacacgtatttcaggaaaaatttctttgcagagtgaagaatatccctctgtatttaacacgcaaagtgtatatttctgtctaaagaattcatagcagcttgtttcactcatttatgttttctgcctggcatcttttagcattttagtctaggacgtccaattagaagctgtgatgtggcggaggggtggggcagtggggttcggggatgtgacacagtcgagggtatgcttgaggaaggttaatctggagctacatgagggatgtcaaggactagtaaagtcaaaataaactggagctgctgaatgaggccatttaggtggctgtgctaaatagattggatatgactatgtggagcgtagtatacttcaagaaagcccacaggcctcctggacagctatggaagagcaggtaggatgtgcagaggtaaactccacaggaactggctgcgtatgggagaggaaaaaggaggaatcagaggctttaagccccagttatgacaacttattggctacttacccagaaattgagatcaggaacgtgaagatgtgtagatttagaaagatatagagtgcactgaagtgcattgagttttgaatacagctggaaatgctggtctaaattttgagacagagcttaaagagttgtaagagtgggtgtagaaagagcacagagacagtgatggagagaggattaacacagtgaggattaaattctgtctctgccaccatctgagtgaggaaccttggtgaagctccttgatctccctcagcaatggttttgtcatcagttgaaaggaagagttcctaatgaatacaacgtcttcctcacaggttgtgggaggatttgaatgacatgagggtctaagtggaatcagtactgcaaaacgcagttgtgctcagtggttgggagctcaaactttggagtcattcagacccagcgtcaagtcttgcctccacttcttactggagcagttgcttaaccttgctaagattttcttctccatctgtaaaatggagataataatgatgcttatttcatagacttactgtgaatgccaaatgaagtaaatgctttaatgtcatatgtccaacacatctctaattagctcaaaagtactattatagtggtaatgaaggcaatggtatgagtaataaagtgtctgcctggtatcaccagatgttcaatgaatgtcagttttcttatcaactctgaccctaccactgactgcctatgtatgaccttgctaatgttactgagttttttctagcaatttatggaaaagtgcttccaaagcactattcgaaagcaggaggttatttatttctcctttgtatttaccttgtagaaacacacattttacagcagtttctaatctattaactcatttgattcccatggaataggaagagcacggattattgcacctaatttacaaaaaaggaaacaggtacaagtgaatttgttcaagtctctgcaggaaagccaggcttgaatccctgctcttctaactccccaagtcatggttctgtgtctccatgcagccttcctcagaacaggctttactgtggaaggggtcctgttgtgtttcctggccatgcattattcctgaaacaatactctatttgtcaagatgatttcataaaatttagtaaaacagaaggtccttgagggtccctatattgtctagattattttaaataacgttctcttttatcctttgagagaaaaaaatgttttttaaaaataatagaaaatggagtctgaactacagtgaatctgcaagtgcttgtatcatctgcttgtagtacatcctttctgatgagctcaagctcattcccactagattgccagccccatgagttcagggcctatgtctgtgttttctccagtagaaagcacagtcctgggcagaacaggaaaaggcacatgtctcctggcagtggaaagggctctggcctagaaaacagctgctgactcctgctgagagcttgggcaagtcacgtcttcattcaaggcctcagtttccccatctgcctgatgagggaactggaccagctggcctctccaaacccttccagttctgatggtctgtgactcccagtccaatgccccttccctcaggccacattgggtcagtctgcatcctgctgtgtaattgagaggtaagtcgctcccaagtgggactcttctgacccctaagctcctaatttctgtgcaatgctctgtgtttacttagaacatgccctcgaccttccggctgaactcatttcacctactgcataactctgctcattctctgggagtggacaggaggccttggccccagaaggaaatgagaaatgggtaaacatttctcatgaatttcaattgtagtctccggtggaattctcccactccagagacaccaggacccaaacaccaattctagcttattcagaagaattagaaaatgaaaatgagcttgcttcaggaaagtgtaatgaaagctcattttatgccaaaagtgcaaacagcacaggcttcagggtgatggaaaacaaaaggaagctcgcagtgctgaggaagagcatgtgggtgagtgtgagctgggaaggtcccaggtgtgggtgcacatggggtgcatatctctgtgcttgagtatattacaggttgctgttgaaaacaccttggtgaagagcagtgcctgactttacttcgatgtgcttataaagggaaaagttaagggacgaagaggtattcatttattcaacaaatattcatccagtgcctacaatttattagagcttagggtacagcagtaattagaacagatagaaatctctgaagtgaggcttacattgcactgggataaacagacaataaacactaaacataatacataactaaattatgtactaagtaataagtttatggacaaaaataaaatagagcagggctctgcatgagttgagatgggggctctgatttaaatatggtgctcattgagagagtgacatttgagcaaacacttgaagcaggtaagaaggttagccatgtggctttcttgttgggggggctaccctgggggggcactttaaccagagggaacattcagtgccctcaggtggaaagtgcctggtgtgtttgaagaatagcaaggatggcagtgtggctggagggcaggaacatgaatgaagactgagaggtacagatggggggcgggatgggagactggaaaacagggttcctgttaaatgctgccagccaatggcaggctttacaagctgctttcatgccccgaatctcatttgacctgatgctcagagtattaatgtccactttttacgtttgtgaaaactgtgccctggagacaggggcatgggtgctaacaaccagattggggggtgggggcagggaatgggggcaaagagatgcgcagtggcttatcattcgacattcagatagcacagacacagagagcccgcagagcatagagcatagaacaatcacataattaggaagtaatgagttttcacagaactggttttcatagaactggtttctaatagaatgtacttaattttaagtttatgaaacttgatgatggctggatttaacaacagggtagcaaaatctctgaaaagctgacagttggctcttataaactggtgtgagctgccggctccagcacacctaccgcctggggaggtttaagtgacccctgaggtatgagtggcagagctatgacagttggtccttattccagcactcttgtaggatttctgtgcaaagatttgaggatataagtttagcctgagtcagggcaaggtcctgggcagtgtcacaggaacacagcagctcacaatccttgaaactctgctggaagacactggcccaaggcggccccttctgtccactcagcacaagcctcatcactgccttcacccacgtcctggctatgacacacctggagccacgcagcttctgccacagaagaacacagcaaccctttgtgtttcccatcctcaggctattttcccgtcctgaactgtttggggcccagcctccaagttgctgaagggatttgcatatgaatgagctcagctctggagtcccagaaggggtgaggtgggggagtctgagccattctcaggccaaacagtgccaatcctccctggctctccctcccagacacaattccagactcttccctcccaccccaccccccaagcccagctccctctgagacggtgggcactgctggtttcccacctgcgggatgcccgcttcccaggctcttggcaggacccctcccctgccagctctttcttctccctctgctcatgctgcccttttctgtccagagccctcccgagaatgggcaatccttcctggcagcagtgggattcttggactcttaggacctgccagctgtttctctggcccccaccagctgtttctcaggcccccacattctttatggcgccaagcatttgcatgtacacaatacctgcttaggggctcactcagctctgttaggaggttttcaccctaattaacaaataagaacaccatcctggaaagagcagtgcacctaggccccagtactggctctgccattgactgactttgaacaagtctgttcctccgccaggtatagacttgaggtcttttcatgttcttttcagctctgacctttgctctggcaggtggcttatcagctgtgtgattccaattattgagccaaacctggatgtcagaacatcctgatgttgtctcaggtctgctacttgtaggctatgtggacttgggggagtcatgtcacctccatggactcagaactgtctccctgaagtgcactcactacatgactgccattaggagcaaataaaatagagaaggtaaacgtgccctgtcaactggaaagttccacatagaacaaggaattattatcatcatcattatttttattactttttttttttttatggagtctcgctctgtcacccaggctggagtgcaatggcacaatctctgctcactggaacctctacctcccgggttcaagcgattcttgagcctcagcctcctgagtagctgggattacaggtgcccgccaggacgcccggctaatttttgtgtttttagtggagacaaggtttcacaatgttggccaggctggtcttgaactcctgacttcatgatttacccacctcggcctcccaaaatgcagggattacaggcatgggccaaggtgcctggctgattattattactctttttttatggccgaaagacttgagccaggactggagcatcaacctccagaacctctcatttgaagtcaacttgagcttagatctgccagctgtgttatttttactttacatggctttcaagagtttctgaagtgcagcacacacatgcaaacacataccagatgcctccttcgtttctagacccaagtttctatctggtatcaggtgcctttaacttgcttctactcagatcactgactgaaattaaagctacctggtgaagtagcaggactgggccattaaccactggcccagcagctgggagtgatggactttccgtgaaggtgagctcaggagtaccgagctcgcacaatgagcaggagtcagcccggggctgtcggtgaatcattggcctacggctcacgcatctaggaaaatcttttgaagcacagcaaagtaaagagagaaattcctagacttaatgccatcttcttgtggacagaagcctttagagatccctcactttgctctgatcgtctttcataacttaagagtacccttttgatgtctctcagccccaggactgttagaaggctttgtaaagtgcaaagagccaaacagctaatatgccacctgccagaggaggaggctgggctgggaggtctctctaggtgcccttccagctctatcagcctgggttgtgagtcctcacaaaaggggaaaccactgctgatggcttcagcgagattaggaaaggagtgaaatggagaaatagtatccagggacaatctcagcttcttaatgttctccaaatgcatgaagtgacccttgccccactagctgggagccagaacgtgtcatctcagttggtggatggatctcagcagtcctgtttttctcattgatgtactgagtgctcaacgtatcccgggcacttttctgagtgttttatgtatatcacctcccatcctatttacaacagttctgtaatataaataggattattttcactattttacatatgagaaaaactatatacagagaatattagtttcctaggacttctgtaataaatgtccacaaactaggtggctgtttaagttgttaaatttcttaacaacagaaatttgttctcacgcagttctggaggtgaaaagtctgaaatcaaggtgtctgcaggaccatgctccttctgagggctccagagggggatccttccttgcctattctagctttctagaataggcagttgtaggcgggccgtctttggcactccttggctagtggcagcataactctaatctctgcctctgtcttcacatggctgtcatccctctgtgtgtgtctctgtgtccaaacttccctcttcttataaggatatcagtcattgggttagggtccactctaaccctttgtagtgtcatcttaacttgattacatctgcaaagacctgtttccatataaggtcacatgcagagaaacaggggttaggacttgaacatgtattctagggggacacaattcaccctacagtacagagagtttaagtaatttttccaacatctaatcattggagaagatcatataaaaatgagatgccccaataagtaaggcgttgcatcctaaagaaacagaaaacctaacaaattgaaaacaattcacaatttgactcactcttgagaagtcaacaaagggcacagatgttcttattgcaacctttcttgaacatctaagatctgtctttcttctctttttctgtctctctccctttcctgtcctttaggtcttcatgaactctggactaagaaactcttctctctccccttagccatccacttacacccacctactcactccttggacttcacagtcacaaaaactgtcccctgacatgagaccctccctgccatacgctgccatctgtgagttttaggtattctgagtttcttgatattttctcagaattttacttttcaccttattgtttatgaagcaaagatctctttttcaactctgttgcgacccaagggctagagaaatgagaggaggtgacagagtgctgaggagttcccacgccatgttctgtgatgaagggaagacaaggggggaggagggtgatagcagatgaatgaccctgcacttccaggctagttaagttgcccttcctgtgtgctccccttgtttgttgactggaattaaccaattttataccatggggtggaagctagagggaagcagctttgagctcaagtttctttttaaatgtaaaaagagaagaaaaagaaaaattacctatagttccactaaccattgctaacagttactctaattccttctactttttattttcaatgcgtactttcaacataggtataattataccatatatactattttttctgctttttcacttaatattgcctcctaagaatatttccatattgctataaaccctcgattaatgtgataattaatggctgccttgtatttagaagttaatgctaacttatttctctagaaaaggatatttacagttatttctaatattctaatatcatatgactgctataaatatctttgtttataaaagtttttttccacatttggaatatttttccctaggttatattcccagatatggaaccaacagataactttcaaagtcaaggataatccaaaacagcctgatctatcttggaagatactgagtttctcatccctgcagctgatagtgaaaaggtggtatgatatttgctaagggtgtggtaaaaagataataagttagactaggtgacttttgaggccccagaaacccatgagattgtggttctccaaatttcaatttacaaacgtgagcctattctttgtcccaaatcactttcttacttgctataaaagttatctattgctgtgtgataaaccactccaacacttagcagctaaaacaatatccattttgtttgcttatgattctgtggtcaggcgtttgagctgggcccaatgagatggtccttttgctggattagcctgaggtccttcatgcagctacagttgttcagaggcatgtctgaaggtcatctttggccttagtttctcatctggtagctgatagtgaatgccagtgaattggtctagacattttaatcagatggttcatctctgccctatgtggccgctgagccctatggcctcacagggcttcttcacacagttgcctcagggcagtattccacatgtgaaagtgttaaagaaaaaattattcaatgacacttgttaaagtgtggtaaggcagactttattcaggacagggatgaaaaggatagggaccacggcatgggatttttgcagtgagggagagagattgggctctattttgagtatagcatgggcaagtggggatttatagccagggagcatggtggtggtcagtggatgttaaattactaatgggaaacatcaggggtaagaggggttctagctaaaatgacctaacaggattcttgctggtgacaggccaagatgatcagacagcacccgtggggatggtggaggatgaagatcccaattggaactctagggtgaaaagatttcagggatggggcgttcttgctgcactgattcagcaaagattttgctaaaactgagttttacaaggaagtgcacagatgagttgaggagacgtttcagaagcctgactaaaatttggctaagcaaagaatctttgttaatagctgcaaggtcccttgaggcctaaatttggaaatagtatactgcttttaacgcatcgtatacttgttgtcagaccaagttaggccaatcaatgagcagtgaagttacattgcagaattatctgtgtgcagaaatggaagaaagtattgtgaataatttttgcaaacaatgtattattatctatcttagggacaaaataattcttgtcctttgcatatgtgaaatgtgcttttgccccttctctcaaagttttatcccattagccgttcaggcttgaactccaggacctcatgatctaaatcatgtctagaattagatgacacacaaaggtatagctcttgaagtatatctcttcttgatctagagatctctgaacccaaaagaaaagttatttgctctccacatgctcaatatctccttgtcttggtgagagaagaataagataaccacaatagaatttccattgaaaaatggaaaaaatgagaggcatatagcaattactgctccatagtaattctgaaatttagccaggcacatgttgccaactccagataccaagaatgttccttgattagagcccagttctgcttccttggaggggtgagagtggatccccagtccattgctctctgggagtggtgagagtggctcttgcctctgatcttgactctgcctctggcttcttagctttgtcttctgagacattctttcctttctgtaagaaatggcccatgtttgtagctgagtagtctattcagttcgctttctgtacatagaaacctgaggctcaggagcctcttttcattttgaattgccacagtcatttctagtccaagcggatatagctcccttaaaatctttttgggtctccaatgtagcagaatatagttcactccactagatgaaaaacatatccacaattcttttcaaaataggtcttcctactttgaagggcatgtcagggtgctacagaataatgctcttaagattcttaggtgccttgtggtctggctgatagggagtactgggtactgccttaaatcttctaggtcttaacaaatgattcttacagtcacaccattgatttgacatttaccctgaagccatttttggttttaaaatctttttttttttttttttgagacagtgtcttgctctgttgcccaggctggaatgcaatggcatgatctcagctcactgcaacctccgcctcccaggttcaagcaattcctctgcctcagcctcctgagtagctgggactacaggcacacaccaccacgcccagctaatttttgtatttttggtagagatggggcttcactatgttggccagcctggtctcgaactcctgaccttgttatccacccaccttggcctcccaaagtactgggattacaggcgtaagccaccacacccggccttaaaatcttttactagtggataaactgttttccaacccagctagttctgggccctctatatttcctctaagttctgctcacatattgaagacttacttcttcctgaagtacattgccatacacaaccagaagtacacactgacactttcaacattctgtctagagatctccttagccagatatgcaagttcactacatacagtccttcctttcttttcttttcttttcttttctattttcttttcttttcttttctttctttcttcctctctttctttctttctttttcatagacagagtctcgctctgtcctctgttgcccaggctggagtgtagtggcatgatcgtggctcactgcagcttcaacctcccaagctcaagtgatcctcccaccccagcctccagggtagctgggactacaggcacatgccgcaccaccacacctggctaatttttgtattttttgtagagacagggtcttgctatgatgcccaggctggtgttgaactcctgggctcaagtgatcctctcaccttggcctcccaaatttctgagattacaggtatgaggcatcacaccttgcccattacatacatttttctaccttctaagttgccgcagacaagttttgccaattgattcaccattgcattattcaagtggtctgttttagactcctatagcagtctcttcactgtttttctagaatttacttgctagccaatcctaaaactgaagccacatattctagttttttgttactgcagcattctacttctggtatcaataactatttcagtcagacttcaatcaggaaagcaaagtctttatgagtaatgtgagataatgaatatttatgggtattagaactcatgtaattatagaaggagctgggcaagtaaaagttggaaatggggatttaaaggattagagaaaaggtcaccaagcagttctcttaaagccctggcatgggtggaaatattggcatctgcaagggaatctgataagtcaattctacctaaggggccaaagtgcaacaatgaaggggaggctcatggaaaagggtctctgagaagctgttggctgtaagcagctaccacctctgtggtttcacctgaaagtatctgatgataggcatgggccactgttggtcatcagagccagtagttataaagagccgggtgcagagtagaggaacgtgagagcaagtgaggatgtattggacacatctacacatttctttctctgtatgtgattacaaaacagccttcagtgagtaatgactattgcctttcaaacttgcacaaattcctcttttggccaactctaatctagaactatacagggaaagaaagtctggggaacgtagctcccagattaactaaactggcaacagggtaatccagcatactccctaaatgtctgcctaaattaagtctgcaatgctcctcaagggccctgagcagatttcagaaaggctccaggagatagctcgggaacattgacaaacaaagtcatgaggcatttgggttataagacagcctttgtttatttgcctaatgtcttgaggagcactggctagggaatcaggatgctgcaattgtggacctggatccaccactcactagattcatttatcatgagattcattcaccactcactagattcaccagtcaccttgcccaatttgttcaaattatctgggcttcaatttcctcatctataaaaggagagcaatcccccctgggctgctttctctatacattgctttgaggagccagttggtagctgtcaatgcatttgtttagctgatgtaatgaatttatggacatgcagagagcagccatacatagcgagagtagctgtccttccctagagtagctgttcttccatagagtagctgtcttcccatagagtagctgttcttccatagagtagctgtccttccacagaaatttggccaatcccagctgccctgccatagttttgcctagcaggtttgtgctgtttctgctgaggtagaaaactcatagaaaccaaagcctcttggcttcttcttatcagatgtgccttcccagctctctgtccttaacagagcccctttctgacgccaggtaatgggtagtggggaggagcagctgagatttgaataccccaggccttcactatttcctctccctacatactctacccaccccctaccctccatctatgatttctacctgcctacattctattcacgtttcagtctccagctcaaagattattctcttcttcctaaatgttttctgatttccctcagctggattcaatcttttccattccttaaacccccagggcagcccatctttgattgcatttacgataccctgagaataccccaacacatatacctttgagtacttatcttattcttctaccaagtgtcacattcctagaggcagggaacttgcttattgagctcgtataacaaataaataatttttggcacccttcacattaaagtgtagacagaacttagtacacacatatttggtgaattgagttgaaagaaaacaaattgaggacatacagccacatgttggtgtcctaaataacaatagtctctaaggacatagtcgcccacaagaagaaatagaaaaatgaagagtttattattcgcagccacatgggtctccattattatgaatgttttgtcttcacttgataaggtccctccatcatgttgatatgatgacctctgagaggggacagtccaaatagaagctaggtctcaatctgcctatactcagaggtaaatgatctttatagaactccatattccacagcacaggatgcaaatattaaccgggaccagtgacccctctgtttaggttatgactggagctgtcactgagccacatcctctctaagagacagtccatgcacccaagataaggtttcaagaggcctttgagccaggaaaattgtttggccaagtgtctgtgtctttagtcatgtactctctgggttggtgggttcttttctctcatctcagaatagttcccaaagcaaaactgatatcagaaaatgttcatgttatctctccagccttgagcaagtcacttcccctctcttgacctctgtttcctatagaaggaggcagatagaaatagctcttaaaggtcccgcccagctctgatattccaggactctattctgagctgcaggctgaattcccagggccccaggctactggccttctcttctctgcttctaaaaggatgtatggctcaaattttcccatgggcctcagctggggcatgcttcctgttctctggaatactgtggctctgcaggtgataaccatttatctgatttatctgccattatgaaaaggtccttcagcccagacgttacaaggagggaggtcatttatcacagaccctcagtagtatctccctaatccaaatgaccagtgtgttcacttgaaaatgttcatgtcccagtcactgcagaacccaagaggcactggggataccaagttccagaaagaagcctgtgtagctggaactattaatgcccaaggcatgactattcattattaacaaattcaagttcatccgcaagcagtaatcctgcatatgttaaaactcctgcttaccatcttctggttggtttatataatatatgactatgatgatttgttagaactgtgttagactatgatgactgctatgtctggaattggaaaggaatctagagctcagctagtccaaacccctgtttttacaagtggataactgagagctagaaaggagatggcccaaaatgcagaatacggcagtgtcaggaacaggacccaggacctccaactgccaggttcctgtatatcgtattactccaaagcagaggtcaccaagatggtgtactctagttcatgcagttactcacagaagaatccctttcccaggccctcattctaaatctatttagcttttttttattaagttctagcaaaagcagttaactggtttctaattcacaacatattaaaaataagcagacagaaaagtacagtgaataggctgataaaaagacaggaaataaaacatgacataaagaagacttcagaagttcaaggctttatagtccggcaatgtttaacgccaggtcaagcgacattacacaactcaatatccccaagattatcactttaatatagtatcacaatggttgacattcataacaatgtccctggatcaccaagaaagggttagcatgtttcacttgagaaagtgggtacttctttaaagtacttttttttttttaagtgttacaccaaaaagaaaatttttagttatagttaggtaaagctttggctatttggaaaactgagtcagataaaataacacagcagctgggaggttcaaggaagtgacatttcagctgtgtgcagataggcacattctatagtaacaagactggtgtgagttcggctggtatctgcagagaagaggaataaatagcaaagccatgatctcatcttctgtttacacttcaattcccaaagttagtgattaattgtacttgcgttttgttgccagggcaaattgtttttctttgaaactcccacttattttaaataaataaaccattagtttcaaaacaggagtgtcaaatgtcaagatatttctgacatgctaagctaacgaacaaaacaatgaattcattagaagctactagagatagccgcctttgagaacttttctctaatgactttgaaaggcagcaggaatcattcttggtaagagatttttttcatgcatcttggctaaaatttggtccagaggttgcaaacacaaatacaacttaaaagaattggattaggtataagataatcgaatagatacgtcaagaatttatactcaaataaatataccaactagctatcatacgaagcttcccaaactcctgtctcacataaaatcagctttaagccaccagtttaggatctctgcttggatctctgaattcgcacagggcctctggctcttccaaagaagggaattcttttagcaaacaggcatgttttttgcatctaagtcttaacacaaacatgtacacacagagatacacactcaaactatttttgggtgattccaataaatagtttctgtattaagactgcctattaaacattagttttcattacatgactttcctgcttaaaagttttcagtgtcttccacttactcacagaattaatggcattcaaggtcaaccataattttctttccatgtatccttccaagtacatctcctcctacaatccccacagactccctggctactcactgttcacagaatggggcttgtactttcagttcttgtaaacaaatgtttattggataactattatgtgccaggtcctgttccatgcactgaagacacatctataaagaaaataaagtccttctctcctgtagcttatattctaatgtggattgtttgcctgctttgagtgcatatgcagtgcttctgcttgtgtgaaagcatttgtcacactgtgtaatacctgcctgtgtctgtgttcctcaatctcaacactgctattgtgtgcacagcactgtgtctatctctcatcacctccatctcatgctttgctcggcagtaggcacacactggatactcaatgaatgacttatattgtgtatacagtttccattctttggaaatgtggtaagttcctgttgtgcagagaatctgtctgcgaggttatctaactttttaaaactttcatattgagttatttttaataaataagctgcttggttattgacagcaacaacaaatatcaagctacttctaatggaactaaataagacgaatgaaactgatcagatgtccacattgaattaacttgtaatgcgtcttttctcaagaatccttaacctcctttctttgggtttctcaggctgactagcctactcttgggtggccccttcctttttctttctaaagataaggaaagaagcctagctgggaaactgctcatcttgttccctttctctttgacctcaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtgggtaagttggagaagtgactcatcctcaggtctctctctctctctccgaagatgaaaactgccttgtgacctctcctttacgatggaaatctgtgtgtgcaccacatagattttaccattaatgtcttaatgcatttgctctatcacgtatctatccatctatctaccctctatccatccagcaattcatcttttacaaagtgttttaacgtaaattgcagacatcagtatacttcttcctaaataattcagcatgcatattattttgctagagtttcatatttgttcacagcattttttctttttgtgtaaaattgacataaaatggaatatacatatctcatgtatacatttgttgaattttgaaaaatctgtatttgtgtgtaacccaaacctctaacaagacactgaactttaccaccagcccagggggttcctttgtgtccctgccagtcaatctctgctcccacttcccttagaggaaacaactgttttgattttttttctgctgtagattagttcttgcctcttctaaaacttcatttaaatgaaaacatacagaatacattttgggggtgaggattcttttactcagcataatgtttttgaagttaattcatgtgtcgcatgcatcagtaatttgctccttttcctggcagagtaattttccattgtatgaatatactaaagtatgtttactcattctcttattgacggctacttggaatctccccattttttagctctcactaacaaagtttttatgaaccttcttgtgcaagtcttcttgcaaacatatgttttcaattctattgagtaaatatgtaagagaagaattgctgagtcataggataggtatacgtttagctttatgagacattgccagaccttttccaaagcaaatgtaacattttttatctgtccaccaatgtatgagagttctggctgctccacatctaaaccaacattagatgttgtcaatttttaaaaattttaatcactctggtgagtatgtagtggtacctcattgtggtttaaactgcattcccttaatgactagcaatgttgaacatcttttcatgtgcttgttggccattggtttatcccttttggggaaatgtacattcaaatgcctaggacagggcttgacccacattaggggcagaaagaaagaaagaggtagcatgaggtagaagttaagagcacaagctctgtacccagcttgtctgtatttaaatcctgggtctgccacttattatctgtgtgattctaagtttgttaatgcctctatgtcgccatttcatcctccatagaatgtgactagtaacagaatgcatagtaacaaatgtgtaattcttcctgaggttgttgtcccacacacagttattattataactgttagaggatagtggtcccaccagaagtcaagttacctgggtttgaacttggctttttgtgaccttgggtaagttgcctaacctctctgagttccagtttcctagtctgtaaagtgaagataatggctacctctgggctgtatgagaggattaaatgagagaacgcatgaatctcctaacatagtgagtggcccatatcaagtgctctataaatgttggctgtagtcttcatcatcatgcatgtattgatggagaggctttacctgccctacagatgtggacgagtgcaaggagagggaggacgaggagctgtcctgtgaccactactgccacaactacattggcggctactactgctcctgccgcttcggctacatcctccacacagacaacaggacctgccgaggtagagcctaccaatgattgtatgcattgcccttataggccacatcctcaataacattagatgaggctcagagaaagacagatatgcaataggaacaagtaaaaatgaagtcaatgatgcacctcagacaccacatggatgaagatgcagaaatgcccacccagcctggaaacctgatcttgggttcccaaaggagagaagctctagactatttggccatctttctttctggggcagcattttttgctatacaggttgctgtctcctatcctattgtaggcaattggtctggtcaagttaggggaaaacttgggtttcccagttccttctctttgagccacgaattatgctttacccagcaactccttttctcttcttttccatggcccctaagttcctctacaatagagagacctcagtccaaagcaaagaagtgagagaggaaagaggcaaacagaaacagccagaaaacttcccattccttctatctatctttgttttcatctatcatcaacgtacctactatgctatagtctcgtgcttagggagggatggagaaatggaagggtttagccactttctaggatgagctcttgggctagtggggtaatgggcatgtaagcaaatggtgaagtgtcttatggtctccattttaacattaatgtttccattacatttatgtaatggaagtatggacatagcacaatcagacctgtgcaggcaaacacttcccagagttgtgacccttgacagagatgaaagaataaagagaagaagggccttccaggcagagagaagagcttctgcaaacagtcagaagtgtggtagaacttggaatgtttcagggaacagtcaatagattagtgtggtccaggataagcatctgtgcttgaaatctcacttggaagctgagtgagggatcactgggggagcacaagtctggagacaaaagtttttttcttcctccttcaaaacctgctatttgcttctgaataaaaccctatataacacatcagtataaagcaatccaaaaccaaaagaacaggcacgtgcaggatttttcttaaagagtgtatattttctatttttttattcggttaagttcttcttgagtatctactatgtgttcagtacagtcagggccaagaatgcttagggcagagcaaggtttctcactcattttcttcattttcacccttcaccaggagcttttttaaatataattttcctaaggcccccaccatgaaattttaatatcacagatagactatatatctgtttatgtactgtatgtccatctgtgtattgtgcatttaaaaagcaagaccttccccaccaagaaggaattttagctttcttgagggcaagatcgcccccatgagaatgcttggggtaaaaaatgaaaacagtcaggaactcaggagacttccatcttcaccttgtcctgcagctcatagctgtgaaactttaagatagtcaagacccctttttcagaaccacagttttctcatttgcaaataagcagaatgaacaagggcgtagaaacattgacatcccagatctaggatgaactggcccaagggtaaagacttagtgacacataaatgttccttagcagggctaaagtcacgtctgggttcccaggacagtggattctcgcgtgcagtaaatgcagtggggaacgaagcagaattcctgcactcacagaacttacagtctactgggagcaagaaaatcaatatagggagctgttaaaagaaaaacttcagacaaattaaatttaacagagtttaactgagcaaagaacaatttgagaatcctcccctgcacccaccctaccaccaccagaatatgttcagagcaactccagggttgctcatgctggataatatttatgggaagtagaaggaaagtgatggacagcaaatggaagtcaggtacagaaacagccaaattacttacagcttggtatttgccttgtttgaaggcagtttgaacagatggccacccgtgactggccaaaactctgtgattggtactgttaacttaaaaatcaagattacaaatctgtaagtttagaaaaagagaggagattttattccttatgaagggttacagcaggtggccgtcctcatagtctgggaagcaccacctccagccaagaccagagacaggcacttaaaaggaggaggggttgagataggagctttatgctgaacaggttggctaaacatacatattcaacaggttataggaggagctgtgaatattcataagagtggtcctgacacatgcatattaaacaaatatgtatgcaacacatgacccatgttcactttgggatggagacttcacattaaatgtattacagttagggtctaaacgtcttttcaggatgggagacattcaggtgtgcagcctctgtaaactggcgagaaccaggccatggtcagaagtctcttatcaaaagaaagtgactgaaatcaatgtcttgtccattcaaagctacagttatggctggtggaacagggtggggatcagacagtcagcatctggtagagctgaaaattgttttcatatcacttaccacaaggccagtacttgttcagctgctggagaaaaagaaaaactttgtagcatcgttagaacatagtttatgctttcagtgtagggatgcgtgacttaacccttgcctggcatggccttagttccttcatcatttataatttggtattttatttccacaaggagtctgttttctcactctcatgatctctatttaacattaatgttggtcagttgttgtgtccaaactgcagagaaaaggggatatagaaggagtgtctaacctaccactccatcatggccaggaattccgttttaaggtttttctggagatcctttgccacagggggcccattaggtcagtggagggcttaggattttatttttagtttacagtaagacagtagattacagtctacttaaaaatccagttaggttgcagttcaccatgtacgcagaacccttcaggctgaatttaaaatatgtaaggaggccgggcgaggtggctcacacctgtaatctcagcactttgggaggccaaggcaggaagatggcttgagtctaggaatttgagatcagcctaggcaacatagcaagaccccatctctacaaaaacttcaaaaatcagccaggtgttatagcacgtgcctgtcgtcccagctattcaggaggctgaggtgggaggatcactgggagaaggtggaggtggaggtggaggcgaaggttgcagtgggctgagatggcaccactgcactccaacctaggtgacatagtaaagttctgtctcaataaaataaaataaaataaaataagtaagaaggaagcttaaggctacatttagttgaacagagtgaatagcactataaagaaaaacaaaacaaagacaggggttagacagtgaggagtgagggtgtgtgtcaagggcctgtaggagatgagggatctcctgaagttctgggtacagggaggacatgatcacagaggtccaggcatccccctgaccactccatctcaaaacccttccctctcagatccctctccctgacccccataccagaggatctgatgagaaggatcttcacacagggtaaacagccctggacagacaattagaaaatctgtgcttgaatctcagctcggtaaattactagacatgcgaccttgagcttcatttttcccatctgtaaaatggagatgccgataccttccctgtctactgcttgggaccattgggaaaatcatatagtaacagataagccaggcttgctatggctgtggttgcgatgcgccattttctctattatgtttccaacagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaaggtgagcctgcaatgaacacttgtcctggagatgctggaaaatcttggctgagttgggaaaattgatattgcggaaccttcaccttcttctcccaggatagagagcctagcagctagttcctcaaaaaggcattatttaaaataatatctaccatcttagttagatctattccaggaatctctgatccgaaatgaccccactggccactagggtggcttgaggaggagagtcgtgaatctgcattttagaaaggtctctggcgggcacgcccagcctcatgagcacgcctcccatgccgtcacacagggccctgtgcacagaagggcctcatgcttggtttaataaacatatgaaactatttttcttctgtttatttttttaacctactaccaaggcaaagaagaatgtatgaaaattttaatttgttttaaataagggtccccgtattttcattttgccccagacctcacaaattatgctgctgggcccacttgcgggaagaggctatgtcaaaggcaaataaagacggaacaaataccacaggcaaataactactcaacttgtggttatttcaatattataattaagaaggaatggcagcctgaatttgagccatggctgggataatgggggagatattttcgagatatgtggaaagtaaaaccagcaattcttatagagtgatcagccaagacatccaagtagagctgaatattagggtctagctcagaagagaccctgagctggggataaagatgggtgccatgaaatgtttaaagaggtgctgatttaaactgtggaaatggcgggatgtcctagaaaaaaaaaaaggaagctagaacataatagattatgagacctagatggaggaagaggaacccacagaagaggtcagaaagagccagaaaatgagactgcccaggagaaagctgtcaacagtgagagaggcagaaaagcctgagaggacacagaagaaaactctagaacttagagcctgggctgtcccctacttgtgtacagaggctaagaggcagcttgactggagggggttagcaggaagcataggccaccggttttctattttgctgtgttagcaaactaccacaaacataacagcttaaaacaatgccaatttcttatcccagcattgtgtcagtcagaaatcccagtgagcacaatggggttctttgttcagggtctcatgaaactgaaatcaaggtgtcagctgatggagctcttatctagaggctctggagaagaatcaacttccaagatcatttaagttgttggcagaattcagttccttgcagatgtaagactaaaatccccttcttcttcctggctgtcagccagtggtggctctcagctctagaagttgcgctcagatacttttacattggcccctgccatcagagacagtcccttccatcaaattcctattacacttcaaatctccctgacttctgctgctgctaccagcaggaggaaactgtgttgaatgggctcgtgtgattgggttaggcccacccagataatctccctcactttaggtcaactaatgaataactttaatacatctgcaaaatcccttttgccatttaacataacatcatcacaaagtaacactaggggtgaaggtcaggaggaccaccctagaattctgcctgccatggtgtcccagaagctacacatgggagcctcacccaagcacacaacctcttggggcttcatttgtttcccctctcctcaataaggacaggacaaagatatcacttgggattgcagaagtcaccaaatgatagataaggagtcatggccctcaaagatggggaaaaaacaggttaaagacatggaaaagaaccaggactgagaggtggggaatccggatcagataatagagcctattgccttctctcccccactgcccccaacctcctgcaaactcatcacctccctcctgctcagctgcaaaacttcccaactgttttttgttttgttttgtttttttgcttccactcttgccctacacaatctattctcccatagcattgagggtgatctttataaaagctagattcgatcgagtttgcacttgaaattaaacctaaatctctcaacacaaagtggcgtttgtctgttttccaacctcatgccacagcactcccactgcccagccagcctggattcctgcctgttcctaacactaggcaagctctttcccacccttggctttgacctttacatatgcagttttctctccctataaagtgttcttcccttctcttcaaataggctcatactcatcctacatatctcagatccccaatgctacctcagagaaaggccttccttgattacctaaagttattatctattatattaccattataggaatgattacttctataggttacatagattttacatcaattataaacatacagcatatatttcttttgtatatgcatatcatcttgattatttttataacccttatgacagcctacaattattttgtttattatttcttattagtccccccaactagactgcaggttctttgacagcagagatcatctctgctttatgcaccagacagcactctgcccttctctgagccacaatacgttcatctttaagcagaggatttttttttaattttactttaagtactgggatacatgtgcagaacatgcaggtttgttacataggtatacatgtgccacggtggtttgctgcacccatcaacccgtcacctaggttttaagccccacatgcattaggtacttgtcctaatgcactccctccccttgccccgccaccccctgacaggccctggtgtgtgatcttcccctccctgtgtccatgtgttctcatttttcaactcccacttatgagtgagaacatgcagtgtttggttttctgctcctgtgttagtttgctgagaatgatgacttccgtcttcatccatgtccctgcaaaggacatgaactcatccttttgtatggatgcatagtattccacagtgtatatgtgccacatcaatgccagtctatcattgatgggcatttgagttggttctacaccttcgctattgtaaatagttaagtagaggattattaacctgccttgtccacgtcaagagccattgtaaattataaaagagagaatgaagatgaaaccatttggtgaatggtaaggctcactaaaaacctaagtgaataccaagggttcatatggaagcttccagaaaacccagagtgcagtggagaggtgttacctgcagtggccattttggctgctcagatggaacactctatttctctctctctctctcatattttgcagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggtaacctcttccctcccaggtcacaccgagctgctgtgcttagcccttgcagaggcagtggctgagggaggaggtgtgcaggcttggatctcctctggagacctgatgggactcccagttgagcagctggggaccaaggcacgtgctttctcctgactcagttttccatctataaaatgggggcaagggcaacaataatgttgggtggactagactgatggttttcaaaacatgtacttcagtatcgcatagagagattaaagaaaaagaaatcttgtttcctgaactctacccctcacacagtgattcagtagacttgaggagggccttttcagctccagccttctccaagtctagggctagaatttggatgtgggtttctagcccagaatgtttcattatggtgctttgcctccttgtgggccccccatcagcaaagcccatgggtctcatgcccccatcccccaagtcagccagtcctggcccaaaccttgatcgagccattcaacctgcagtaactggtctgtaggaacccaaggaaggagagggtgaacatcagtgacaaaagatcgcagctgggcatgactaatctagttcataaactaaaactctggccctgcctgcattatcacatacactgctcagatgcgggagagtagagaagatcttaacaaaggagagtttgtctcagaaaaagtgtcagggataggcccaggcctgaagagcctgtcagatttagcctttcaaggagaggactcagaggcatatgatcacagtctttctaatgctttgaagaagggcctcgggaagaaagagcaatttgggtcatccttggtggcccaagaggacaaatgagtgaaaattacaggggcgcaaatttcagttaagtaggaatgcagtgttcatgtaatcagcagagtccgtgcctgaaaggttagggaggcattgagctccctgtcactgtgtccctgagctgccatgcttagccctcccaggggtggtggctgagggaggaaagatgcaggtagtggctgagggaggagggatgcaggtttggacctggtggggctcctagctgagcagtctgtttggcatctactgcggaggatattttaagagaagcatcagacaaggattggatttaatgacatttaacattcctcccaaccctgtgttttaatgaaatcatctggtcaaccatttcattctacaagtaaggacatggtggtccaagttggaaactgccctattcacggttccagaattagtctcttgcagggcttggaagatccatgcctccaatacccagttccatgttttattcaccttcatcaggccttgctttctagggactggccctttaaggtcagaattctcttttctcacctgctgttctttcatttgctcctcaccaggaaatgagtgcccagagctacagcctcctgtccatgggaaaatcgagccctcccaagccaagtatttcttcaaagaccaagtgctcgtcagctgtgacacaggctacaaagtgctgaaggtgcagagccttgcctgggaaaggggagtgaccaggccacagaaactctcgaaacctgcccctccccagggcagatgggctgccagaacttgtcatagttccagcacagaatttcctagctgcccatcaacttctcaaatgctccagaaattccaaagcatgcgtcccaggcggtctcacactctgaaagtggcacaaaagtttgttttttttttttttttaatcagagcatgagctggtttgaatttttaaaatatggatccatacagctctataatcaaggctgagaactgtaacaaagttcatcgggcttatagaggggagtggagtgggataccaggaaaggaagtaaacagtttaaaagtagcaaatggggctgagcatggtggctcatgcctgtaatcccagcactttgggaggcccaggcgggtggatcacctgatctcaggagtttgagaccagcctggcaaatatggcaaaaccctatctctactaaataatacaaaaaatagccaggtgtggtggcgggcgcctgtaatcccagctacttgggaggctgaggcaggagaatcacttgaatccaggaggcagaggttgcagtgagctgagatcacgcctttgcactccagcctgggtgacaagagcaaaactccatctcaaaaaataaaaaaaggaacagatgggttcccctcactctcccacccccagaagcagtagttctaggaatcacatggttcgctttaaaaaaatcacctcccagctctcacttgagatcagttaaagcagactttttggggctgggaccagtgattggtgcagccaagctagaggaccatcgctttcaaggaatggttctcaaagaggggtgttcagtttcagcatcaccgggaacttgttagaaatgcaaatgcttgggtaggccagcctcactgaatcagaaactctgggggagaagcccagcagcctatgttttaacaagctctctaggagatgctgaccgcttgccctggtttgagaagcactgctctgaaaaaggagtcaatgcttaccgttttcccttcagagatagttgcccaaaccccttcttgcacacagcccttgcccctctccagagtatgaaaaggaggtatgaattcagcatgtatctttcccctaccttcaagctcacccttggaagcccatgggtggaaaatctcagtcgagatcaagacacgtgtggagcttgagttggttttgctaggaaaaaacccctgacaccacccccacctccttcttcccactcccttcttcctgtctcttcccaggataatgtggagatggacacattccagattgagtgtctgaaggatgggacgtggagtaacaagattcccacctgtaaaagtaagaaagcctaatgggttgttataaagatactgagctccccagcactggcgggatccgagcagagcatgcaagggtgaaagcttggcaggagcactctaagggggatgggagcaggaatttaacagacacacaagggttgggaaaaaaaagagtatcagtgccccttttggcaataagatgtttgaatcccaaaagaaacttcttgtgggcccagtactttgttaaataccaattttacttcagcccacggatgggttgccagacttactaaaggaatagcacgtgtccaggttcaaaaccagctttggcaattgctaattcaggaaactagtttggtgctggtgcccagagctgagtgaccttgctagtcttcacatggccatcagccatatccccttcatcttctgagacagctcatgatttagggctgtgcaggaagggctgtgggatcagcacagtgggcctgcatgaagcagaggatacagctcttcactggctcctgggacccagagttcttgccttggctctgcccctaaccaactctgtgactgtgaataagacccttcgcctcaactataaaataaggagtttggactagctttatattttagaatatgtgccagtggttttaaaatgatatagtctatataaatcatctactgagctttgtaaaaatacaggcttccaaccccttcacctcaccaccaccccctgcaaccacccctcaacacccaggtgatttcaatgaaagacttataaggaccacagttttagaaacttattatggccaacattgatgagaggaggcacagtgacagaaatagtcagggaaggaagggagagagaagggagaatttgctttacaatggcttggtgaggtcaagaattagagcctggcatggtggctcacgctggtaatgccagcactttgggaggcagaagcaggtggatcacttgagttccggagtccgagaccagcctggccaacatggtgaaactcagtctctactaaaaatacaaaaattagccaggcatggtggcgcacgcctgtaatcccagctactcgggaggctgaggcgggagaattgctggaacccaggaggcggagattgcagtgagccgagatcgtgccactgcactccagcctgggtgacagagcaagactccatctcaaaaaagaaaaaacaaacaaacaaacaaaaacgaattagagttggtcccacccatcttcctttcatgaattttcatgcaaactggagcgctatcctcttccctttctcctacatggccttgattcagcaggcagacaaatctcctgccattgtcccaagggggacattcccttaacgcaaatcccaggaagaactttgaagtaaaatacgattgttcttttccttttcatatgatgaaatttttccttttcatatgatgtagctggagtcagagcctagcatggggaaggagggggcattttatgactttaacaaaatgtttcaaaaaatgttgactggatgcctgcacagagttccatagggaagtcggacggaaaagacaaggtccgggcatggcggaactcaagtggtggtggccacagccaccacctcctccaatctgaggctcgaggtgcagtgctgtgactgggttctaagcaaagcactctgcagaacaaagcaagggccatgttgaaggagaaggtaaaggaggatatggggtgtcctggatagaatcaggctttggaattaggaagttctagatacaaatgcagactctacaagctgacagtccctctcagctgtaatcagtgtattcagactctttggcctcagtttcctgccctcaagattgctgtggggattaactgggttaatatacataccatacccatggagggccagaaacatgcaaaagataaacggactcctcctgccccaacccaatcccctcactaggaagtggtttcatttctctcattcacatttttggaaagtaggaaacattaataatttttccctgacttacattagcatacaacagaacaccctgtcattttgtagtaaagagaaactgtttccctgatatgaccctattctcccaaaataggctggattaagactattagaattcccattcagtcatacccagcatctttgctcactctgtaggtatttattgagcatctctctgtacgaggcactgtgctaggtcctaggggagaggcaaggacaggactgaggagtcgagagtccccaggcttctggggcttacaagttctatgtttcttaaaattcgctgattaaaaattttaaaaagataggtatcacacctgaaagcagtggccccagctctgtgccatgggatatcacaggtcctaaacagtgatagagaaagggctggggagtggcagctggaatctctgcttccagacaagaggggtgcactctgtggtaaagaaacgtgcactagaaaagaagctgggaattatgggtcattgttctggccctgcctccaccttgctgtggtgaccccgggacaagccctgttctactctaaatgctgtcaagtgagggtttggaccagatgcaggcaaagctccctccaggggcagaattttataatcctcatgagccaggatgtatgactctgcaaattctcagaacgatacaaattccacaatcccaaactgttcttcacactggctgtacctaaactatgcattcttaatcaattctggtggagtaatttctgtatttcctgcataaactgtttctgctttgcttgctaatctctctctctttctcttcctctctctgcttccttcctctgtatctcttgatccctctttgatcttcaccatggtggcagaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatttttgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctacaacgtattaacagcattcatactcagtgacatacagggcatcagaatttaagaggaagatttgatatgtacccaaataattgtaatagctttgatgcagacaacattagatatattccatcaaagaaacatgagtgaagagttccagaacaaggaagcagccctgcccagttagaattagaaaggctttcaagaagaaggagtgtttcatcaggacttcagggtggccagagcatggacacagggtgccccgtgcagcagggatggcaccagagaggcctgggagcaggaggcagcaggggagcacactgaaggagctggtgttcggagggtgggtgcaccaaggggaggaaagaagatgaggccagggagggggctagagcccaaacccccaggcctgagtgccagggttagctgattgcacatcgttctctagaaagccccccagtacagcaaagcacacttggaactgtaggtcaagaaatgtgtgtctggagaaaaataagtggcaacaagaaattaccatggagatagggtgttgggcggtacctccaaggcaaggggaaagagaagggtgttttgattccagagtgcggaactggccagacaggactttagagaaaaggataaaacccttcctaaagcaaagagcataagtcaacggaggaagcagggtctagtgtgtgctgattgtgccagacagagctgctcaaggcctcttgtgaggggttaagtcacttccatgtcccagagaaacatggctttttccctgccactgtggacttgggaagaaagtacgcccctccacactgccaagaccctctaccttccactatttatcaccccctctacctagttgtagggccagctgtatcagtgggcaaagttacttctctgaagtgatgtgaaagtaggtcctccacccagaaaatatctatccgccagcatcagccacataacaggctcccaggggcccgtccatctagccacactaaagccaaccctggaattcctgaactgggcggtcaggtggaccaaagttaagggagatgagtgataccaatacctaggcaccaagtcaatggcattttctgaaaaaggaggaaaaatcggctttaacagaaaataaatttaaaactgttcatagtatttaaataataaatattattgcctcattatcctagtgttgagctgcacacatttacctcacaaagtagaagagcatctgtacttttggatcatcaaaacaaatggagatgatttgtccagggtgattggactagaggccaggacaaaaccagttgtcttgattggccttcttagtggataagaagtacctatatttactcccctccttcatcttttcctccaacccggagggacttgaaattatttgcattttgagtggactctctagctaatcaaaaagatgaatttggagtcctaaagttaaaatcacaatgtctaaatggcactcagggataaattatatctcactgtttcccaaaatgaccaggtaaaattcaggaggacatggaactttggaaattttaccagggctctggaaattctgacagttgatgtccaccattggccagctagtacctagaataggccatttaactggaaaacagatccttaagaaccactagttccatttactaaaacagccctgggtttgaggtcaaatcttgctctcattctgatagtaacttgctgtatgtccttagacgagtcaagtctcctctctgggctcatagataaaataaagaggacattctagattgcctacttcaggtttctttccagctgtgacattctatgattcatctatgattcttcgactctggcataggctgttatacctaagattaggatttccttaagaatgaaaagattgacaaatttgggtccagagcctctgatatggccatgaaaagatgccctgactctcagctgactcacgctgggctccatcagtgctgacaactcccctaagactgagctggactggaaagctccccaaagaccacctctgaggagcaggcatctttattcatgtcctgtactgggaattatggctcaaacatgcggccatcaacaattatagaaaatgaacaggggaagactgaaagctgatccacctccaaccctgcctcctggcttctatggccaagcaagctgcctgtagagaggcagcagggtggggctgtgtactcatacaggagctgggtttttttattttttgtgccaaactccaatgtgagcacattagctgctgttactcagcctaggattgggactagaagaacaaaagattatttagtttatgtcagctagagttttctcactaagccaagggcttcattcttgggcagaagaggcagagaggattgcacaataaaactagaagtaaaagaaagaggccctggtgggtaaaagactggagtctgcttaaacctcagtagaccttcccctacccaaaattgacactgggcaggtgagttgaccacacagtagtaccataatgaatggaagagacctcaaaagcaggaccatgggtagcttcacaggctgtacactgcacaccccaggggtgcccttcagaggcattataacattgctttctggaattgtgtgcagtgcacaacctgtacatctgcatgagacagatccatcagatagccaaaggaggatgagcaaaaggcagttgaggggtctcacttcttctctctcagttgtagactgtagagccccaggagagctggaacacgggctgatcaccttctctacaaggaacaacctcaccacatacaagtctgagatcaaatactcctgtcaggagccctattacaagatgctcaacaataacacaggtaagccatccatgctaagccatcccactcccgtttcacactctcggggcctcagggttggactgggggccgagacagctgtgaaaggaagaactgctcataagtgtgtagagcctgataatgcaaaacgtgtcactcacacatctcaggttctcacttttcatgagcttgtgttactgtgtccatgtggagatgcagaaacagtctcaaaaccaaaaagcaggcttttttgtttttaactttaaagctagcactgatttactaatgagttgttggtgggagcgtgaaggagtcacacactgacacaactaagagaagaaacgagaccctaaaggaagcctggaatcccccaagttaaactccttcatgtggtctgaggctgagttggggtttccaaaaaaaggccagtattactgcttcacccagactctgccttggcttctgggtgagggcaacatctcaccaggccagacccattcagcaggtaagggaccttccttcaaagacctcttcccctggtacggacaggggtccaggcagggttggggagcgaggagtggatcctctgtctccccaggtagcccagcatatcccctgaccacagctcaagcacagccacagcagtccctgtccaggccccatccatgccacctggcagagacccctggctgccccaggggctgggcagcagcacactggccagagggtgaaggaccagcaataacctgaccattggccacactgggggtttgggaggaactgggaggagaaatgcttagagacataacccgcctctccctgccttgtggcagcccaacacccgctcacatgcactcatagtccctagcagaaaaggaactctcagggagaaaggagggcccatcggctctgcctctctggcatgcaagcactgagaacattctcctgactcatctaagcctccaactcctctttgtttttgtttttgtttttgagacagggtctcactctgtcacccaggctggagtgcagtggtgtgatgtcggctcactgcaacctccacgtcctgggttcaagcaattctctcgcctcagcctcccaagcagctgtgattacagaagcttgccaccatgcccagctaatttttgtatttttagtagagacccgcttttgccatgttggtcaggctggtctcaaactcctgacctcaagtgatccgcccgcctcggcctcccaaagtgctgggattacaagcgtgagccactgcacctggccccaagtcctcatttttaaaagagggaagagttacaaagctcttagagctatttcaaaatgccagtgagatggtggccacaaatgtatgcttattaaagagtctgtcaaatggagaagaaaggaaagggcatctgtgcaacagggagccatgtgagcccaggtctttgtgacaagtgaggcggaggtgccttccaggacctgggcagcgtggggtggggaggggagcagccctcagccaggcaggagtgggattccccagagctttggacagacaccatgctgaagagtgtggtgtttatttttgggggtgacagcaagccattcgtgattctgagctgagaaaggacatggtcacattcccattttagaaagatccttcatgttgcaaagggagtttgatagaaggactaggatggtagccctgtgggtatttgaagatatttggaggttaattggtccctttggaggattgtatcccagagagtacctgccacattcttcctcattcttcttagtacatctaggctcagagacaatcgtatctgagcctagatgaccatttggaggactttgtaataactcactttagagaaattaaatacccagatctattttccatgtgttacaaatcaaccattttctccctcctctcctaacctctttcactaatccaggtatatatacctgttctgcccaaggagtctggatgaataaagtattggggagaagcctacccacctgccttccaggtacctcaccctccaaatcctttgcctcacagttttccatccaaggccctaggaccccaggttttctggctgttaacagggtgatgggggacaggggaggtgatgctttggttgctttttaagagatgtcttcaaaaggttaaaggtcagagaagacttgcttcacaccttctcaaaccagcctgtattttctgcctgctccatcactctgagagccctcctgtcccgtctctgtgcccttgccacaagatttttcatataacacagtttgcatgtgcatctgctgttgtgccggggaaatttaaaaagtgggcaccctgtcctcaagcactcaccatgctatcaaggagatgataacacaaacaacatcatgataagacagagtgacaaattctttcttccaaacagcaacgtagtcaagcctttccgattcccatggtttacttactgactccactttaaaatggaaagaaaattttgtggtaacaggaagtgttactgtgcatacagattttgaggatatttgctttagcattaaaagtataggccaagcgtggtggctcatgcctgtaatctcaacactttgggaggccaaggcgggtggatcatctgaagtcaggagttcaagaccagcctggtcaacacagtggaaccccatctatactaaaaatagaaaaaaaaattagccagtcgtggtggtgtgcatctgtaatcccagctactcaggaggctgagagaggagaattgcttgaacccagggggcagaggctacagtgagctgagattgcaccattgcactccagcctgggtgccagagctagactctgtcttgaaaaataaataaataaatagtatgggtgatttgcattgcaatcacatgtatagctattcaagtcaacttagaaaagtgtagccccaaaatgcacactctacggttaaacaaataatccacaaaaagttaaatttaatattcacaacatagtaatttacattttttttaaaaaaaagcaagaatggcagtagtttaatgatacaatcactcaagacagcattgaggaatactgaaaattaaatgccttgtctaattccatctgcatgtttgcacaaacagcaggaaatttgcaatatggttaagcattgggtgatatttgtattttgctgaatgagagtgttgggtaaactgacatagtgtattatattaatggtacatttcagtaaccctacagtatacagtataaagaaggtatactagtacacggttggtatattagtctgttctcacactgctgataaagacataacccaagactgggtaatttacacagaaaaagaggttataggattcacagttccacatggctggaggggcctcacaatcatggcggaaggtgaaaggcacatcttacacggtggcaggcaagagagaaatgagacatagccagtttgggacatagccaaaccatatcaggaggtttctagatatcagattagacactaaaatggaaaggctatggagttgtctaccattcatccttaagaagcgaagaacatgttagcatttgggagtcaggttttgaccatcacaggtgctatgggatcccagagaagaaggaagtaacaatgcctggttgtctatgaatgaaggggtaagaactgactaggaagggttcacataagaggtctttatttctgagaaaaacttatgaggatgtggaataagggaatgttcatcccacccattccgctgattccatttacctcaattaggcttgcccagaagtacaaccaaggactccaggcagtgaagcctcagagaagagaggaatggcggagctgtagaggaatggtggggctgtagcaaaccagaggatctaatccccatttggctaaaagaccatgtgagcaaaaaaaagctagggatagattccatgctagaaagccatgtggccacctctggaaggggaagaagccctgggcaaggagtcaaggccctaggtactaatactgatgctgccatttcctaactgtgatctttggtaagtattttcatatctctgggtctgggatcccatacctcagaagtaaagcatcagaaccaagagacctatgatattctgaccttttttttgagacagagtttcgctcttgttgcccaggctgcgtgcaatggtgcgatctcagctcactgcaatctctgcctcctgggttcaagcaattctcttgcctcagcctctcgagtagttgggattataggcatgcaccaccatgcctgactttttttttttttttttttaatttttagtagagacggggtttctctatgttggtcaggctggtctcgaactccccacctcaggtgatccgcccacctcagcttcccaaagtgctgggattacaggcatgagccatgcacccagctattctatgacttttaatggtcatcatcctctatgtttgtacaaagcatcttggatacaatgagtcatgacattcttttaacacccaatgttgggcagaaccatggtgtatcattggactaggccagaaatttgtaaattctctcttcgcaaaacactgtgattgaaccaggatgcaggccaggatggagaaggccatctcatctattgtcaaaaggcccaccatttcaggggtcctgctaagcaaatattacttgcccttttattttataaatgagaaaactatcagaatagtgtagtgatttgcacaaggctacttgtagaaagtcaggggcagaactgaaaggtgaactcaatacttttgatggcaacataagcaatgccgagccatttttttaccatgatcatgttttatgccatcctcaggaaccttgaatcctagagtatcacatttttttaaagaccctccctcagtaaccactgtcctctagaacccaaatctggcttcagcatagccaaagctataacatttcaagaagatccctttctcccaggaaagactgggtggggaatggcagcagccaataagaatgaccccatttcaatgagctctcccaagagcttgttgaatcattcagcctcttaaaaggacaagaacacatcaaggagaaaaacagatttcagtggagatatgaagctagactcaggataaataggttcgagttctggctttcccattaacaaccttgagtaagtcacttgccttctctgaacttccatgtttccatctgtaaattagctgttctccaaggtctctccagatctgatctgtgacctgcagtgtgccactggcaccttggttggagaaaggtaccgtttaatgctggctttgttgtgaccatggaccaagccatagacgtgtcccttaccagattagggccttgaagcactaaatatatgtaggaccagtcacagagctgcattgagatgttgccttgcagcttgctacttgtaattggaaggctgaccctcaactttgaaaggccaggccacagagagttacaaagaccagttcacatctggcctggggtgaatggcagggtgccccaggatcaagcaagaagcatctggcctcaggaagaagagcatctgaaaagcattaggttgctaaaagcctgctctcccaaagttgccaagaaaactcaaatgttccatgatgtctaaaggattgtcaaaagcacccaggccaaggagtgtagcctggccatttggaaccaggaggaggcccacactcatagtaggtctacctccaagacccaagcaccctgcctgggaagggccatgcaagcatgttcttagccagcgggggcctggtgccgaagaccttctgctcattggccagaggcatttggctacaggaggctggtggtgcatgtgcatgctcagggtgcaactcagtggaacgaagtttgctcagatctttctccttcccctaaaggtactacacagctcctgggtgcaatgatgggtggcccagagtagggtccatgcatcattgcttatagattatgccacctttccccaaccctggatgccctggggcttaatccatgggcatcaatttatagcaagattctgttaggacagagaagaaaaggtttgagggcctatgcccatggtcttaatatctgttaagtccgtgtgggatacaagacttagaatctagttaagcttctgctatctgacttaagagtcatatccttttgggctagtcacttaaactcaggaggtttactcacctagaaaatggtgatggccaaggcaaataaaatgaaaattaaaggatctctggaatttgaaggatccctggagatcattgtgaccaaatgcctcatttggcagatcaaaaattgaaatccagagagggatatttgctgactcagagttacatgggaaatggaagagaaaagccaggccaaggcttccagcatctttgttcccagtctagcgtttgctgtgacctgctagatggttttttaggttccttccatctctctgtccccatggacagaaaactttcagaagtattctaggttcccatagcatggaccacttctgaaataagacctgcctttctagagaaggaaggggagaagtgaccactactggaaatagatggctgtaaatggtctgggtcacaagtggtcttagccagaggtggttcagggtagagaaagcccaagcacagagtggtccagtccagagacagtcccagctacagaaaagccagactagagatgggccagcctagagagacttagacccaaaatgaccctgagtagagctctcccaggctagcatgacccaggcaggttagggtcccatggtggcataatctatagtgggtgaaatgtgaatttatctttgtggctcctgtcacatggctgacctgaccagtctctgtctcttgtccctgctccctctttctccttacagagtgtggtcagccctcccgctccctgccaagcctggtcaagaggatcattgggggccgaaatgctgagcccggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctacccagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgctgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccacttctccaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaacagccttggcttatgggttttgttattgttggggaagtgtgttcatttgttttaacttttttgaaaagaaattggtctcctcattaaaccaaaatctcccttgttgcagaaaaagtacaacttttggtatctggacattatccaagaggtaatgaggaaaggatttggttattgatctgtctccttctcagaggctacttgttccttcatttaagtgcctgccatttaagtccttgtcttcaaaggacttgagcctgaaggcccaaccccccacacgctgggcctggtgactggctagggcatctctagtcccaatgtgacattggacgagatcatcagcagtggcacatggaccttgtcagatgccctgcagtatgtcaagttacccgtggtgccacacgctgagagcaaaaccagctatgaatcctgctaaggcaactacagcatcatggagaacatgttctgtgccagctagtttctagtaccagtttcaaagtgttgaaactggcatgcaagacaagcttatgtgcatgtaggtcttatataggcaaaaggagttaaatgtaaaaggaacagagatttaagtactataggaacttaaagaaggggctatatcatacagctggaggggcttggaatagctttgcagaggcttcaaaggatgtgtgggagataggagggaaggggcagagtggaaaaaagcatgaaagctggccatggttaaagtgagagcagtgggcattgagtgggaagagttttaaagggcatgctctatttgaactgtcctgaaacgagtgattctctaagtttggggtatatgagaatcacttggggtgctggtgaaaaatgcagatggctgggtctcacccactggaaaatttgaattcagtatgtctgagggtgggcagcatggtgtggaaagtggacaggaaggggctgagctaggaaagcagttatgcaacttctgcaactgtcctgatgagggatggtgcagacccaccacccatagggctgtgacagtgcagacaggaggaggggcagtttaaatcgatttaagtggtacatacagcagggcttggcctataggcatctcttgataagttcaagcatgagtggcacgtgatagtgaagtctcaccatgggacgcactcatggttcgcctttgtttttggtttgtaccataatgaaaatgccatcctttttacactattgagaatgaaaataagagcttatttacgctttgcactttatggtttgaaggactatcgtgtctcatgttctattacatttccaatttttgtttttcttttgatacttggactttatgttgtgacatattgaggtactgaggtattgaggtactgaggtactgaggttgtgacatattgaggtacatagagagcactttgtgacatggagtcggggagacacatcactctccttctcctagggatttaccagcagctcagcgactgattgaacatggggttgaagaaaagggaggcaacaaggatgtgattgattcagacattagcagacatctggaaaaacaaaggggagaaggttagtgaagggtggatacttgggcttggattcactgagctggaagagtttatgagcaatccagctggaaatgtaagtaggcagtaaagaatggtgagttttagaggacagggcagatttaaagacactgatttgaagttcatcagcacatgggtagtatgatggcatagaggtagagggcatcatctacgggaaatttacagataagaaaaggataccaaggcctgaaacaccagcatcatggaaggcatgaagaaaagagaggccccaaggaaaaaaaaagggggtggggggaagggatcagaaacacagggagaaaagtgcttcagaagccaagaggaggagttgtaaagagggatgaagtagtcaacagcacccaatgctgctaagagtcccaataaaggactccaggatggaagttccctaagagaggaatcaagtctctatcatcatccctgaggggtatgcaggcaggaggctccatgtgtgagtttcaagtctctaggacttctctcttcctttgtcctctctctctcggtcctctctctgtactccctccttcctctctctccagccttctcagtctcccaggatgggcttttagctcttttctcagaggtaggaaactgcccatgcatcttccctaagccttatggtaaaaattacatgttcagttctccatgttttggttccttgaaacctacaaattttttattcttactatgaagcctgactcttcaaaatgaaagtccgtcttaccagactttggtttctgctttgctctttcaagtcaaagctttatccagcctttgcttaaaaccgtggatgctccagcttcaatggcttgggagccacagtgcacagcgaattcctagggatgcaaaatgtatctgataagattcaaaaaatagtatcctactctgtatgtagatatcatggttggagttccatttatggtctcagagacattttatttccatctatttgtagacctgttaaatattcaaatggctgcctatttccaagtttgtgcagtacatggcactttcttcttctgaatccggctccaaagggggaggaagaatgtgggaaaggagtgtcaactcgtcttttcagaagctttactatagaagggaggagaaggagagactgtggaatgaatggcaaacggggaaatggaagctgatttttaggatgaaaagtcttgactgtgttttggaggcatagaataaggagagatgaaaaatacaagagaggggtgacagtctccaaggccaggtctccaagagttcaaaagttaagagatccagagtgaaaaattagttctgaagacaataaagtttataggaagaagagatggtgaggaggatggttcccattcagtggggttcccactcagggagttcccactcattgggctctgagcgtctgttgggaatggaggcagggcattagcttggggaagctggctgtgggcatgtggaatgatgctgggagatgctgaggctgcatcaaggttgtggatgcagagcatttatctgtgatattctccagcctggtgacagctacaaaggtagcaggtgactgcctggatccaggggcttgggttatgagtgttctgggaagccacataattaaaagtttatggggctggccagagtaagaaaagcccagaattgggagtcaggagacctagaactatagtcttgctactaactcatggaataccttttggaagtcaatttccttctccaggccttggtttctttagctgaatgatgaaaagtatagaccagatggtctccgagggctattcagttgtaaagtgtgtatgtgggagcgtgtctgtcaatccaagccagtggaaaatgggatggagcaggcagacactgtggtggaggggatcttcaactccacaaggccctgaggaagggcttctctgaggagacaagattcatgtggctggagcataatgattctttattagctgtgactctttcatttgtaagtgacataaaccaaacataagcagcttaaggggaaaaaagggaatttataggcacacataactgaaaaggctgtaccaaaaggcttcacatataattagatcaaagggctcaactattagggtgcaatctctctgtctctttgtccctcaactttcagctccacttttcttcatcattctcagcagactcttaatgaagtgattgttggcagatctgggcttatggctaatagcttggcaattccagtagggaatgactttctcttctgtaatatgtttagcgaaattctcaagtaatgctttcattggtccagccaaggtcacattcccatctctgagcaattgctgtgaccagaaagtgcatggctttgatcagtcacattcctatccctgaaaccagaggtgaggtcaatccaactctagctgcatagactaagaataaggaaagtgcagcctccaaagaaagactgggatgctattatcaggaaggtcaattaatggtggaggagcaaaaataatagatgttcctaacagggtgaggagctgggagctctggcagtgggcaagatggagcccagagtctgatctgtctctccctccctcccttggatgcagtgtgtgggctccccaagttctcccggaagctgatggccaggatcttcaatggacgcccagcccagaaaggcaccactccctggattgccatgctgtcacacctgaatgggcagcccttctgcggaggctcccttctaggtagggagaaggtggaaggggtggaagctaaggaactgaaccccctccttggagactgaccaaggtttcttcattgagaatcattgtgcacactagcatcagggcacagaagcacagtgcggtagaaagagttctcggctagactggatcctggtctgtctctggcaccgggaaggacaaagtcagggagtctctcaaccatgaatttaacagtacatggaggtcaaagacagggcatgccagggctgtgagttcagggagagccaggaaactcacccttgggaatcagggaaggtcgatttacaaagaccttgaatgctatgcttaggaatttttatcttgtcttgaacgctgctttaggttgataagtatgctctggaaagttctctccagaggcagcaatgataaaaaggagggtgaaactggaggccaggagatcagtgagacatccattgcagtggtggggagagaaggcatagcctcagagtaagaacagggtatgatggatggaaataaggaggcagattcgataacactgggaaataggactgtcacctttgtaatggaatgtgggtgggagtgggagcaagaatgagaacagccgatggctctccctgacacagtttggtccaggcaatctaagatctattccagttctgatgtcaaaagaaaactgaatagcaatctaggctatctagaccacttctgcatcggatcccacccccaaggaagaaggcccggcttggcccatctctgcatgagcaactcccaggctgatgggcatgcctctcactctgccccaccctcctccagatccaaccaggggtggacagctctggggcagggatccctttggcaaggcatcaggtctgggctagagctgcagccaaagcaccagggctacataaatccctactctgcaaggaatttatccttacattctctcagacccaaagatgaatggtctcactcaaagaagtcccccagagaggtaaagagagtgagggaaggtattatagggccagacagggctgagggcagttcagtgggagcagagtcggggagaggaccaagggagagaagggaagggagacagaggaccagaattagaaagacaacaatggagaggacagagagagacagagaacactgagagatacctggaaaataagatagaggattgaagagagtaaagagaaaaatgaaagggaacaatacaacaagaggaggaggtactggcgggcacaagatacccaggagagaagaagccagggaaggagggacctgaagggaagttggagagaagcagagtggtgtggaggaagagctgccagcgagggcagagggagggaagactctgcttcaccagacagctccgattttgttagagggcaagtaagagagatggattgtgtgcacctaattttaagaatgaattcattttcttaaaccttgattttttttttttttttttgagacggagtctcattctgtcaccaggatggagtacagtggtgcaatctcggctcactgcaacctccgcctctcgggttcaagccattctcctgcctcagcctcccgagtagctaggacaaaccttgaatttttgagtccactaatgtccaccatgtattgtgattcattgtatgtttattccctatgacttatgtttgaaaaatgtttgacgttcacttctctaccctcggccaagctggaatgccctcatacttcgcactccctgcagcaaccctgatctatcatttctgtctccctcctgtcattcagtcttaaagagcaggggaaggataggagagggcagaagaaacaggaaagcagccaagggacagaggaaggggaaagcacctcattaatgcccacactgacacctgggtagagggatctgcagagctgggaggccaagccatgtctctgaactggccagtgtacacccctgggttcatctaaacagcccagagccccagaccaaggcaggctgtcctaacctgggtacctcagcccacctgatccacctggaaaatctggtcctggacatgggcagggatcaaaaaatgccccagggcagagaagagtggcctaagtagagccctggccaggacccaggagcacatagctgcttctcagagggccaagtggagcctggaacctgctctgagactaagcacttctgccctcgaccctgaactttgacctgatactcagcctcccccacccctgtgttctagagcttttctttctgcttggctcatcttggatatgtctctgggctcagccacttatgggcttgtcatctgctccacataagaggtgaatggaagcctgaccctgcattaaacgaagggcagatgcctgtccatccagagaaagatgacagctgagacacaggaaatgcattaagctgactatcaggagccctggggtctggccctggccctgaccctgaaaccaacctgctgggtgaccctggacatctctgctttctccacgcctcagggttcctgcctatataatgaaaggtctagatcagagcagtgattctccaccctggcagcagtagaattaactaaggaaatgtttaaaacattatctgtgcttgggctccacccccatgacataaatggtctagatataggtccagacactgatttactcttttttcattcaccaggtaattctaacgtgcagccagtgtaggtagcttcggattcatcaattttaaactttaatatgcatacaaattactggagagtcttgttaaaatgaaaattctgattcagtggatcagaggtggggccggcctaagagtcttcatttctaagaagcctccaagtgatgctaatgttgctggtccaggcaccacactttgagaagcaaggcctgagaaggcagccagttgaccacaggctttctgtgcacccaccttgggctctctggctctcaccaatgccatgggcttaaaggatccctgaaatcctgtttacaatgttcagtcctggccttggttggaataggcaggtaaaaatcacagatttaaatcctcatcttcagattaggatcatatgagcatttgagttgggggccataaaatacaatggagagaagcatggccattttcaaggtcttgaggggtcctctggagtagcctgaagatcctcagctcaagacagagggaggcaagacccagtagtgcaggacgatgagacgtgtgttctgttccccaggctccagctggatcgtgaccgccgcacactgcctccaccagtcactcgatccggaagatccgaccctacgtgattcagacttgctcagcccttctgacttcaaaatcatcctgggtgagtgagtgaggggcaagctgactcccaaagccagctgtggttctgggaatgacctactggccctttccaaggcgtgtctgctcactcactcgctcactcatttgtcagggcaggacacctgggatggaggtccaggaacctgagtccaagtgcaagatatgattctccagacacgtgaccatgagaaggcattgaagtctatgcttcagtttcacaacgataaaatgaggaggcctctagataatttccaaagacctgttagatttccatgaacctgtggtttcaaatagatcatacatatacgatccagatttcccctcttgtttataaaatcagatgaccagctgattcaattcaggtccacacatatttacctactgacattatgccaggatctaaggacacagtatgattaagacctagtttctgcccacagggagcttacagtctaataaaggaataagatgtgagcacagagacctctaacggaaagtagccagcagtaagttttgtagaagaagaacagataaaatgccatgggagttcagaggggaaagacttctaacccaagagtctgagaggctacctggaggaggtcatgtttgacacaggcactgaaggtgatgatagggattgaacatgtggcagcaggcatcagaacaagcattacaaggcaacagcatcagttcctgaagaaagacagaggtggggacccatgagattatgtagagaatgaccaatagggtgggatgtctgggaaaggtggatgaaggcagtgaaagggctaaggctggaagcaagggctggatggggctggggcgggggctgacagggaacaaggtgtgaccttatcctccattgcacccatgcctcacatgtcttcttcttgcccaggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggtactttcccctacctccacctctgcagggcagctggtgcctccacaaggagtccgtcttcacgttggtgaagctctggtgccaattaagtcagctgacagtgtctgcttgactcaccaactgcttcccctcaaacagccaagtcagaactgggtccaaggcagcaaaagttgtgggaagcacatagtaaacagtcagacctaagggtccagatagaaaaacaaaaactagactagttatcgtaacagagagaatttaatatagggcactggaggattggagaagtaagagggaagagctgagatcatagagatggtacctgcaggaagaaaccaccaaccctagggctggggaaacaaaggtaagaacctggagttagaaattagaagcttggaaaaggggccctatggggccagaacctgaacctctgcagaagagtctaacgtgctaaggaaaacagctggaaacaatggccactactggggtgaaaaaccactgccagggatgatgccaacagccaaagcaagtcttcctgcctttctgaaagtgccccctgttttcaggaaaccagctagcaaagtagaactgcccacttcagagtctcatccctagtaccacaaagcagaatgtagaagggtaagtctcaagctgggggacaatggcttaatactcagcacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaatactcagcacaggctcaaacaccactgtgaccatttcccagctgggtgatcttcaggaagttatttaacctcagtaagcctcaatccccttacctctaaactggagatgctatcccatgtggtggctgtggcatttccgtgtttgagataatacttaaacataggtgacccatgtcagctggcttccttttcattctaatttcagtggtgccacatcaagttcacttcctttagctcaaaagaaaaatggctgagatgtaatctgaggagtatttaggggaactgagccaacaggaaaggcacaggtgtagctggctttgactcattgggtgccatgtgcccaccaggtgctttatgttcattaacttatttacgaaccatgcaagccttgcaaggtggcactgtagcctcatttacaaacgagaaaactaaggatcagcagggtgaggtgactcacccgagatgcagcttgtatgaagcagatctagggatatagtacaggttttctgactttaagcccaacactgttttcagtatccaggctctttttcaaatgagaaaataattgctctgtcagtgctcaacccacttccacattgccccacagatttaccaacttcatagacttctagaatgtcaactctgaaaggggttttagagaataccaagtccagcctcctcattttatggataggaaaacagaggcttagaaggggagcagagaggagggctggctaaaggcaccatagcacatagtggactaggctgggctttttatttattcgctgttcttgattgagcacctactatgtgacagcattgctataggcactgtgatatagcagtgaccaagaatgagattctgctctcatggaccctaggtttcagactagttgagggtgggacagaatagaaaactaaacaagtaagccagtaacacatcatagaaaccagtgcccctagctctgctgcaggtaatctgtagcccagctgcctttcacgtcttcctccccaccacaccacctttctctgagaagaacaatccagtctttcctccacagaagaggatgatggagctgcaagctgcacccctccaaacaccccacagatagcttctctgttctcacagtatcttctctcctccaggagccatggtcatcgtcagcggctgggggaagcagttcttgcaaaggttcccagagaccctgatggaggtgaagttcactttataacctacagacagtgacacctcagctctgcactgggccttcctgctccgtattgttcccttagggattttgaggcttgggtgggggttggtgagtgggaaactaggagcccagacccacctccaaagttcaatgggactttgaaccccagaaagcttgatttgtttgttctacatgtcatggactctagcctctaaacacggttaagtttttctggtagcttattaaaggcttagcttatgaaaattctcccagaaaacagcaagtttagacacccccatggtgacaatccagctgtgcaccatgagaactgtacaccaaattggccagaatgagccaggctcttgagaaccacagtccttgcagtaatgaacttggcagttacacttagaagttcatattcctatcagttcaaggaaaaaaaaaaaaaacacttaactaaaagtaaggagccatagtttcaagtcttggctcccactaacttgctgggtcatctgaagcaagttattttgcctctctagaccataagatactatttccaactgcagagttatggggcaacacgagctgccatcaaagagttgcttggctctgatatcaccggggcctatgactgacacagctagtttctaaattcttccacatatattattttgacatattttaaaatttgggatttgcaacaaccattcatcccttcattcactaactcccgggggtctatttggtgtttccttggtaccagacactgtactagctactagctgtgctggggtaaaaggatagatctggtccctggcccccttgggctcatggtcaagtggaatggacagaaagtagttatggatgtgataaaggtggagagagagaaatgcaggatgctccagaacatatgaaagagaatctgatcttgtctcaggggttcaggaggcattcccaaaggaagtgatgctgaaatgatacctgaacgatgaatcaggtgctcagcagttgctgaggatctgtcctcaggaccaccctgccctggcttcctctccccttatccagggaaggccatgacccaagagggatctgaatggcctctggtttcctcccagcaagggcaacaggagttgtccatttagagaatatggcccattcagttcttgatttgactgaaagagaatcatatgtttcctctttttattccagacatctactccaacagttacccccacactggatcaagggcaataatagtcacaatgccttatttttatgtatcgattttgctgcattgcaaaaaatatatatattttctgggtatctactaagctccaagcaatgtaagatagaaatgcataaaatacagatccagcatcgagacagatgctcatactgtagagagggaggacaacataacaaagtgcttgctgcaaagccagcagtgataactccacagtagctaatatttatacagtgtgtgtagtttacaaagcacttgttcctgcctctcctctttgtacaatgattagtatatcaaatactgcaacctccatttttcagatgaggaaaaagggtctcagagtctgaaaaacaatgagtaagccacatgttctaggtcctacagtaggggtgagacaaaagaaaaccaaacttcatttttgtatacattgtcctattgactaatacatctcctaggcaagtattattacctctatcttactgaagagagatctgaggcccagagagggcatgtgacttgcccaagttcacacagccaaggtcttcacagccaagactgccctagaacacgggcctcctgattctccattcaactgttccttcacctgtagcatggggcagtctcttagatcaagtctaaggtagacacaggtccgtccaggtatggagtggagaggagccgtcttcaggggtgtcagaatagcagaggcttctcagccggggatgaggaccaataacagctttgtgttctagattgaaatcccgattgttgaccacagcacctgccagaaggcttatgccccgctgaagaagaaagtgaccagggacatgatctgtgctggggagaaggaaggtgggttaagaggctggcatacaacaggggcgctgccagccagggagtggtgcagagccagcaagggagcacagaggcctcccaacctggtgggctggcagtgtgggggcgcgggggactggaggaaggccgtgggaggagggattccacaggagaagatgcatcggagaaaagatatttacaggatgctcatcattcccttcccaagttcagtgtttcccttaagaaagaggccttggccgggcacggtggttcatgcctgtaatcccagcactttgggaggccgaggcgggtggatcacctgaggtcgggagttcgagaccagtcttgctaacatggcgaaatcccatctttactaaaaatacaaaaattagccgggcatggtggcaggtgcctgtagtcccagctactcgggaggctgaggagggagaatcacttgaacccaggaggtagaggttgctgtgagccgagatcgtgccactgcactctagcctgggtgtgacagagcgagactccatctcaaaaaaaaaaaaaaaaagaaagaaaaaagaaaaagaaaagaaaagaaagaaagaggtctgaatcagggctttttagaatcatttgagctctgatgcggcctgacctagaactgcccagagctgaggtttgggtccaacggtctgctatgccctctagtgcccaattctctgaactacaacccatacatgggagaaggagacttgggctgggaaggggcattttatcttcatctatgtctctttttcacctagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtaactaggaacatgcactagatgacagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcaaagctctgacgatctaagatacaatgaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattctggtatgaaggttttgggggaggagatatcaatcaagaaggcttcccagaagaggtgactggaccagagccttgtccacaggtaagacggaggaggccttccacatggagggagaacaatagtaaatgtccactcaagatgtcctttattataccagctcctcccacaaaaacacatgtccagtggactctttttctgggatcagaaccaacaccaaaaagagcttttctccttaaagttagaattctaaacaggacttgaaatggcctcaaggtttgtgcacaaatactgacttctggctggacccagcttattctgtttatttctccaattgcaatttcatccttatcctgagaaaatgtctaaataggccatggaacccaggcttccccgtgacctacaagcacttattagctgtgccagctcctgcactgctgctaaggtccaagaaacccagatctctcacagagccatagaagcagagggctggagtatctgtgaggacaacaaccttgtctaacttcgcgacctcattcttgagcatttctactgatgagaaactcactacccccaattgcagctcattcaactttaaaattgctgctttttgaatcactgattgtgaatattaatttaaaaaaataagtaagaaaatgttttaaatgtgctgcctcttt

SEQ ID NO: 12010 - DNA, 23757 bp, Human
tcagcctcctgggtagctgggattacaggcacccgccaccacacccagctaatttttgtatttttagtagagagaagattttaccatgttggccaggctggtctcgaactcctcacctcaggtaatccacccacttgggcctcccaaagtgctaggattacaggcgtgaactatcatgccagggctatatgtctgtgctttctaaacccaataaatgtgatgtaatattaatgctaacagcacacgtgatgggccagaaacatttctataagcccagcggctctgggcataaatttctagggatggtgaaccgaagaaacaaaattgtgtcattgaaatcagcttttcccaaccaccagtgtcttctctctctctctctttctctctcagtgttcacttattaatggctactctgtgccaagcactgttgctaaacacattatgtacaatttctcatttcattggtactgattttgacacttactcatccactgtcttttatcatgatgtgaccatttcctacaaaatgccctatgtagcttccaaccaaaataccacaaagcacaacttcagcagtcctgcctcttgaccttctcccaggctctgctctcgctcatctgttccatcctttgcattggcagaagacccatctttctaaatgcttactctcttggagcatgtaatttctttcctaggaatcaccattctcagctgcctgactccaagaatcgttctcagttttatcttctgatgctcctagacctcagcaccttattccagcctaacacatctggcaactcactgttcccagagctattcaacatgccttccacctcagggctttacttggcctgtaatgccctcttcctctctttctgccaaagtagcttaatgattaggaatataattctgaagtccaaccatgggcaaagccagctcctctgctgacttggtggatgaccttgaactaaatttcttcccttctcagagcctccaatggacagtaaaactaataacaacacctccctaccttagaggttgttgtataattaaatgagataatatacataaagtgcatggtgcagtatctggtacatagtaaagatcaataacctgatgttatcattgttgtcgtcactattattatttcagaccttggtttctccccactctttcatgaagcccttatctaaccactccaggtcaaaatcatctctcttttctttgaattaacttacttttcctatcactgatttgatgactaggatttattgccttaagctttacatcattcctttccgattttatttccccatctcaggtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaaaaaaaattaaataagcctccgtctccttttatctcctagcagtaggcagtaatttaataaataaaggagccccgttagcgttttccctgtccattctttcccaggcacggtgacctagacagcagcaaaaagcgagttaatagggaggggttatgtaggaagcaaaagtcaaggaatgtggctacagctgattacaggaactgagaaagtggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacagggggtgagtgaggagggtcggggtcaggggcaggagaaactggaaagcggggaaaggaggagcaggaagaggaggggtgggagaagggaagagacggcttgcctaaccgttgctaacagctgccacttttaataggcgctacccggtgtgctaagtgggcgttttacaggtgttaccttgtttatttcagcacactctccacctagggaggtattgataccaccatttgattggtggaaaactgagactcagagaggttaagtgacttacccaagcttacacagctactaagtggcagagctggaaaggttttctgatccagagccagacttctgaacatactgtgcatagtgtctaagggaagggcagagggatgcgggggctggaagagggccagtggggtggtgaggaaggaaagaaaaaggaaagtatatggatactttctaagagaccccagcattgatgggaaggggctgaagctgctccctctctccttgtagctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtgagcaacttcctgtcccggggtggaatggggcccctgggcccagattgaagctcaaaagtaagttctccgcagcagggggagtcttgattgtgactacgcgtgcccctctgcaagtgactggataccagcaacagtgaaggttatctgtgtccatgtatctatttctaggactgcctgaggatgcataacacggcaccagcgcccactgctgcctcaagcatgtgacagtgtggaaataataatcttgttgtcattcttgcatatgtccttgtcctatactcagttgccccaaatacgcagcttgaatgaacccattagccaagggaagacttacttactgaatccttgtcgacatggaaaagaaggggtgttctataatccctgggagtcttcagaggggtatacggtgttacctgttttaatatctaatcatagtttcaaaaggtagcagtagcttgtgtttatggagtactttttaatgcatcaggcacttttctaaacatttcacatttattaatcctcttaatacttaaaactattctatgatatgggtaatatgattactcccactttatagatgaggaaaccgagtcagagcaactatgttcaacttaccgaggtttatgtaaccaacaattagcatggctggacttcagagctgctcagtctaagtccacggtccataggtccagactcttctaagaccaccgccattttaactgctacatattgggcacttatgtgccaagaaggagacgctgatcacattcaattctgcaaaattcctctatgggtgtttttattaactccccttccccccaatttctgttgaggtccttgaggctcaggttagtagagtcactttgcttgaggtcacacatctggttagtgaaagactcaagaatcactcctaggtgtgacagttaactcttaaggtctgtgcgctccaagctgggtcttacaatgtccctccttttcccctgaatttctggatcgccaaataatctggccgtttaacactcctttgagaatatctagctttccccaacttatactcatccaaccgagatggcattcatactacctgccaacagcggttccctaggggggtagaacccaaggctttgaaactagatgacagctgaatctgctcagtgacttggtgattcacttcctcatctgtaaaatgaggttgatgatgcctattttttgatgatcagctgagatgaataacagagagaggagtgcagaggatggtttttactagcgaggcataattttcaaccttcgctgtgtatcggaatcacctgggctgtctgggtctcactcctggaagagatacagactgggttaatctaagggtggtatctgagcatcttcacgaagctttccacatgtgcagcaggaacggagagccactaagagtttcatggccgttgtccagatgtcaattggcaaccttctctctctagttccttcttaatttggtgttttgagaatcctagggcaagaaaagaaaatgggcagttcttgagggctcaccatgtgctagatgtttccagatatgcgagtgcatttaatcctcacaataaccctctgaatggctggcattatcttttttacaggtgaggaaaccagtgcttaaagattaaagtgtttgttcaaagttgcatatctcgtaagtggaggaatcggatccaggtctgacgccaaacccatgctgtttgtaggatgctataaaacttcctaagctaatattttagaactgtttcttctaatttatgcagtggacaggggttccccttgctcactgtctctcctttcctccaaggtcatggatggaaatgtcataactgcaaagagaacagctgcagtttctgccattgccaccaaggtaagatgaatggctggctgtaccattaaggtgagctgtcaagtggggtctggtgtctcaatcttgagagactaaaggagaagtggggaacttattttggtttcctgttggacatagctggaactccagatgtcagatatatcagtaattcacaaaattattagctaccaattagtgtgcatgaccagatttcaagtaccttatgtgcataattctcaatcttcccatcagtcttgaagaatcgaaatgagaaattctctccaccttccaggtcaaggaatatggctcagagagcttctgtgaattgcccaggatcacacagctaataagtgctagagtaagaatttaatacttgacctctctggcttccaggactggcttcttgtccctgtaccacattgcccctggtaagacagtataattgtcccatagaccaaagctagtactacacaagaggctgagtgaactgaacatatccaagccagatccctgtattcattcgacaagtattgactgggcttctataatgtgtcaggcactgttctaaatgttagggaaatggcagtgagaaaaacagaggggcacacacaggggaggtagacaataccaataaaaaggaaaacacaggctgggtacagtggctcacgcctgtaatcccaacattttgggaggctgaggcaggcgtatcacttgaggtcaggagttggagaccagcctggtcaacatggtgaaacctcgtctcttgtaaaaacacaaaaattagctggtcgtggtggtgggcgcctataatctcagctacccgggagagtgaggcaggagaaacgtttgaactcaggaggcggaggttgcaatgagcccagatcgagccactgcactctagcctgggcaacagagtgagtgtcttaaaaaacaaaacaaaaaggaaacaaaacaaaacaaacaaaaacatcttttgagtttaataatgtgttaaatagtaataaataatatgtaattaaataattagtacatattaataaatgattaatagcgtgcttagaatttgctaaaaaataaaaccaacaataatccaaaaagccacataacatgttaggtgaagataaagcagaagtgagagtattggagaagctgtcacattttacattatccaagaaaggcctccctgagaaggtgacatttgagtcaaagctgaaagcagtgagttagcgaaccatgcaaaaacacggaggggcactccaggcagagggaacagtaagcaatgggggtgatgatgttcccaagcaatgtcaaggcatcctataagaaaaacagcatttttaaaagttagagttaagaggatgaggcttaggaaacagggtgtctgtgggaacgattggagtctggagtctttcacattaaatgtggaagtacaaggtcttgggacactggttttcctaagttattataaaggaaacgtggtaacccagggaaagttgcagcagcaaagaccaggtgttcaggttgcatgtcgaggttttctagatacctgctggggagggaagaatgggaggattaatctggtaattgtatgcaaagggagtagaccaacagcacccacctcaatgaactggtttttagttatatccagacctgactcaactgaagtaatcaaggactccttgctatgtttgctggtaatttgggaacagaatgaatcttgtattactgtcatttgcaaagagctttagtctttttcaaactcatttccagccccttgtctggactacgagtttctgtgaggaaggcagagaaggtattaatggcctcattttacgcataaaagaatagaaacttgggtttcctgaagtcatacaaccaggttcctgcgggtccttttgaggccacatggtcttgtcccagataagaagtttccaacagaagcaagctatgcagcagcattagctagggaagtttttaaaaactcaaattcccatgcctactgaatcaaaatcacagagtgaggatcaaccaggtctggaaaccacacttttgtagacccagcctgcaataacactgctttgttgcattaataaaaatctgtgctcccagaagaatcaagaagccttgggttgacacttcaaagtttagacacttcaaagtttaggctgaaacttcacagctttatttccaggggctcagatgaactgtttcaataaggaacaaagggtctattttacttgttgccttgagagtagaatattttcttgtccatcatttctcttttatttagggctcttgttggggagaataagtatatggagctctagggtctgatgaacataatacattttttgtgcttgggtctcacataagcttcattgaagcctctgatatgttttctcaaggtgatagtatatattagggtttagcactgacatacatttattcaacaaatatttgagtgtccaccaaatgcaaggttctacgctcagcatggggtaagcaaaaccagatacagtacttgccctcatgtagtacagggtccagtgggggaggcaagatatagtccaaagatcacatcaataggctgggcgcagtggctcacgcctgcaatcccagcactttgggaggctgaggcaggcagattacctgaggtcaggagttcaagaccagcctgaccaacatggaaaaaccccatctgtactaaaaaaaaaaaaaaaaaaaaaaaaaaaattagctgggcatggtggcaggtgcctgtaatcccagctacttgggaggctgaggcaagggaattgcttgaatcctggaggcggaggttgcagtgagccaagatcacaccactgcactccagcctggacaacgagtgagactcagtctccaaaaaaaaaaaaaaattcacaccaataaatatgaaactacaacgctgacaagtgctgtaagagtgtaaagcagtatgtcttgatctagcctgtggctgtgtctctgtaggggatatttgagctgagattgaaggataatcagttacttgtgagggggagaggggacaaagcagcctagcattgtatggcaaggaattaattcatgcaaaggccctgtggttgaaggaagtacatgagcttgggaagctgcaaggaagccagtatggctggaagacaggaagtgcaggggaacatggcatggtggtatgagagacagctttagagataggagggccagaccatgcaaggccttggcaaatgcaaatgaaacagactttcagactctttaaatgagaaacccagcagattcatatacgtgtacttaataacctgcatgcttaggagaaaagattgaagtgccactaatgctgtttaataaatcttataaacatatgattaaaaatcggctgggtgcagtggcttacacctgtaatcccagcacttttggaggccgaggcaggtggatcacttgaggtcaggagttcgagaccagcctggccaacatggcgaaaccccatctttaccaaaaaaaaaaaaaaaaattagccaagtatggtggcacatacctgtaatcccagctactcgggaggctgaggcatgagaatcgcttgaacccaggaagcagaggttgcagtgagctgagatcacaccgctgcattccagcctgggcgacaaagcgagactgtctcggaaaaaaaaaaaaatttaaaaaatatcaattatcacactattaccagggcaacaaattatcaagtaagacaaccaattagaattacacatttagtttaggaagttgaaggttatttttatgggatactgtaacaatttctgaagctcacctgtactttcaagaatagattcatattaactgagaacagaagaaaatggtaacaattaaggaaaaaaatctaattatccttatcagacagcaacataagatttctagtcttgtggatattatcattttgaaaccttttcaaatcagagatgttaaactatattttatggcacagaatggtatctctccttcggtagctgcaggagataaaattaattcctaatatttcagagatgctgttttgctagtaattagtagttaagaagacttttcactttttaaatattatactccagaattccagtgagtagcattttataaaagaacagaccacagggaactcaaagtttactaaatggaatagagaaaaggcagaagagggttttatttaatacatatggtgtcgagggccaagtgatgtctttcctctatgccagtggttctccactgagcatgagtttgccacctgctccagagacatttaggagtgtgcagacgtttttagttcccacaacttgaaggggtggaaaatgctactaacatctaatggatagaaaccagagatactgttgcacatcctataatacacaggttggtgcccctccccaataaagaattgtccagcccaaatgttagtagtaccgaggttgagaagcccagtgctacctcttgtaggtcatagtaggtatgtaccagttctgtgcaaataagactacctctgtcctcatggggcttaaagacctgtagaagaaaatctacaaacaaataagtgctatggcctggtgcattctatcaaggaggtcagaaaggcttcattggagaggtggcactggacgtgagttgatcacagaatcctgctctcaaacacagacaccctcaggagatgccacaaatgctaattctacattcgtctttagaggaagacagaggcagtgaaaagatcaacagagttggcccagtgaatatagctagaaccctgggaaggaagggctcacagaatccaggcagctcttagaagcagctcagagctctgagaagtgggtatggctgagcatgtacctgagatatgaagaaaggacatgggctttggagtatggaagacgtgactttagagccacactgtgcccttcaatagttgtaagacctggctaggtgcggtggctcacgtctgtaatcccagtactttgggaggccgaggtgcacagatcacctgaggtcaggagtttgagaccagcctggccaacatggtgaaaccccatctctattgaaaatacaaaaattagctgggtgttgtggcgcacacctataatcccagctccacggggggctgaggtaggataatcactggaacccaggaggcagaggttgcaatgagccaagatcgtgccactgcactccagcctaggcgacagagcgagactccgtctcaaaaaaaaagaaaagaaagaaggaaagaaaaagaaataaataaataattttaaaaagtagttgtaagacccagagcaagttcacctttctgttaccagggcaacctcagtctcttcatctgtaagaagaagatagtaggagtccccaactcgtagggccaatgtctagactaaatgagatcatgggggcaaagcattggcatacattagctgttcagtgaagccttcttccttcttttcccacttgatacgggggaaactagacacaaaaggaaattctcttgattgcctgcaagctcttgagggaggcagaagagagggcagaagtcacctgatactcaaaccatcttagttttttacccgtctgctagggtctcccttgacctttgccacttcatttctctcatatagtttctgaaacctcccagcagtgaagtgctgtgcatccttggggctggggtccaggcctacagccattatgagatcttcacagagcagttctcctttaaggaggtaagtccaggggtgggggtgggagagaagagggaagggggtggtccttgacctgtctatactgcttcactgcaccacaggttattctgaaataattaagttgtgagccccatctagaccattcttgtatcttcatgacttcccagaagccctgatggaggggatggaggataagagtcaggggaagatctgattacctgtttccagtcctcagttcagagggcatttgtctgaggatacagcaagcttactcggttaaaagattctattatatctcttgtatacattcagttgtccttttagctcctgtctattatgtttttcttaggagaatccagagtttttaagtattcaaggttgtggatcaagaaactgggtgggatgagacctggagaccaggaggccacagcctctctcttttgcagtctccatactggtccaccttccccccactgcgtctcatgcttccccctgggaatttttgatgctattgttattttatgtgtgtgtatgaaagggatggagcagttttaaagtatgatttaatgatgaaaataaaaccactgccttgagaaatatagactattaggtgagtgcaaaagtaattgcagttttggccatgactttttttttttttttttttttgaaatggagtctcgcgctgtcgcccaggctgcagtgcagtggcataatctcggctcactgcaacctccatctcctgggttcaagtgattcttgggcctcagcctcccaagtagcttggattataggcgcccactaccacacctggctaatttttgtatttttagtagagatggggtttcaccatgttggccaggctagtctggaacttctgacctcaggtgatccacctgccttgtcctcccaaagttctgggattacaggcgtgaaccactgcgcccagttgccattacttttaatacaaggaagaaaacaaaagaaaaatgccctttcatctgttttcaaagacagttaatgttttctgatcttccctcttcagctttttataacatagctttagtcacgttagatatgcaccattttatatcctctcttactgaatgttctaacatcacttttcaggttatctaatttttgcataaaatttgcatagtcttctatcaagaagggtgaagaggttaaccatgcacttccggccgggcaaaatgtcctgtttttcaccttgcttggtgaacttgcttagacataaagtttgtttccgtatgtattatatttccttatgagaaattctgtaggccttattttcagttgacgggtgacaagcccttgacccaaacattgaaacctgtcaagcaagtcggcaagtccccagctcctggtgaggccgctgccccaccctccaaccccagcacctttcaggattccagccgtagctaccattcttggccttttcattggctatgccatttaccttcaaactcgtctgatcttgaatttcctaagtattcttcaccgatcaagttattccatgaaaaacattatcataaataatccttcatatgaatctcccacccattacaactcctttacggggtctcagacataaagtgtgagttccacacagactttgccagttatatttccattttacagatgtggaaactaaggctgaatgacatgaagcaatttcaggaaatagcagagtggagattggttccaagcctacctggctccagaacttgctctgctaatcattatgctattaatatataatagctatgaagttactgaggctgtgcctcttggcctagaagtgaaatacttccactcattttaaaaggggaaagtggtagagaacgctgattttcaaatacctggctaggtgtctaagttaatgctgtacccctgatcaaatgtccattctccatggggaatgatttaggagtgatttagataaccactgacccctatgccagagtagttcaactttccctccgcatccctgggctcagtgtaacataagcagccaaaaaatggcgccaatatccttcttgttactcccaatgaaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatggtaagtagagtggctccataaggcatgatgggtggtggccaggctcctctctagacgggaccagtcgactacatttgcagagccagtttattcatgcagaatgcccaagctatttaagggccttgaaaacatgtgagattgaaaaaaacaatatttggctgggtgcagtggctcatgcctgtaatcccagcactttgggagactgaggcaggtggattgcttgaggccaggagtttaagattaacctggtcaacatggcaaaaccccgtctctactaaaaatacaaaagttagccaggcatggtggcttgcacctgtagtcccagctactcatgaggctgaggcatgagaatggcttgaacccaggaggcagaggttgcagtgagccaagattgtgccactgcactttagcctgggcaacagagagagactctgtcttaaaaaacaaacaaacaatatttgctccaaaaaatgtaaaagggaaattacaaacctgaaactaaagaatatttaatgttctataaaatgtaagttttttttctttttttgggacagggtctcactctgtcgctcaggctggagtgcagtggcgagatctcagctcactgcaacctctgcctcctgggttcaagcgattctcccacttcagcctcccgagtagctgggactacaggcatgtgccaccatgcccagctaattttttgtaatttttggtagagacaaggtttcaccatgttggccaggctggtctcgaactcctggcctcaagcactctacccacttcagcctcccaaagtgctgtgactgattacaagtatgagccactacgcctgaccataacatgtaaaattatggcaaatggtaattcacagctcaattctaaaatgtgatgaaatttaaatcagaaaggccaaatgagtcactttttcttaacactaagaattataaacctttaaatttcttttgtactgtaattttttatgtgacatgtatatgctttttaatatgtgtgataggatgaggggcaggagagggggctctagacatgagggtgcctggggcctctgtagaccttcagatggccctgggtgttatagcaagagctggtctacatctaatactactgcaggtgctgtcatgaattctttgtataattctttgtatattaaatgacattattctatgtataatgtcatttaatacttataaccaacttatgaggcaggaactattatcataaacattttatagggggatgaaccaaggcatggagaaattatataacttttccaaagtcacaagtttttgtttgtttgtttgtttgtttgtttgagatggagtctcactctgtcacccaggctggagtgcagtggcatgatctcagctcactgcaacctccacctcccatgttaagtgactctcctgcctcagcctgccgagtagctgagattacagacacacgccaccatgccagctaatttttttgtatttttagtagagatggggtttcaccacattgtccaggctggtctcgaactcctgacctcaaatgatccacccgcctcagcctcccaaagtgctgggattacaggcgtgagccactgtgccaagcccaaaatcagaggttcttgatggcagagctgggatttgaacggaggcactctatcctcagagtccaagctttaaatgatactcatgattgccttccaacaggaagactggattctggtgagcagagcaggcaaattttagaggatttaaagatggtcttggtgccctgtgttttagtgacaagcacatggtgtgaactcagaagctaagagctttgcacacgtgggcagatgagccggcgagagccaagtcaaatgatgacgcattcaatcatacatgctgactgaatctctaccgtgtgccaggcactattctagatgccagggatgccacaataaccaggcagtcaaggtcactggtttcatggtggttaatttcagtgaggagagatagacaacaaacaaacacatagaggaactagatcgttctggctaaagatgagaccggaaagaacaaggccctgggtgatagaggctggtggtggaggtggaaggtagaagcagagagaggtgttttcaatagggttatctgagaagctctctaagatgtgttttttgagctgtgacctgaatgaggaggaagagcagccatgccaagagctgaaggaaaggcattcagggtagagggcacagcagatgcaaaggccttgagtgtggaagcgaacatggcgtgtttgaggaatggatcaaagtaatttgaaagtctcaggctgcatgggactggtggtcagactgggtccagggaatgggtaagaggtaagtcagggctgagtttatggacaataagaccatttctggaaggacctgggaaatcaaaaggaaccagttcatggtgaaatgggtttccaaggctgcatcttcagaaagatggacttgatttttttttcagcttaaaacaacacattattatcatctcacagttcccgtggttcaggagactgggtgtgggtagctggatcctctgtgcaaagtctcacaaaaaagaaattgggcaacatccgggctgcaatctcatctcatgctcgggggtcctcttccaggctcccatggtgtggcaggattcagttccttacactggaggatggggggagcccctttccttggggccattctcagctcccagagatgacccaaatttcccaccatatggactctccatcctcacatccagccacagacaatctcccttatgttggatccctctctcacttggaatcattctccaggaagggctgacttgattttgagtcaaggcatctcttctgttttcctggcccagggacaaaattggtttatgtgttcacagaggcaacacatacatttaagaaaaatgtgtcacaagcgcagacaacagggaaataccaacaacagattttacttagtttacagctcagcggagggacaggcccagttccaccctgccccatgcctccctcctcctgcccccacaccctgtcaagcctgtctgcgaccctcactcatttagccccatcacaaccaagccagagccttgtttgagtcaggcctctctctctttactgcctggcccacctccatccgcctgagtgacctcacacaaccctttgagaactcgcccggctcataagcagtggttgtgcaggggaaatagtccagtgagaaggagtggcctgagaaacgggggttttgttcccaccagcttatgatttatttacaagcttccttagctagtgcttttgttctatagaactctccgcacaaacaaccttcaagatggacatttttacacaactctctttggaaattagaatgagggagaacagaacgggagggaacaaagggagaaaacggggcggcagtggaagaaggcatataaatgctgtcttatatttgtataaggctttatagcagttttcaaagactagccagccaggggctggatccagccagcagatgtgtttggtttggaccatagagtaatctaaaactcaaggagtgacatatgcaaatagatttcctgtttctcttctaagaaaacaactggggcatatctggtaacagtggatctacattcacacgtggtaatgattagctggagctgaacaatgactgtccccttcggaagggcctgctggcttccccgcccctcagtctccaccacatctaatccagtccctctgaccagctttgttcattttcattacctccctggccttgcaggcatttggtggcagcctctgcattctcctgtgtcctggtgccagggggcgtgacaccttggattcatcattctggtcctggactccatagaggatgtgacagttcagggccaggacggagccagttttctttctgacgagacttctccatgaccctgacactgagtttttgttgttgttgttttttttcttttgtcatgagttaagagagaaccgggggtgaggagagggaaaggggcatagtggcaggcgtctgtggtcccaacagtttgggaggctgaggcgggaggatcacttgagctcaggagtttgaggctgtggtgagtttttgtttgtttgttttttgagatggagtctcactctgtcgcctggtttggagcacagtggcgcagtcttggctcgctgcaacctccaactcccaggttcaagagattctcctgcctcagcctcccaggtagctgggattacaggcgtgtgctaccatgcccagataatttttgtatttcagtagagacagggtttcaccatgttggccaggctggtcttgaactcctgacctcaagtgaaccacccacctcagccttccagagtgttaggattacaggcatgagccactgcacccagcctgtggtgagttctgattgcaccactacactccagcctgggcaacagagtgagaccctctctccaaaaagaaaaaaatagatattaaaagaactggttgagggtgaggaatgggaatgatggagatcaagaggagagtgaggtgtgaataagcaccaagtgatgtctctgtttcgggatttttgtgaggaaggtgttcctgttaagcagaagaggtgtgagcgcctaggtgctctctcagacctggattcacccatcagatccttaaccttggcaaacaccttcacttctttgagcctccattcgtgcatctgttaagtgagaaccagactttgaaatgtacttgcgagaaccataaatagtacgtgcaaaacatcccacagagagtagacaccctgtaaatgaatgctatgtcgtctcaaaatcttttagcaatgaggtgggatatagaatagaaaggcaaaatggtaggtagttttttttgtttgtttgtttgtttttttgagatggagcctcactctgttgcccaggctggagtgcagtggcatgatcttggctcactgcaacctccgcctcccaggtttaagcaattctcatgcctcagcctccagagtagcaaagactacaggtgtgagccaccacgcctggataattttttgtatttttagtagacacagggtttcaccatgttggccaggctagtctcaaactcctggcttcaagtgatctgcctgcctcagcctcccaaagtgctgggattacaggtgtgagccaccacacctggcctatttcttaataagtatttcgtcctactgattgggagagcatggcctggggaatgagggggtattttgaatctgagtgtgttcacgagtcctttgttcacctctctcctgtgctttgggcttcttagcagcctttggcactaatcctgggcttaaggtctgttttgctgtctcttagctgttggagccagcagacctgactggagagaactggatgatgagctcatgaaagaagctgtgctgtacgtggattcccaggaggctgccctgaaggagtctggagatgtcctgctgtcaggggtgaggcccttctgaccccagtcagggctgccacctggctggcctcacctggatcccagggtttcattaacctcccttccagtttggtctgctccagacctcagccaccccacctccttgtaggggaaggagctcctaaacattttgcaaccctctttaattccattccagaaaaatatgggcattatgggtggtgacatgtgtgttcctggaaggagaagctcagtggattttatttttttgctgggctgtcctctaaagaagtgggattggaagcttcttgcagcctggaaaccttcccaatgtggccaacatgataagactgtgttgcccaccttctggcctcattttacggttataatcagcataaaacaagaagggagctgctggcatgcatgttcagataacagcatgtctatttcctcactgacacaatgatcttggcaggacagctccctgagcaccaactcgaatctctgtgtttatggtatcacaaaagcaaatgccaccccaaaaggatttcggggccagcctcctccctaatatcattcagtgtacaaaggatctctctcttttttttttttttttttaatcaaatttatctcttatccaattcaggaattccctgggctggcttcaaaagccaaccctgcacagactttagcttcatgcctgggtcagcgtatgtttgtttcctaggccgagatctttgctgagctgggagaagtgattaagggagtgaaaccagcccactgtgagaagaccacggtgttcaagtctttgggtaagatccattgctccctgggcacaaatccaactagcgcacaaggcaggttcacccattggtggaaagagcaatgagtcaccagactctgcagctgaatcattgtgctccatcattcaggtcaattatttacatggtttagcctagtgctaagcccatgaactctggaactgagcagtcctgggtcagagtcccttccccgccactcagaggcaggtgtccttaggcaagtgatctgacctctgtaggcctcagtttcctcaccacctgttaccattgaggattaggtgggatttgcatataaaatgaatcagttcggtgcagatcttgatgaaattcagaaggtacccttcagaggtggagggggcaggggacaaagatgttaaaagacaggaaccttaagggaaatggcagagacccaacctgaaagagtcagatggaaagtatagcctaagccctgttcattccctccttccctactctcccacttgctgctttgaggagggcttccatggggagccccctaccacctgagttgtatggggtaccttatagaagcccaacaaagggtgggctcccagtggccagtctgtcccttgccccaggtcctcttccaccctatgagattgaaggaaacagaagtacatgggaacaggctgagctcggtggctcacgcctgtaatcccagcactttgggaggccaaggtgggcagatcacttgagctaaggagtttgagaccagcctggccaacatggtgaaactccatctctactaaaaatacaaaaattagccaggcgtggtggtgcacatctgcaatcccagctacttgggaggttgaggcaggagaatcacttgaacccggaaggtggaggttgtagtgagctgacatcatgcactccagcctgggcaacagagcaagactccatctcaaaaaataaataaataaagtacatgggaacagagctgatacacctaaaacactgaaatactcccaaactggttggtaaacagttgctatcctgagcccctcgagagtgccctctgtccccctctcatgaccttccatacttcgtgatcaagcagcaaaagagtaaatgcctggcagagcatcaggagcgctctggccacccagagcccatgccattggttaagtatccatgccttgcaggttggtaaatgtctttaaaatctctcatgcactggaagacaaaggcaatacaattttatctggagcctggttcaaagacatcacatggatccagttttgtctgaaaacttcaaaggtcatggcagatcagaggtcagccagcccctacttaaggagccaaaatgctgcagaaacttgttctgtcctttttggcaatttttgctttcttacttttggggatcagtttattggtgcattgtttcatctaacagatgcgtatcaagcacctaattatctgtgctgggtgcagaggttaaggtatctaccaaaattacaagacaaaggggagatatcaaaggatgcagcattcaaactggaccaagcgtcagaaaactacagtcctggggccagacctgctctgctgcctgcttttgtgtggcctatgagctagaaatggtttttagattttcaaatgaatggggggagaaaatatttcatgatgtctgaaaatgatacaaaattcaagcttcagtcccatcaataatttcactggaacacagcccacagccaggctcttttgtttacctgttggctgtgttttctactctaaaggcagagttgaataattgtaatagagaccctgtggcccacaaagcctaaaggatttactgtctgaccctttttgaaaagtttgttcaggccaggcgtggtggctcatgcctgtaagcccagcactttgggaggccgaggtgggcggatcgcctgaggtcaggagtttgaaactagcctggtcaacatggtgaaaccctgtctctactaaaaatacaaaaaaaaaaaaaattagccaggcatggtggcatgcacctgtaatcccagctactcaggaggctgaggcaggagaatcacttgatcctgggaggcagagtttgcagtgagccaaaatcgcgccactgcacttcagcctgggcaacagagcgagactccatctcgaaaaaaaaaaaaattaaaaaaaaaaatttgctcagccctgagctagatttagaaagatgcacaatttgttggtgggtgtttcttactatcatattctctgcccctttgcagacaattgaagcctgagctcatctctgggtatcagtccctgttattccaataggcattggcaacatggacatgtatcaggaaacttccagccatggggcctgggttgtttcaagaaaagttgttttgaccaaaggcgaaccaaatttctgtctattctaggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtgtttgcttcggtaacttctattactatcacaaggaaactgagagggatcagatgctcccatttactccctgggggagctacactggctataatgaaacttcttttttatgtatttatttagtagttacaactcacatactctaagatccactagtttaaactatacaattcagtagtgtttttttttttttttttttggatggagtttcactcttgttgcccaggctggagtgcgatggcatgatctcggctcactgcaacctctgcctcctgggttcaagtgattctcctgccttagcctcacgagtagctgagattacaggtgccacgccaccacactcagctaatttttgtatttttagtagagacggggtttcaccatgttggccagactggtcttgaactcctgacctcaggtgatctgcccgcctcggcctcccaaagtgctgggattacaggcgtgagccacggctcccggccaagcctggtcatttcttacaagtgaaattctactatatgtagtcttttgtgcctgactccttaatgcttagaggaaaaatggaatttctgtatagatcagggctcctttggtcataagtggtagagactacaactcaaactaccttaagctgaatgaatggagaatgagatttattggctctcgtaattaggaacacacaggtaactggtttcagctacagctgtattcaggggctccaactgtcaccagggcctggtcttcttccccgttggctccattatcaagttctccctggtagtggcaggacattggtcagcagctcctgaattgtattctgtcctctttagcaactgagcataaatattctcttcctttacagttagatgttccagaactgagagttactggaccatctaggtcacatgtctattcctgagcctaacattgtggctgaaagacatggaatagacggggtgaggtggttcatgcctgtaatcccagcattttgggaggctgaagcaggaggattgcttgagcccaggagttcgagaccagcctgggcaacatagcaagaccccatcttttaaagagatggaataccctggccaggctcaagccttgtacctatccctgaaccatcacgttgtccagggggatcagatgctctggttatccaggcctggatcacatgcccacccttgaagtcagaagtgtcatctgcgcatctgcccacatgagctgatggagggaaggtgtctcttaacaaaaagaggactgggtagttgaaaggcaaaatctaaagatgtccactacagtatccatgttaaaagggccattaaggatcagctagtcgatcttcaacttacggatggggaaactgaggtgcagagatactttctccaggccccctgaatcactagcagaaccgtgttgtccttgtcctgccaaaggccctgtccaaatcccactccgaccctagcctcaccccaccccttcgctttttgctactccaaggctggttttcagataagtcagcagcaaagcatggctctgttttcctgaccatactcctcctgggaaggactcatgctccagatggtttagccaaaagtttatcatatttgccagactgtctggacaggggtctttgtgctgaaacaaaatacccacattacccacatgatctgattctgcatatctcaagtgactatggagtctttctgaggaatcctgatggtcactaccctaaaggatatatagagaagagcatggaatgatgagaatattcatatatcttttctttcattcttttcgcaagagcccctatcataaccctgtgctagcttactaagatacaacagaaaagtagtcctcagccccagagaacacagcctcgaagagaagacagatgttaaaaaaaaaaaattacaataatttggtgttacaggaacatggttcagggtccctgcaggaaatgcagatgttccttgacttatgatgcagtcgtgtcccaataaatt

SEQ ID NO: 12011 - DNA, 64626 bp, Human
ctacttatcttttcctttcgtagcacttattgctacctgaaattactttgtttatgcatttgtttacctgtgcattacttgcttctcactttagaaggtaagctccaccagtgagcaactggtgtatgtcttcctcataacacatccccagtacctagcacagtgtctggctcatagcaaatgatgaattgttgtgagttaaacaaatgtgaatacagttgggaaaaacaaagccacaagagccaaaaagatacgttcgagaggtaggtagaagggtatcatttcctggaagatggcttcccagaaactttgggattatcttgtataacctcctcagtccacaagtggggaaattgaggcccagttacaggacactgagagaaaaactgttgtgggttcccaggcaattgggatcagatgtcacaagctgtctagcagatgaggtccagagaaggccacagccacctccctgaggccatcactataagtctgcagccaccaccagccctaaccccacatggggaagaggtgcctctttgggagcagaggtgctagtcagctgacaaactgtgaaggcagggctgtggagggtggagaggcccattcctgagacaaccagctattctgagacagttagggataatggttggtactgaaagaacctggcctcctcaccctcgttccagtgctcacacctctgtcccaccagaggtgagactaatacttgaactcctttcagcaactcttagacgcttcagcttttatcagggcctgcaaaggagaggttgatcatcagatggagccctgtccactgggggctcccagtctgatggaggagacagactgaggtcctcaggttactgactgatagtgtctgggttggagggagttaaacagagaggagacccctagaggaaaggatccctgaattagttcaatcggcatacagaaattatccagtccatgaggtgacagtaagagaagtaactgccagtgtaaagggagggaggcaacacagctaagttccaggaattgtttgcagtcttgtgggtggaatcttccggaatttgagaagagagtggcagaataggaggctggaaaggagggtttggccaaattatggaggactctgaatgtcaagtgaagagtttgggctatctttggtgcataaagaggtccatgggagatttttgaccatagggagaccatgatgagctctgcatggtagaaagtgctttgtggctgttttggggaggtagctcgggcaaggagagcaggggtgggaggcagatagaaggaaaaaaaaaacactgtattttggacgcacagctcttggcaggactcctgtaggaggaaggaattgggccttggtctcttgagagctagtatcctcacttctcagactcctgcgccatgcccttcctagggtccaactttcattcacttcttccgaactccaagtttgaatagaaagtgttgctgaaaccctaatttaaaacgaggggtcagagcaaaagagacttcagctcccagaatgcttggctctacagctctgcaggtcgcgcatggttcttttcaagaaaggggggccagctgggtgaagtgtgggaaacctgggtaccgccatcttaacttgggtcaaaccaactgttcacctaatgggaggttcgtgttctctctgttgtcacttgttaacactattgaaataaaatgcgcttaactattgcaagtctccttattctgctttgcgttggggattccttccattttgcaccctaggccagaactgaatccctaaggttacaataggacatcccagcatggccgcattcagagagattcctctgggggcggagtcggaagctgtctcgccccgcctcctggtaggagggggtttccgcttccggcagcagcggctgcagcctcgctctggtccctgcggctggcggccgagccgtgtgtctcctcctccatcgccgccatattgtctgtgtgagcagaggggagagcggccgccgccgctgccgcttccaccacaggtacctagggagcagccaggcgaggtcgttggcgggtggggtgggcccaggatagggcagcggagcgcggccgaccctcacgcttccagcagactcctgagcggcccgtcgccttcccctgcccccaccttcacacataaaccaagcgaggcccctgcagcccatcggggaggcccaggggccacccctcagggcggagggcgaggtttgggggcagaggccgatgtgagggtgggaaccggctgccggagtccagcttattgcagaggagaggactgaactgggtggggactaggggacaacttggaggagggggtcgtcagagggggaagggaacttgaggggtggggccgcaggggggtgctgggggagggtgcggagggagtggtgcctgctgggtagtgtgcagtgaaccctcccgcgaaactgggcagctggagtaggggccttcttagggtccctctgggcggggctgagcttcccacctgcagagtgggtgcgaggtggagagaaccccaggcggggttgctggggcgaaagggggaagggaccaagacgtggggcagaacgtctggagttggagttaaggactagttaggagcctggatagaaaaagaggtatggagagaaagcttggctaagggtatacatatgttggtgaccttttgaaagagtaggacttttcaattttgtttttcgttgtgtgttttttgcagtgttggaacattgctagattaagcaggtgatgggtggagcttctgtagtttgttttggggaagcagagtcagggtcaggagaagttgcatcttggctattgctttgtgtggaggaaagagttttgaaaagaaggtggcaaattatttgggaagacttgattacttttcagctgtttaattctacgagaatgggacatggggagaggaaatgaaaactaagaagagaggccgggcgtgtggctcacgcctgtaatcccagcactctgggaggccgaggcgggtggatcacgaggtcaggagttcgagaccagcctgaccaacacggtgaaaccccgtctgtactaaaaatgcaaatatcagccgggcttggtggcgcgcgcctgtaatcccagctactcgggaggctaaggcaggagaatcgcttgaacctgggaggcggaggtggcagtgagctgagatccgccactgcactccagcctgggcgacagagcgagactccgcctcaaaaagaaaaaagaaaactaagaagggaagatttttccaagaattggagacttcattccatctgaggagtgcagtgtaggcccagtggttaaaaaccagactgcctaggttctcaaatatcagggccattgctacttagctgtgtgacctaaactctctaagcctcagttttcccgtctgtaaaagggggatgatggtattttctagcttgtgagtttacggagaagagtaaataagacaatttgtgtcaagtgcttactacagtgtctggcaggtagtaagtgtagtaagtagcttttacctgtcactgtaaagggactagctggtatatttggggctcttctgttctaagtaaaatttatagtcaagaatttgactgtagacagggctttagagtagtatctttgtagttgttgtagggttttgttgtaagtcatttggctttactggcttggtggacctggggctgaaagtccagtaccaatactagttctcctccgtggtattctcaaaagttcacctgcagtcttagcagggcatgtttttgtccttctgtgactttgaaatacttggctttggtttgctattgcgggagggtgtatgacttgaagaaagaatgcaagattggaaatttgcttagattgattaatcaactgattatacagttaggtccccgtgaggtgacttttctttaaaaataaaaaaaagcctagttatgtactcctttgtggaatacagagaagagaaatacacatttaaggaggagcatgggttagtttctaagtagttatgggtgaagtgccttgcaatttgaggatgaaacaggtggcaactccttttccatactgcgcgtccttttcctactcactcatccagagtgagtccttgtttttactattgtctctatctctgaacatacatctttgtgtcacataagtaaagacatatgtatgtatgtatatatactttacttcacataagtaaaatatatacatctttacttcacactctgttaaagaaagggatgattttctttaggaagtgagtttaaacccttccataggacttggatttgtagtaggcagaattacatctccctcttcccaaggtgccataccttgatccccagaatctgtagctatcctgtgttacatggcaaaaggaacttggcaggtgtaattaaggttaagaatcttaaaatagaaaaattatcctggattttctgggtgggccgaatctagtcacttaagtccttaaaagcagagaactttctccaactgggatcagagaaatgggcagaaaaggaaatcagagatttgaagcatgagaaggactccatttgcctttgctagagaggaccacatggaaagtttatcagaaggaatgtgggcagcctctagtggcaaagaccagtccctggctgacaaccagaaagaaatggggacctcagttgtgcaaccagaaggaacctgaatttggtcaacaacctgattgagcttggaagtgaatttcccagtttccaccaaggaatgcaaccttgagacaccttgatttttggcctcgtgagaccctaagcaaaagacctagctagccaagcccacccaacttctgacctacaataactgtgagataacaaatttgtgttatttttagctactacatttgtggtaatttgttatggcagcagtagaacactagtatagattttggtaccaggagtggggtactattacctaaaaatgaaagtggcagtagataaaggttagaattgttttgaggggcatgatagaaaaggcctggaacacaggaggatcgcttgagcccaggaagtcaaggctgcagtgagcggtaatggcaccactgcactccagcctgggtggcagagtgagaccctgtcaaaaaagaaaaggcctaggacatacttttagtagcaatatggatgttaatgactctgctagtgagggcccagacagaagtgaggtctttcttattggaaactggcagaaaggggatccttgttacatagtagcaactaagtttagcagaattgtatcctatggttatatggaaagccaaatttgcaagtgatgaacttgtatatttagctgagatttccaagcaaagtattaaatgtgcagcctggtttatttgtgaatgtgaactttaatggagtggacccatgtggaatacttccacagcccattaggttcttgagaattttatgccaacataaacagttctagtttggattgaaagagacagaaagtaatagggctgttggaccccccaaattctactgataggaagcaggctgataaaactactcacatgtgaatgtgttgcttttcataaaagaatcagggtgactcagacggagataggagagcccagaggggtggagctaaaagctggagaggatttttcccaggctttgaaatggaatggagattccctagattttgaaactgctttggaccggaggctctgttttcttttacattttgcccatttgaactggaatgtctaactgttattctctacatgtctcacagtggtatgttgggagtagagaacttgtttctttaggaattgtgccccaggaattggacttactgttttgtccccagaacctcatccacacctgaatagatgaatgagatttgggacttctgaaatgataagctttagatgggaaacctttgggaccttgggatgggatggatgtattttgcatttgagagagagatgaatccttggaaaccagaaggcagactgcggtaagcagaatggctcccctacgatttccatactataaaccctggaacatgaatatgttaagtagatttaattaaagttaaggatcttaggtagattatcttggattttctgggtgggtttattctactcacataagcacttaaaagcagagaactttttctggctggtgtcagagatgaggcagaaggggaagtcaaatttgaagcatgagaaggactcagcctgccgttactggaggggaccagattgaaagtgtgagacggggaatgcaggcagcctctagtaggaaaggccagtcccagctgacaaccagcaaggaagtgggaactcagtcctacagctgcaaggaactaaattcagccaatagcttgaatgaatgtggaagcaaattttccccagagtttccagcagggaacccacccactggataccctcatttagcccttgtgagacccagtcaagcccactgacttctgtaagataatccatttgtgttgttttgtttgtgataatttgttatgacacaatggaaaacaaatacaggggttttgctggttttattttagagtctttgggatatcattttctagagaacaaagatagcaaagattctataaaacaatttagtcctggaagactccacggaataatggtgttgagtggaacctgtgcctgtttcttgatgtttgaatattattattgtccttagatgcagtttgaaggggcttgatggtcagcttagtgagatgtagtttctgaaggtctaggacattggtaggatttctgtaaataggtggttcttccatatcttggataaatgacataatttcttcattagtttttattggcttaataatgggtttctatgacagccttttaaggcttatttcatatttttttagaggagatggaaatgggtgatacatttttgtgaatttgtaactgtctctctgttctctcacacctcccaccccaccccagctcagctcaaacttgtaagatcttttctccctgtcattgtctgttgaggttgttgagtttaagagtcagatctgggaatcatcactacagaatggagtttctagcttttaagaaaagtcttttctttttgttctttaaagtatcctattaattggattcataaaatatggactaactaaactttagtcagaggatgaaggaagtgagaccatttcttttgagttattacctgaatagaaagatgattacaagattagcatttcagggtatgaaagactttagaggttatgtttgactttgggtttagagtaagggaaattgggccacatgaatgttaactggtctactaagatatctcagccctagagctagtctagaatcctggtccagccaatagagaatcatgacttttgaactatgttccctgagtacccttttctactgttggccgggcatggtggctcacacctgtaatcccagttctttgagaggccgaggtgggcagatgacttgaggtcaggacaagaccagcctggccaacatggtaaaaccccatctctactaaaattagctgagtgtggaggcgcgtgcctgtggtcccagctactcaggaggctgagaatcacttgaacctgggagacggaggttggttgcagtgagtcaagatcacgccactgcactccagcctgggggacagagcaagactccgtctcaaaaaaaaaaaaaaaagatgttaactgtctataatattcaactatatgacaacttttgcataaatattacagtatgatttgtacaagttcagaaactgaaaaccaatatgatttgccattgaattaggtaagggcttagtattttaaggtaataaataatgtgatacttgatttgaaatgagaaactgggttttgatctgtcacaattcgtgggtaacctggataaggtttgtttcatgagagtattaatgtgttcttatacctgaatttctttgaacttctgaaatggataatttcgaaagtagcatgtcatttagtttatagagaaatctaggccagccagcttttcaaatgaagaaattcctctaggattattaaggaaaagtagctgctgtcattgtaacaaaggatgtattttcattgggttatagacaattggtagttttcttacgttgagtgctcccagatgtactttttttttttcacatgtagaagtcaaagattgagtcttttaaaaagtttaaggtgaaagcattcacagtatcacaagatactgctaagagtggcattttaactggtttctacaaattctgtctttcagtcttagacattaaaaaaccctacgtagcaacagttgctatggtcggcaagcttctttacattcgtggtgataatgttttcttgcatagaaaatattgtgttatctgaggtgacagttttagggttaaataccaaggtacaagttagattaatgttttataattttttatgtgtgacatcttaaatgcccttatattggctgctcttttctttttatactttcttgtcttgtgggtttttctgacaggtttttattagctgaaacattttaatttgcttggaaaagtgaacatttgaaattttcctgaagttatgactaatgctttaatgggcatttctcagtttagctatctcatcaatgttctataaattttaagaaagctaccctgtttaaaatgaatgggtaaattattttccaaaaaatggtatcatgtcatatccagaaatacgagatggtcattttgggttattgaattcataaccactcagaagatgttgttcattcagcagatcctgagcgcctgccacgtttctggcaggcgttgtgctaaagatctccaaactgtcactgccctccaagctcaaaattgagtgacgttttctgataacaggcatatcataccacaacttagtagattttggaggtgttttcttataataactcctatttgctttgtatcttaggtgtagtttttgaaacagctgcagaaatgagaagggggtagaatagagaattaattgagattgcgggtagggaggggaaggcaataggttagtgggaaagaactcccactttgagtttggggaagtttacttaacctcttcaagtctgggagttcttgtctctacagttcggataacaactaccttgggcaacttactaacttttggtttcttcacctgtaacatgggaattagtagtacctacctcaggatttttgtgaggattaataactagagtactagctagtattatctcaggattattgaggattaaaggagaaaattgataaaatgtctggcatgtgggtgcccaacattagttctttcccttccctttcggagaaaagaatgtgtttattgccagtgctgtcattcttcattctttattttcattttctgctgccaagagttcttatttttttaatgagacttttgacctgtacttccttgtttctaatgtagcctgttgggtgggtgaggtatgaattgctgcctaggggtggatcagtatgtaagtcacgcccagtgtagattacctcaattactcgtgtacagtgtctattacctagtcctggtgagtctaggattcttttgcttctagatagagaaggtaatattcccatctcagactcaggaaaaggtctacctttgctcacctatagacttgtaaatatagatcagaggtcttactcccagtggttctctgatcacagtttgggaattgcttgaatattgtgtgttagggatatgtttggagaaggccagctccctgcattaacatcttctctatgtcttgctctctcaggtaatccactaacttgctttcttgtttgctttgtattattaagtgataaactgtaggcagaccaggaacttgtatttatcggcactttaaaactttttttttttttttttttgagatggagtcttgctctgtcgcccaagctggagtgcagtggcgcaatctctgcctcctgggttcaagtgattctcctctctcagcctcctaagtaactgggattacaggtgcatgccaccccaccgggctaatttttgtatttttagtagaggcggggtgtcgccatgttggccacgctggcctcaaactcctgacctcaggtgatccacccgcctcagcctcccaaagtgctggggttacaggcgtgagccaccgcgcccggccagtgttttgtgtatttatgattatatagaatggctacaaatggccatctgctttggagttgtctaccttttgtgaaaaaatgaaaatagactattgcctagcaattaagtattcaagcatgtattttgccacataatttattgtgagaaggttatcaatgtcaaataaaatgctttcattatttgcttctatttgtctgtcttcctgaccagttcatttttccttccagtgaagccatcttgagctagggttttctttgtgggtagttgttaattttttttgtagagacaaggtctcaccatgttgcccaggctggtctcaaactcctgggctcaagcagtcctcttaactcagcctcccaaagtgctgagattacactcatgagccaccacactggtccgaagaaattttttttttttttttttttttttttttttgggagatagcatctcactctgttgccaggctggagtgcagtggcacgaccttggctcactgcaacctccacctcccgggttcaagcaattctcctgcctcagcctcccaagtagctgggactacaggcgcacgctgccacgcctggcttttttttttttttgtattttagtagagatggggtttcactgtgtttcccaggctggtctctaacacctgagctcaggcaatccacccatctcggcctcccaaagtgctgggattgcaggtgtgagccactgcacccagcctggtctgaagaatttttaaacaccacagctaaggacctgagcattcatctgcagctacctatatgctcttgttacatacagttgttatactagggggtttttcacagccatcttttatgactgtttttggaaaacatcacattgaccttcatacatattcaaaactttaggctttgttgcatctggagtccaacactgaggcccacagatgtcaccagcccccagccagcaaggtggggcatgtctcagttgtcttcctttctcccttcagtagccacacagaaaagcttttccatcatttaaaatctgatttttatacaattgtggcctggtggccagcccattcaggtaaaagaataatgaagaaacctgattattgaaactcagtatcccacccctaccttgcctccaaatttaaagcagttcattttattatagtgttttggataggctgttaataaatcagtttggagaactaaggaaatagtattaaatttagtgaaaagaacctatttaggctttggatcctaaacagatctggcttccaccacttagtaatcctgttgtttttggcagattatttaacctctgaatctgtttatttctaaaatcagaatatgcatctgatactgtgcctggtttgtaagaggcattcaaatggtaacagtagttattacattcataagtgctgaatttttctttagattactgtatatcccaaatgaagttttccatcttttggttccagagggtaatagccagtggagtaaagtttcacattgtgactttattttgcttatatggcgtggtaaaaaggtgtatagatgatgactatattgtaagagacagtactggaattccgatttctcttaggtgtttggggtagaactattaatccaaatcaaactgcttggattttcttctaatacctcccttcattgggagacctcacactgttgctatgtcatttatgtcacattgacactcagatcccttttctgggttgaaggtggagaaatgtaattcacacaaaaggcccaaatgctaatgttttctgttttactgtacttcctggtttgttttatggaagtaatacttccgtgtattggtttaatttttttgtatgtatgtatgtatttattttgagacagcgtctcgctctgtcacccaggctggagtgcagtgacatgatctcggctcattgcaacctctgcctcctgggttcaagtgatgcttctgcctcagcctcccaagtagctgggactacaggtgtgtgccaccacacctggcctatgtgcattgtttttaaaaacaaacatgttgtatgttttgtatgtaggaataaaagcagaaggcccctaggggcatgttaggatttataatctcctaaagttaaatattctgcaagtttacacaagcagtaacttcatgaattactaagtattactgagagtatttatgttccaaattcgaagccttaatcaaaccagaaaaaaacatattctgttgggtttgaacaggtagttttcttattcattgtatacttagaaccttgggacttaaaggtcagagagtcaagggaactgccaaggagttagttgctagatatttttttgtttttttgagctgtatatatttccccacttgaaaaaacaaaaacactactacttatatggcattagtatgataggtgagagagaatgttgttggccatggttaccaccttaaattgacatgggaaaagagaatcaatatgaagtggaggaaaaaaaacaataacttcatttaatcatacatttttaccgttaacctgttttcttttggcttatccttctgagctagggtaaggaggcttgttttgtctttgttgtttttgtttttttgtgtcagtgacctccaaatagatgatcttccagacgaaatggttgcctgttagtacatctggtctatacttgaaagctgcaaaaggtgattgcgtatctcttgaaataagaggaattgtgaaatagttttctcaacctgctgcatggattttgactattcaggtcgtgatctccacaagttatttaaactagaatttctcaaccagtgtattgtgttagggtgcgttacagatgtgttgagatactggtcccctcacacctctggccattcatgcagaatatagtttggatacagcatccaaactaatgacctcagatccagagcagtcttgatcatttaccccattgtgccatacaaatattattttctgtcttgactgtaaaaaagactgggagcagtggctcacacctgtaatcccagcactttgggaggccgaggcgggcagatcacaagatcaggagttcaagaccatcctggccaacatggtgaaaccctgtctctactaaaatacaaaaaaaaaaaaaaaaaaaaattagccgggcatggtggcgcttgcctgtagtccagatactcaggaggctgaggcgggggaatcgcttgaacccaggaggcggaggttgcagtaagccgagagcgtgccactgcactccaggcctggcgacagagcgagactccatctcaaaaaaaaaaaaagttaaaagtttagaaaaactgggagcactaatttagaaagctcagtaattggatatctgaacagttttaagattcaagggggtaaacaatctgaaaataatcttggttttaagtttttaaagccattttaaggtacctctctgacccacaagtaattctctttggacacatgattcaaaggatatgctttaaaatacaagactgtgaacaatttaaggttggacagtagtgaagaaattcaagttcttattttctaagcagtaatgtgaggcagaagtaaagttcccttttgtaaaactgttatctctacctgactaactctgaatgctactgtatcttttctgaggctgacattttgttaatcattcatcaagcttgggtctcatactctgaagcctaggatacattgtcttcttgtcttccttcaggaaagaatggcatatacttagtttgagcagtttaattttttaatatttatgtaaatcaccaagttagccttcttagatgagtttctgtttgtctaactcaggaattattaattttgctggagtttacagatttcctgagcctgtaataatttttttcttcaaaaaaaaatgtacatgtacatgctgctttatatacatttaccagagagttcatggccactgatctcattgttgagctgcattttcagttccaaaatttgtgtagtctaaataagagttcccccatcttattatttgtaaatttatatatttagtataaaccagggattgattgctcaaatgccttcaggagtcgagtcaataaggtaaatgaagagttgtccaggtttacgtgtggtatctccattgggtgtctgttaaaagagccagttgttggacagtcacagcttagcatatccagcaggtttttgtcagtgcaggaatgaagagtcattgttaccagacagacagacctacctgccctccctcctgctttatttcttttaagaaatagaaagttaaatttttttttaattttggtaactgtcactttgaaaaatattaattgtgaaaaattttaatacataattcaccttaataccttttcttttgttttttgagacggaatttcactcttttcacccaggctggagtgcaatggcgcgatctcagctcactgtaacctctgcctcccaggttcaagtgattctcctgtctcaggctcccaagtagctgagattacaggtgcccaccaccacacctggctaattttgtatttttagtacaaatggggtttcatcatgttggccaaggctgtcatgaactcctgacctcaggtaatccgcctgcctcagcctcccaaactggtggggttacaggtgtgagccactatgcctggcccctgatttactttttaaaaacagtgtgaaggctgggcactgtggctcatactgtagtcccaacactttggaaggctaagatgggatgatcgcttgaatccaggagttcgagaccagcctgggcaacatggcgaaaccctgtctctactaaaaatgcagaaaattaactgggcgtggtggcgcacacccatagtcccagctacttggaagactgaggtaggaggatcacttgagctcaggagtgtgaggctgcagtgaagtgaactatgatcatgccattgcactccagcctgggtgacagagcaaggtcctgactctaaaaaaaaaaaaaaaaaggaaaaaaagtgaaaaacttgtacacatatgcacctagcgacattatttcatagtagccaaaaagtggagacagtccaaatatctgtcagtgaatggacaaccagaatgtgatgtatttatacagtgaattcagctgtaaaaggaaatgaattactgatacttgcaacaacgtggataaacttgtagacattttgctaagtggaagaggccacatattgcatgattccatttatgtgaaatgtccataataggcaaatacatgaagacagaaagcagattattggttgccagaggattgtaggaagaggctattgggagttaatcctctgaggtactgggtttctttttggggcgatgaagtgttctggaatcagatagtggtgatggttccacagcattgtgaatatacgaaaacacaccattttagggtactgattgtaccctaaaatgatgagttttatgttacatggattttatctcaatttttaaaagtaatatgtgagccaaataggagatatacacacagagtagtcctgttcccagccatctgtgggaaatatattccaagatccccagtggatgcctgaaaccacagataataccaaacctgattatcatcagttggaacacagttttctgttgatgtcttctacccacaaatttaatgccttttccattttaactaagcatttatcacatactgcggtcataacttttgcagtttgaggtacaacagcaaaacaaatgtgaatttatttttccctcttcacattatcactgatagaagatttgttcttaccatagatcttagcaatttccacatatgatttttttttccatattaagtcaagaacttttacctttttacttaaaggaagcactttacagcttcacattggcatttccagattctcagcatcgctactcttgcactttggggcatttcttaagtaaaataagggtaacttgaagacaagcactgcaatactgcaacattcaagtaaccaagaaggctaccaagtgactaatgagcaggtggcatatacagctggacaaagggatgattcacatccagggctggatggtactagatggtgcaagatttcatcacattactcagaaccatgtacaatttaaaacatggctgggtgcaatggctcatgcctgtaatcccagcactttgggagggtaaggcgggaggattgcttgagcccaggagttcaagactagcccgggcaacatagtgagaaaccttctttacaaaaaaaaaaaaaaaaatagccaggagtggtggtgcatgcccgtggtcccagctacaagggaggctgagatgggaggtagaggctgctacagtgagctacggttgcaccactgcactccagcctgggtgactgagtgaatcctcgtctctaaaaacaaacatggaaaataaaacttatgacttatttatttctggaattttccatttaatattttcagactgcagttgactgcgggtaactgaaaccatgggtatgggggttggctgtgtttgtggtcaccagtttacagtcccttgctgtagaacagaagaataggctgtgaatctagacgaatgttttccaatcactacctctgacattgggaaggttatgcagttttgccttctgtaaaatgagaaagacattacttaggtcatggacttgctggtttaacagtgataaatctggctgggcatggtggctcatgcctataatcccagcacgttgggaggccaaggtaggaggattgcttgagcttaggacttccagaccagcctgggtaacataacaagacctcagaacaaaaacaaaagacatctcagaaaaaaaaacaaaagaaagaaagaaaaaaaagaaaaaatttaattagcaggggacagtagtgtatgcctatggtcccagctactaaggaagctgaaggaggaggattgcttgagcctgggaggtcaaggctgcagtcacccaccctgggtgacagagcaagaccctgttacacacacaaaaatgataaatcccaagaatcagtgactgacataggcattcacataatatcttcagaattgaaaggcaaccagtttttactgcccttacttccagcctattctatttttgtcagttttaggacaacctaccttattagctgttggttattgatcacctgcggagatgatggttgtctgctatgtaacctgccaccatggcagtaaagaagggagtgggggaagggtgataatccttatattctgcagttttctcactttaatcaggtaggttaaataacatatccaacatcagatgtaggttgtagtggttctagtgtacttattctttctgcaaccttatgatgtcttttaaatccaagatcctttcagtaacggagtactgaactgtttttgtagctctatcaaggcttgtcaagcagtgtgctcatcacatggtaaatcatgcagcgtggaacctcataaaatctccaagaaacatcattcacccatactgactagtttcacatctctttggtaagtgatagtaggaaacctttttcccctggtttaaaaaggatggatgcaataacatttataggtaagactgaggagcattttaaaaaccacaggccgggcacagtggctcatgcctgtaaccctagcactttgggaggctgaaacagttggatcacctgaggtcaggagtttgagaccagcctgggcagtgtggtgaaacacggggcatccaccaagagaaataaatcaaagtccaagtacttgaattcataatctgaggagagaggtgtatgtaaacaaaacacattcagtgtgacaatgtcagagagtatatggggttgctttggccctgtagaagaggtacttggcctgttttggagaaagatgggaatgcttcatagtgtgcttcatagtggatgtaaagtttgctgattcttgaagggtgagtaggatttcccctagcaagcactattggaaggcataatcaatgtataaaagcacagagacctggagaggagtgggaagcaagttcagtcagtttaaacaaatgttttgaaaatgttaatctgtgcagttcaaagacattagaatagaacaggttgaaacaatactgattgaatttattggttatgggactatttatggttttcattttttgtgtcagtttttgttttttctccctgagaatcagactgggatcttgtatcagttttgataaattatttttcttctgggaatttcaagtttgtgggcacaaagttgttcgtgatattgtcttatctttttaccatctgtaggatctgtagtgatgtatcatttccattcttgatactggacatttaccctaattcatccctcactccctcatttccattcttgatattggacatttaccctaatattcattctctctctctctctctctctctctctctctctctctctctctctctctctgtctgtctctctctctttctctctctctctctcattctttctttctttttttgagacagagtctcactgtcgccaggctggagtgcagtggcatgatctcagctcactgcaacctctgccgcctcccgggttcaagcgattctcctgccttatcctcctgctgggactacaggcgtgtggcaccacacccagctaattttttatatttttagtagagatggggtttcaccatattggccagactggtctcgagctcctgaccttgtgatccgcctgcttcagcctcccaaagtgctgggattacaggtatgagccatcacacctggcccttctttttttttttcttaaatcaagcacacttacatttttaatttcttcccccccacctgcagaggcagggtctttctctgtcgccctggctagagtgcagtgacatgatcatagctcactgcagcctcaaactcctgggctcaagtgatcttcctgccttagcctcctgagtagctgggactcagctaattttttccattgtttttattattaaaaacaatttttttgagatggagtctcactgtattgcccaggctggtctcaaactcctgggctcaagcagtcttcccgcttcagccttcctaagtattgggattacagtcatgagccaccatgcctggcctaatttttaaattatttttgtagagattgggggttgcactctgttgcccaggctgatctcaaactcctggactcagacaatcctttgcctcggcctttcaaagtgttgggattacaggcatgagccacgggctcagcacgagcatttttaaagactcaattggtattgtggatcctctttgtttcatatttctttgattgctgcttttcccgtttttttccttctagtttctctgggcttctgttttcaaatttattgagatatgtgtaagttcttaatttttagtttgcttttctaagttcaagtttatgaatttttattttcgaatcagggccttgctatgtcgcccaggctagagtgcagtggcataatcacagctcactgcagcctccacctcctaggctcaagtgttcctcccatctcagactcctgaatagttggaccacaggtgcatgccaccacacctggctttttttttttttttttttttttaatagttttaagttaaaaaaatagagacagggtctcactatgttgcctaggctggtctccaaactcctgagctcaagcaatcctcacaccttggcctcagcctcccaaagtgttgggattacaggcattagccactgtgcacagcctaattattattattttttttttctttttttttttttttttgagatggagtctcgctctgtcgcccaggctggagtgcagtggcacgatctcggctcactgcaagctctgcctcccgggttcacgccattctcttgcctcagcctcctgagtagctgggattacaggcgcccgccaccatgcccagctaatttttgtatttttagtagagacggggtttcaccatgttagccagggtggtctcgatcttctgacctcgtgatccgcccgcctcagcctcccacagtgctgggattacaggcgtgagccactgcgcccagccgatttttaaaatttttatttttatagaggcgaggtctcgccatgttgcccaggctggtctcgaactcctagattcaagtaatccactcacctcagcctcccaaagtgctgggattacaggcatgagcaaccacacctggcctaagtttataaatttctaagtcctgctttaattgtatcccacgttttgaaatatcgtatttttatgaacaaactctctatagcctatgtttttttttatttaaaatttattgattgattgattttgaggcagagtgtctgtcagccaggttggagtgcaacactgtgatcatagctcactgaagcctcaaactcctaggttcacatgatcacttcagccttctgagtagctaggacacaggtgcatgcaccatacttagctaacttttaaatttttctgtagagatggtagtcttgctgtgttgcccaggctggtcacgaactcagcctcaagccatctttcctcttcagtctcccaaagtgcagggacccctgagctgtgcccagctcttaatttctaattgatacataattgtacatatttatgggatatattgtgatgtttcagtgcatgtatacatcgtgtatataatatataccccatgttttagatgtatctcttttttttttttttttttttgagatggagtctccgtcacccatgctggagtgcccactgcaacctccacctcctaggttcaagcgattctccagcctcagcctcctgagtagctgggattataggcacccgccaccacacccagctaatttttgtgttttgttgttgttgttgtttttaagtagagatgaggtttcgctgtgttggccaggctggtctcaaactcctgacctcaagtgagccaccacacctggcctagatgtatctcttttatttatttgtttattaatttttttttttttttttttgagaaggagcctccctctgtctcccaggctggaatgcaatggcgttatcttgctacaaccttcgcctctcgagagtttcaagcgattcccctgcctcagcctctaagagcagctgggactacaggcacgcaccaccacacccagctcatttttgtatttttagtagagatgggtttcactgtactggccagggtggttttgagctcctgacctcaggtgatctgcccacctcagcctcccaaagtgctgggattacaggcgtgagcagctgcacccggcctagatgtatctcttttagacagcatgtgatagaatttttttcctttttttaaatttttttttaaattaatacacagtaaaattgactcctttttgtgtatactgttctatgaattttaatacatacatagattcaagtaactaccatcacaactgggacatagaatagttatatcaccttctgcatgttacccttggtaacatacctagcctcccacccctaatctctagcaaccactgttctgttctgagttactacagtttttttttttttttttttttttgagatggagtcttgctctgtcgcccaggctggagtgcattggcgtgatctcagctcactgcaagctcagcctcccgagtagttgggactacaggcgcccaccaccgctcccggctaattttttatatttttagtagagacggggtttcaccgtgttagccaggatggtctcgatctcctgaccttgtgatccatccgcttcggcctcccaaagtgctgggattacaggcgtgagccaccgtgcccaacctcactacagttttatcttttcgtgaatgtcatataaatgaaatcaaacattatgtaatattttgagactggcttatttcattcagcatactgcctctgagattcatcaaagttattgtgtgtgtaaatggttagttcctttttattactgagtagtattccatttatggatagactatagttatttttatccattcactccttgaaggacattttggttttcattctttggtgattatgaatacagttgctgtgaacataacattataggcttttgtggacctaagttttcatttttctagggtaaataactgtgagttggattgctgggtcatatgaaaaatgtacatttaacttatttataaagaagttgccaaactgttttctagaatggctatacagtactattttgcgttcacactagcaatgtatgagtttcagtttttcctcatcttctctagcatctcatcctctttagcatttcaagttaaatattggcagtatttaacttgtaatgttgaaaattttaggtttacagaagttacagatagaatctccatatatgcttccctcagtatatcctaatgttcacatcttgccataaccgtgatatgtcatcaacactaagaaactgggccagtcatggtggctcacacctgttatcccagtaactctggaggccgtggtggggaggattgcttgaggccaggcgtttgagaccaacctggttctcagaagttaggtgggcatggtggcatgtgcctgtagtcctagctacttaggaggctggggcaggaggatcgcttgagcccaggagtttgaggctgctgtgaactgggagagctaggatcacaccattgcactccagcctgggtgacaaagtgagaccccatctctaaaaataaataaataaataaaataattaagaaattaacatcggtataatactattaactaaactacaggctttgtttggattttaccagttgtatcctttttctgttcaaggagccagtccaggataccacattaatttagtcatcatgtctccttagtatcctccagtctgtgaagcttcttagtctgtctttaattttcattacttggaaacttttgaagaagactggtgatgtatgttatagaatgtccttcaatacaggtttgatgttttctcaagattaaattgtggttatggatttttgagaagactaccacagaggtgaagtgcccttctcatcacattatatcaggggcatatgatgtcaaagtgacttaacactagtgatatttcagtaaagtctgccaggtttttctactgtagagttgctatttctccctttccaagcccattggacttaggaatacccttgtaatgaataagcatggaaagggagaaatttaggctctctttccatgcttacttatttcctttccttaaaggagaaaaattgagctccacctcctagattcctcacatgtgcagttcacaatagggttctcctatgagaatctaatgctgttgctgatgggacaggaggcagagctcgggcagtaatgcgagtgactcccgctgctcacctcctgctgtgtagcctggttcctaacaggccatgaactggtacaggcccatggcccggggattggggacccctgatataaatggaagtatacaatatgtaggcttttgtttctggcttcttcacttttaagattcaccatgttggtcaggtgtagcagctcacacctgtaatcctagcactttgggagactgaagccaaaggattacttgaggctagacgtttgagaccagcctgggcaacaaagcgagaccctgtctctaccaaaaaaagaaaaacgattcatccattttgttgcacaaatcagtaatttgttcctttttattgctaagcatcacatggcaaaccatttgtttgttcatgtaactgttggacaccttggttgtttctgttttttcacaattatgaataaagctgccttaaatgtttgtgtataagtttttgtgtagatacgggtttccgtttctcttgagtaaatacctaggagtgggaatgctggttgtatgcttaagtacatgtttaactctataagaaactgccaaactgttttccaaaaccattttgcattcctaccaggaatgtattagttactgttactctgcatccacaccagcttttggtatagttttgttttctgtttttttaaattttagccattttaataaatctgtagtggtagttgtatgatttaatttcattttccctgctgtctggcagtgttgtgtatcttttcatatacttatgtgtatatcttcttttgtggtgtgtatgttcacgtcttttgcccatttttaaattgagctgttttcttattgagttttttaatgttacagatacaagttctttattcgatttgtgatttgcaaatacattcttcttgtgtctggcttattttcttaatagtgtctttcacagagcagaaatattttaacgttgatgaagttcagtttatcagttttacagcccatgcttttagtgtcatgtcttcaaactctgcctaacccctggttgcaagaaggtttgataattttacatttatatctttttttttcccccccagaggtagagtcttgccttgtcacccagcctgggattatacagtcatgagccaccgcatctgacccaagttttacattgatatctgtgattcattatgaattatctttatataaagtgtgagatttagattaaagtttatgattttgcatattgatctccaagtcttccaaaacaatttatagaaaagattattatgcctgtaatcccagcactttgggaggccaaggcaggtggatcagttgagctcagaaatttgagaccagcctaggcaatatggtgaaaccctgtctctactaaaaatacaaaaattagcagggcatagtgacacactcctgtggtcctagctactttggaggctgaggcaggagaatcacttgaacccaggaggcggaggttgcagtgagttgagatcatgcccctgcactccagcgtgggcaccagaggcagaccctatctcgaaaaaaatacataatatatttatatatatatgtatatatgtcctttctccattgaactgcctttgtacctttgtcaaaaattaattggccttgtttgtgtgagtgtatttctgtactctttattctgttcccttgatctatgtattatccttttgccaatacactgttttgacaactatagctttgtaataagtttaagatcagttagtataattcttccagctttattatttttcagaattgtttggattattctggttcatttggatttcttttttaatccagtctgatatgatagtctttgtcttttacctggataatttattccacttatatttaatataattaatcatattccaattcaactttcttcccctatgcttcttatgttctagatttttttcttctcccttcttaacattcttttggattctttttatgattttacttttccctctttctggtttggaaatatatgctatttttattctgtaattagttgtcatacatcttgtgacttgcagctataacttagcaaaacctgatattataattttatcttcttttcatataataaaagacctttagaaagaatactttgaaatctcctcaatacactgtgtttttattgttatgtattctatgttttaaagctcctcaaggtattgttattcttttgtataatcagtgtttgtttggagctgtctgtaaattttcctcttttttgctctttattttttctttcaactcagaccttccaaaatgggattatttttcttttttctttagagacatttgcttgataacagaattttaatttggcggctatttatttttttcagcacactgcaggtattaaactacttggcttcattgttggttttgaaaaatcagctgttctaatgttgctctttgaatataatctgcctttttctgtacttgcttgtctttagttttttgtttttgtttgagacaaggtcttgctgttttgcccaggctggcctccaactcctgggcacaagcaatcttcctgtatcagcctcccaaatagctgggactataggcctgtgccattacacccaactcatctttgttttttcctgctattttgtaattatatgtttggttttggatttctttttattgatcttgtttggaaattgtttgcttctggaatttgattgtgtctgattgcttctgggatattttcaactgtcttcagttactgcctttatcccattctcttttctgctagtaccaattaaaagtatatcaaactggctgggcacggtggcttacgcctataatcacagcactttgggaggccaagatgggcgggtcacttgaggtcagaagttcaagaccagcctggccaaaacatggcaaaaccccctcactactaaaaatacaaaaattagccgggcatggtggcatgcacctgtagtcccagctactctggaggctgaggcaggagaatcacttgaacctgggaggcagaggttgcaatgaactgagatcgtgccactgcactctaacctgggtggcagaacaagactttgtggcaaaaaaaaaaaaaaaaaaaagtatatccaacgatttcactatatttttcctcttgttttttgagatctgctaggacattgtatttaaaaataaataattggctgggtgcggtggctcacacctgtaatcccagcactttgggaggccaaggcgggtggatcacgaggtcaggagatcgagaccgtcctggctaacacggtgaaaccccgtctttacttaaaaaaaaaaaaaaaaaaaattagccgggcgtggtggcggactcctgtagtcccagctactcgggaggctgaggcaggagaatggcgtgaacccaggaagcagagcttgcagtgagctgagatcaggccactgtactccagcctgggtgacagagcgagactctgtctcaaaaaaataaaaaataataaaaataaaaatagatatttgtagtgatcatttgaggcccacagtaaggtactttcctccatggagagcttgcttatatcaggtatgcatgggcactaatccagagaccaccttaaaacaagcttaagatatgatattcccttcagtagggctttaattcctccctggatcttccactccctagtcactctcaccattaggaagtatgcctctgaagtcccaccttatgaagagggcctcctattagactttttgtcttgtgagagccctgggctttggtttatgtgagaacaaaattctaattttcaggatcaacaaaggctttccaggcttccttgcttgcttatatctctgggtttgcattttctattcccttttggctataattacttctctgtcttatttaaagatgagtgggccaggtgtggtgacacatgcctgtagcctcagttacttgggaggctgaggtgggaggattacttgagcccaggaatttgaagtggcagtgagctacgattgtgccactgcactccagcttgggcaacaaggaactgattagtgttggaagtagagaaaagaaaataaagagaaagaattccaaagcttgtgaattaatgatactgtttgttttaagcacaaaatggtaacagtcgagtaaactaatagtctccaaatcagatataaaaaggttgctgacctgatgtgcaaaaaaagcacatcaggtgcttttttacacctgatgccacgttgcatgtggcatccaatgatgtgtttcttatagaagataacaaaatgtgccagcctttggtcattttagggtgcaaaattataggtctttaaaattcttaacttgctttaaagtgttacgctttgcaatttcttgttttaatgttttccatctgaataattcctgtgcgtactttaagtgcagttttttttttctcttacagtttttccccattttaggtactccataaatatttgttgaatgaatgatgggttggtgatagtttaaatacccttcaacgtctgtacaccaccatgacttaattgtttcaagcactgatcacttgagattgtaatggtctgttttctttgtctgagggcagagatactttctccaggaccaagagaaagaatgcctttctggcagtcaggcacacatttcctggtacatagtaaacgttcagtaaatgcttgatgtatgagcattctgctcttgattggaaaggaagaaagaaattaaggttaagtatggacatttgaaataagtaattcaggtaacattagctacttgtgcttttttgtattaagttggccttctaatcagtgccccttttgtaaagggaaatgggcaagtttgactgaatttttctctttgcttctgtagcaaggtagaaaagtatacatatttaaggtctcgctgagttccacaagtcttgtttgtctcttaccagtttatgttgcctgattgcttggaaaaagagttcattctctgcagcagtgcataaaaggtgtcttcctgtatagctgcttttcctctaaacaagcagtcctaaaccatgcagtcagtgcaatctaagcacattcctcattctttgctatagaaatctttgtcctgtcgggatgatgatgagatcttgttcatttgctatggttcatttagggatgagaaggagattttttttttccttttaagatggagactaataaacattagggttaaaaagaactaattatattacagttcaaaaattgacttaaagttctagaatgatcttttccatttctgatactaggaaattcatcaataaaaatacattagcagaaatgactaagcaaacttgtttgtatagttttctggtattggactgttactaagcctctagttttctttttagttgccaaattgaaaaataacaactgaacataagagattagaaggagggactagctaagggcaagaggagtttttattgaaattaattctgctgtattcagtgtatatcagtaaacttatgattttggcaatggacaatttttccttatggtttaatggcattttctttttatttacttatactttattaaagaataggtcatgcagacccatgcagttggcttcgatgtgatcttacttcagtcgggaaaaattcattgacatgatacttttttcgtagctgattaattggcttctgttaggctaaacgttgagcatacaagacctagccatgtcttcaaagtcattctgacggtgttaaggtagatgtagtggtctgaaatggttagccactaaagttacacctccttttatgcaattacatgagaacagtaagcactaagtaagacaatttaaaatggaacttaataagaaaggcagtgcattttgttagattgccttaagatatactagtattatgaacagtggagaggagaattgatcttccaaatatctaggactcaggcactttttccatcttccaaataagctgctataaaaattggtaaaatcaagtttcttcagtattctcttaatttgaattatcgaggggaaaaagacaaatcctagttgtagtcctgtgatttaatagaagctgtagtattgggaaagagagagagggaagggaacaattactcaagaacctttgacttggttttccagttctcctagttgcgtaccagatgacctgaagtatttaggaacaccctatactttggatgcaacttcattttcatttcatttttaaaaaataaaccaagattaatttgatcaccaaatagtgtttactgaacgtgctacaaaatgcaagccttaggctaggtactataaattaaaaaggtaaattaaacatggttcttaactttgtagaacttagggtccaattgagaaattaagatttgaagactggtgtgtgtgtgtgtgaatgtgcagtagaaagtgattgtgttctgtaggagtgagaagacttgaaccttggaggccaactcactgtctttgaatcccagctgtaactgtattggatattcttggtcaagctactgaacttaggctgttcttatttgtagattagagaaactaatgcttgcctcgtagagttgttggaagagttagatacttaaagctgagaaactcttagttccagacttgtaatatctaactgcctattcagaatcttcgtttgaatgattcaaagccattttaaccttaagtccaaaacctatcttgtgcactcttatctccatgaatggcaccaacagtctgtcaagcaagaaatccaagagtcacctcccacttcatacagcattttccagttcactcagagctattgattttacaccataaattttgttcctcatattagtccactgatctccacatgccaccaccttaggtcatcatttctctcacgtgtgctactgttaacagccttctccctaagtcctgtcccacactcagccagagtaaaaattttaaaaacaatatgtatgggtcacttttctgcttaaaacttttcaatgaatttctgttacccttagtccataggtaaaatcttcaatggcatacttgtctcacccctgttctgccttgctcacttatattcctaaggcctaggatagtactttttcatagtagatggttatctatttaagggatggacaaaatcaggaatgtagggaagaatcaaaccaaaaattgagaaatgtaggctgtgtgttttcttcctgttagcttacatgtgatatacatatgcatttgcagaggtataagtgaaatactatttctaaataagataatgtttatcttggttgggcatggtggctcacacctgtaatctcagcacttcgggaggctgaggctggtggatcacttgagtccaggagtttgagaccagcctgggcatcatgacaaaaccttgtctctacaaaaaatacaaatattagctgggcctgatggcgcatagctatagtcccaactactcaggaggctgaggtgggaggattgctcaagcccaggagatgaggtggaggtttcagtgagccgagcgagattgcaccactgcactccagcctgggtgacagcgcaagaccctgtctcctgtctcaaaaaaataataatgataatatttggtctttgacctcccttttctgtcttttcacatcccctcttgtttttgttttttgtttgtttgtttgtttgtttttgagacagggtcttgctctgtcacccaggttggagtgcagtggtgagatcatggctcactgcaaccttgacctcccaggctcaagtgatccttccatctcagcctaccaagtacctgggaccacagttgtactccactacacccagctcatttttatgttatttgtagagaggaggtctcactgtgttgcccagggtggtctcaaactcctgggctcaagtgatcctgccagagtgctgggattataggtatgagccaccacactgggcttcacatcccctttttatcaccatcccttaacccccaatctcttagtacccttttatctatctgagattacagagtcacagttgaagaatcctctgttttattttcccgtataattaatgaaggccagccatttgaaattcatgtgaatacctttcttactataagcagattatttggtatgcgtgacagtaaggtgaagcacctctttgggggtactgcaaaaatagttagcttgttgtcttcccagtggagaatcagatctgctagttcataaattaggtcccagttgatgagccccaaagcttcaagggtcattcagacaagtactggagaatctcaagagtttcattagttattagtcttttcccactcctcacagaggatgccagggccttgaaacagcagaagaagactgggtgatgagaatgtacatgactagtaataggagttggctattctccatatgtcagatggtttccagggagaaatgaggactcattttgtaatgtcatgtatacttgggagttagccctcagtggccgggaattaaccacggctactataatttttgtattttaaagaatgaaggttccagcctgtaaagataggtttctgcttattagctttcactaaggagctaggggatagtaattacttaatacaaatttacatgcatttcatgtttctaagccctttctggaagatcatctcacttcatcttcccttcagtctgcaagcacagttagacaggttttataagtgatgaaccaaagctgggaaaagcccaacagagagatcacttttaagcataggaaaagggctttgagatccacagacgaaggctgtcttacacgtataaaatgttaaccagaagagtaaagtggctgtaaaggttatgtagagaaagatactgtttcctgtcagaggagaggctgagaatttaaaagtttagtatattaaaagtaataaatttctggggacagcatttctgttgggttcatgctgctgtttctactattttggccatattcacacctacacctttctctacggttttcctagtgtctttcattgctgtcaaggcaggcatagtagtcacagagtcaccaatcctacaacatagatgaccttatttctttgggaagaagaaaaattacaagaaaacatctggtttttgcatgtttgatgtgtttgtgtgtgtgtgcgtttacagttttaactgatattaagtgaagatagattaatgtcacccaggttttacaaaatcaaagaaatagaaataattttaaagacttttggtacttgaattactttgttgttttctggtcatttagtacatttatggaacctcagaaggtttgagttgaacagaggcaagttacagcagttttttgggtgggagaattcataagtcagcatgtgaatcttttgatctcatatatttggagtggaatgtcattaattgtgtttgtcacggttaaggaatagagaattaatctccatcccagtcttgctattcttctgaaagcctttagctgccgacaccatgggcataaggaggtatctcttctggcttctctttgggtgtggtagctaagttacagcttaccttggaaagatgagcagcttgtaagcaacaaaaaaacagtatagttaacaaatgcatcgtcaacaaacaaaacaacccaatcaaaaaatggacaacagctttgaatagacattctccaaaacaaatatacaaatggccaataagcatgtaaaaagatgctcaacatcattaatcattagggaaatgcaaattaaaatcacagtcaatgagatacaacttcatactcattaggagggctgttactgaaaaaaaaaaaagaagaagaagaaaagaaaaccaaaaaataggccaggcacagtctattttgagagcactttgggaggccgaggtgggaggatcccttgaggccaggagctcaagaccagcctgggcataagcaagacccctgtctctataaaaacaagcaaaaaacagaaaataacaagtgttagtaaggatgtagagaagttgtagcctttgcactgttcctgggagtgtaaaatgatacagttgctgtataggagtgagccaccgtgcccagcttgttgaaacaatatgctggttcttcaaaaaattaacatagaattactacatggttcagcagttccacttctggatatatacataaaagatttgaaagcgaggtctcaaacagatgtttgtacacctatgttcatagcagcattatttacaatagccaagctgtggaagcaactcaagtgtccatcagcagataaatggataagcaaaatgtggtgtgtgtgtgtgtgtgtgtgtgtgtgtatatatatatacacagtgcaatatcattcagcctttaaaaggattggaattctaacacatgctacaacatggatcagccttgaagacattatgctaaattaaataaacaaaacaaaggacaaatattgtctgattccacttatatgaggttcctagaatagccagctcaggcagaaaatagaatagtggttgcaaagagttgggggagggaaaattagtgtttagtggatacatagttttcatttgggatggtaaaaatttgtagaaatggatgatctggtgattactgcacaagaatgtgaatatacttaatgcaactgagctttaggtttaaatgtggataaaatggcagtttttattttttttagatgaggtctctctcctgtcacccaggctggagtgcagtggtgcaatcacagctcactgtagcctcgacttcctggtctctggtgattctcctgcctcagcctcccaagtagctgggactgcaggcagacaccatcacacctggctaattttttgtattttcagtagagatggggttttaccatgttgcccagactggttgcgaactcctgggttcaagcgatccaccctcttaagcctcccaaagtgagccactgtgcctggccataaagtttatgttatgtatattttaccacaatttaaaaaagtgtttcaacaagctgggtatggtggatcactcctataatcacagtactttgggaggctgtggtgggagcatcacttgaacccaggagtttgagaccagcctgggcaacatagggaaaccccatctttacaaaaaaaaaatttatttaattagccagctgtggtagcccacgcctgtggtcccaactacttgggaggcagaggtgggaggattgattgagcctgggaggtcaaggctgcagtgagctgtgatcagaccactgtactctagcctggcctacagagggagaccttgtttcaaataagaagatttcaacaaaaagtaaataaaaatagtacaaagggcatctctattccctttacgcacgtttacctattgtaatattttacccagcttgttttatcatttgtgagtgtgcagtcatgtgtgctatatatatacacatgtaaacgtgtgggcacatttttttcctgaatcattttagggtagattatatgcatcatggctgtttacttctaattacttcaggaaaatttcttaacaatagacatattcttgggctgggcgaggtggctcacgcctgtaatcctagcactttgggaggccgaggagggcggatcacctgaggtcgggagtttgagaccagcctgaccaacatagagaaaccctatctctactaaaaatacaaaattagccaggcatggtggcgcatgcctgtaatcccagctactcgggaggctgaggcaggagaatcacatgaacctgggaggcggcagaggttgtggtgagccaagatcacgccattgcactccagcctgagcaacaagagcgaaactccatctcaaaaaaaaaaaaaaaagaataggtatattctcttaactattgtgattatgtaccaacttcacaaatttacattgatacaataatttaataccctctgaattccagttctgtcgatattgttttttatagcatccccctccacctcctgcagtatgggatacagtctagagtattgcatttatgcaatgtctctttagcctccatttgtcttttatgctgtggacatgttttagaagtatagtaccccttccccctttttaaatagacacttcctctttttctgaatgtttcctggtaattgaattgaagttatggctgggtgcggtggctcacatctgtgatctcagcactttgggaggctgaggtgggaggattgcttgagcctgggagttcaagaccagcctgggcaacatggtgaaacaccgtctctactgaaaatacagaaaattagctgagggtggtggtgcgtgcctgtagtctcagctacctgggaggctgaggtgaaagaatcaccggagtccaggaagttgaggcttcagtgagccatgatcacaccactgcattccagtctgggcagtggaataagaccctgtcttaaaacacatacacacatacaaattgaagttatgctgtctcagccaggagacttgcatacgtgttatatccttctcacgttatcacaatctggagactcaatacaatttcatctaaatgcataatgaggggaatcagcacatgctgtaggagatagggaagacatcattggaaaggaacctgatttgatagcatatttctaacatcttacttattttcccccggtgtcaaattttgcattagctcagctaatctgtattactgttttataccagtttttaagctcctgtattaaatataaagagaatattactgatttctgtttttaaatttaatgaaaccaagtgtgtctttcaaatggtgatcaaggttctactgattattaccttaaggttcccccaaaagatttggattggtataagatgacatggagctttgatgtatgagaacaagcctttattctcttcctggtttcatcaaatatgagtcagaatggcaagttgtactcttagctttgccgccattctagaaccttttagcacccctacttaagttacagaaagctgctgaaaagaaagtatttttcttgccaataccttttgtagaatatataactagtggtaatgctgatgtatctatcctcaatgccatttttctcttccaggctgtcttacaaaaatcattcaaattttgcctgcagaggtaacaggatatttggcaaaatatgattaaagcaaatatcagtttactgtatttcttgggatttttcttctcatgttataggaagcactggttaacacagttgagctatatttattggctgtaggtaggagagccagaggtatatttcaggccattattatttgtaagattatttccttcccatataccttctgtaaatgattccttggactttgtgcattttgtttctgcagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatgggggtaattgtttttgttgacttcattatactcactcaaagggctgaatcttgtggatctgttgagtagtttttgtcagaaaacctccgtgactctgtatgtgtatacctcaggatcaaagcccaatttgtgttttcttttgagctgaaaatttggttttgcagtgaagaagcagagttgctttggcaagtgaacaattttaatgggcttaccatttaaaaatcattttagtttcttatccttttctatgatgtatatgcagtcgtgcaccacataacaaagtttgaattaatgacagaccacatgtaggacagtggttccataagattataagagagctgaaaaatgtctgtggcctagtgatgtcatcgtaacatcaacagtgcattcattaccttttctacgtttagatacacaaataccattgtgttacaattgcctaaagtatttattacggtacacatttgtatcctaggagccgtaggctataccctaggtatgtaatatgccataccatgtaggtttgtgtaaacactctgatgtttaacacatttctcagaatgtcattaaataacgcatgacggtattctgtatgggcacctggcaacaaaaagttacctatcagcttgcttatcaagccaagggcattgcagatcagtgagaagtgatacttgagagactttgaaaacaccaaagtcttatataaagtatttttgaggtagagaatgttgtttcgtgttaatacaggaggacgaaacagttctccaaagaggtaacttctttctgatgagaaacaattaaattcttaaacatttgcccttatcctgagactaggcatgtcttagcatggaattcagcccaaattctatcttgaacagttgtagtctgcctgaacagctgtgtttgccctcctaattctctgtgcagactcatttggatgtttgcatttcctgtcccaatgtggtagacatttaattgttcagatcatacttttgtgataaaagcattttgacattcaagtgcaaaagaaagcaatttgaaaactaaagctacagctcctgtatgctgtattttatatctgactgcatgtgatttctgtaacctgtaagtggttagtggatggcttccctaaattgtcatagggcgtatttttaatcttgagtatgccatgaatttgtgtatgtgtgtgtgtggaaatgagtcttgctctgttgccctggctgcagtgcagtggtgtgatctcggctcactgcagcctccgcctcctgggttcacgtgattctcccacctcagcctctcgagtagctgggattacaggcaccttccaccctacccagctaatttgagtatgccatgattcttaacagtaaatacattgcctctgaatacagaggcactgtatgctgtaaagacaccattaaatgccagtgtggtttagtaccaataaatgttgttattactgataatctaacaattctcctcttatgtcacaggctttggactctaggtgacactgtgtttactataggaatttcagccgctatcttcaaattgagtgctttgcacttggttctgcttaaatggcactaaagagcccttttgggcttttggcatggttctgtttgcttgctggcatttgttttgtatgccctcccataggaagagaactcaaccagaagtaggagcattcttcccctacacctgccatgattattatgttgtccattgtttttagtaccttttgtcttttcattcactttctttttagctacttgaggaaaatgaatggttgaggtggttgatttggttcatattggatacttagtaggtccagaggattctatccagtaggatagaatttaggccttattggaactgtgtttgtcattcttcagagcaaagcgctctacattggaagcaggcaggggcaggaggaaaatgttggcatttcccttattctacctctgtttattacctctgatgttgcttattggtcacagaatatgggtatatgtagaggaggggatcgctgattatagtttacaatctataatgtgcttcgtactacgcatggactatccccagagcttgccctggagggcaaatagattaagcctatacatttgaaagccatttaccttcaaagaggcctgttaaaaatcagctgctgccaaagtgtggctagattgaaacagtcttgcaaaatgtttttagttcctgctaagtgccaacactggaccaagcactaagggacaagaatatataaaaattattctccggccgggtgcggtggctcacgcctgtaatcccagcactttgggaggccaaggcgggcggatcacaaggtcaggagatcgagaccatcctggctaatgcggtgaaatcccgtctttactaaaaatacaaaaaaattagccgggcgtggtggtgggcgcctgtagtcccagctactaggggaggctgaggcaggagaatggcgtgaacctgggaggcggggcttgcagcgagccgagatcacgccactgcactccagcctgggcgacagagcaagactccgtctcaaaaaaaaaaaaaaaaaaaaaaattattctcttggggaaagctgtctcttgttggagacaaacgtatttagaacaaaccttaatacaagccagctccatgtcatgtgccaataaagatgtaaacagtttgggattagaaagaataattgaaaggtataagtttttctaattctaggatttgaaacacacgtattttaattggcctaatttaaaaaaaaaaaaaatacaatgggccaggcgcggtggctcacgcctgtaatcccagcactttgggaggccgaggcggacgaatcacgaggtcaggagatcgagaccatcctggttaacacggtgaggacccgccgtctctactaaaaattcaaaaaattagccgggcatggtggcaggcgcctgtggtcccagctgctcgggaggctgaggcaggagaatggtgtgaacccgggaggtggagctggcagtcagcagagatcgcgccactgcactctagcctgggcgacagagtgagactccatctccaaaaaaaaaaaaaaaaaaaaaaaaacctatttgggaattgtttgaaatacttcttatttctattacagctgctggtaatagattcctgtaatttgaattgatgctgataatttgaccgtttataagtcattttgtttgtgtccacagaaatcaagatgactaccagctggttcgaaaattaggccgaggtaaatacagtgaagtatttgaagccatcaacatcacaaataatgaaaaagttgttgttaaaattctcaaggtgagtacaagagataatttcagaggtatttggaatatagatttttaaaagtagttttgaagacttttttaaaacagcatttaaaaggtttttggtgccaaagcaaataaataaaattttattgtatcctatgaactcaatagaacaagttctgcttatttgacagatcgggaaactgaagcaagagaagtgatttgagttgactcatatagctaggttgtggcagagtaagggagcaaaggtacagtctcttctctcccagttattgcctaatacttatttcctttacttttcattatataatgaggcttttgttttcaataaataaatcattgcctctactttgtaaagatgaggagtcacaggactcgagggggacagacagatgatattagtgcagctagtcgggtgtaattgcccttgcttaggtgatgtgagtggtagggactgaaacaaactgggaaacacatgcctcttcaaaaggagttagctgcttctcagctgaagctgatgattgccctgcagtaatgcaagtccattgttgcttgatactctgttttgcaaataaaagccagaaatttatatttgtatatgaattttcctgacttttaagtgttggctcaagattttaaaaaaacaatgcacaggccagatttggcctctgggagaccaatatacaacttttaatttagttataactatgctgtgcactgtcatatattgggaacttagcatatagttccttaccacaggaactttttcatatttgacactgaaaagtagaagtttccaaactttctcaatttataacacttatactgtctttaatttttcacggtactcctaagtcaagaaatacctcatagttctctgtattaagtagcaaggtccaaatagctaagtaagttttgttttttttattgtttttgtttttgttttgagaaggagtctcgctctgtcgcccaggctggagtgcagtggcgcgatctcggctcactgcaacctccgcctcctgggttcaagcgattctcctgccttagcctcccaagtagctgggactacagatgcacgccagcaatgcccggctaatttttgtaattttaatagagacggggtttcaccatattggtcaggctggtctcaaactcctgacctcaggtgatccgcccgcctcggcctcccaaagtgctgggattacaggcgtgagccactgcgcctgcccgctaagtatttatatcttagcaacttggtagccatttaaaaagttattcacataaattaaaagaaaaaagttaaatttgttcttatataactataatttgttactgttgggttatgtagacctgttgctgcatagcttttcaaatgttgtcattggttggacaccaccaccctcatttcctgtcattgatttttgtgcagtacttgctttttaccacagcaactactgcaaacccagcttcacaaaaatatgccatcgcgaggagtataacacaatccatcacgaggagtgtaacacaatctaatgttgaaactacgaaccacctcaagctggcagtgcacccagtgtctggcagattcaacgatgggttgatgtgtcttcctcaaaaatgtaaagtgttccacagtattcctgtgcattgctggggtgcttcacatgccctttgagaaccagagagtttaagtatttatatctgtcttgaaatatgtagaaagagaactaggttggaaatcaaaacatgtgggtgactagccatagtagtccttttaacctaggacatgtttatccatctattaaaaagaatgttggctgagcatggtggcatgtgcctttagtcgcaggtcctcgaggggctaaagtgggaggatcgcttgagcctggaagttgaaggttgcacggatctatgatcaaaccactgcactccagcctgggcgatgagaatgagaccctgtctcaaaaaacaaaaaggatcaaacacaaaattgtgtgtatatatacatacgttggagactggagttctttgtgattgtatggtgatattcatatggaaaggtatatgatagaatgaggtgatatattattatttagagccacatgaaaagcatgcatagtgggtctacagttcagaagagggtagtagttaggaaaagctcccaggagctgtcttcaggctgaatgggaggaggatttggataggtgttgggtggaagtggtgaagggaagcaggctgtagagtgcaccaagataagaaaagaggaggagggaaaagtgagagaaatatttcatgtgaaagatgttatgtgaccatacataggagttgaacttggaaagagagattaagttggcgaaggcctggaaaaaataatctctgcatttccttgcagtcttaaaattatatgactatctcttctaggtaattgtgagcccttgatgattttgaatgaagggtgatttagaaagatttttttcagctcagtctttctaactgtattgtatattttactgtaactgtgggtaggtggtgtaagtatagatgaatttcctttgtaaaccatatttaaaatttttaatctcccctatttaataagacaaaagttgcattgatcgcattaaattcgggcctgagtcagctgcctggtctgtcacaaaccagctttttaagtttatagatttgaagcattctgtagagtagttttgtcaaccagaagctttttttttccactaaaaaaccagcagttgggttaatggaaaacaggaggtaagttgttgggttagtctctgcagggtggaaagatctcccagataatataacagtttataaagatctgaatagttgaagcaggaagagaagacttatattatcttgtttcttaggtagatattgtattgggtaagaggtcgtgggttgaattcaatggactacatggaagtcattagtaaaatagcttctgtttattgggtaccactttgcattggacctgttctaactgtggtatgtaaatcactaacaggcgagtatagtccctttcagcagtgagaaacatttaaatgcttttctgaacactgcacaaccacaaagccaggttttgagaactgtcaatgtttccaaaatctgcttgctttctgctatcatgtgcttgaggcttaagacaaagttaaaagaatttatagtattatttggtagtttctggacctggatcatcagcctggaaagtatctaaaaataaatcccccgtttccctctcaagattttgatttagtgaatcttggtgggttctgtgagtctgtatattaaaaaaatccaggtgattgttggtcatcaaactttagtaaccaccaatcttgttaatgaagagatgagatgtacttaacttctaagagttatatgcagtgcatctagtctgaggtgaccaacaccctaggaaaagacctgcacagtccagtacagcaggcacgcaggccacatgaggctgttaagcacttgaaatatggctgggctgaattgagatatgctgtaagagtaaaatacattagatttcaagggtttaatacaaaaaaaggtaaaatagattaataatttttatattgatttatatgttaagattttagattaataaagtacattaattttgtcctttttaaaattttcttgatgtggctactaacacatttaaaattacacatgtggtttgtattatatttcctttgggccagcactgttttagactattcaggagaaggctttataatataagcccaggcacagtggctcatgcctataatcccagcactttggaaggccaaggcaggcggatcatgaggtcaggagttcgagacgatcctgaccaacatgatgaaaccctgtctctactaaaaatacaaaaattagctgggcatggtggctggcgcctgtaatcccagctactcgggaggctgaggcaggagaattgcttgaacccgggaggcggaagttgcagtgagctgagatcatgctactacactccagcctgggcgacagagcaagactctgtctcaaaaaaaaaaaaaggctttataaaggaggtgcagtgggaccaaggccctcctcagaaaaaaatgaaaaggattccatactagaacagatgtggaaagaatgggtaaggacaaaggaatgtttaagatatgctctgcagaatactctttagaatggaggggttcatttataagagtattggcactttgggaggccgaggcaggcagatcacgaggtcaggagatcgagaccatcctggctaacacggtgaaaccccgtctctactaaaaatacaaaaattagcctggcctggtggcgggtgcctgtagtcccagctactcgggaggctgaggcaagagaatggcgtgaacccaggaggcggaggttgcagtgagccaagattgcaccactgcactccagcctgggtgacagagcaagactctgtctcaaaaaaaaaaaaaaaaaaaaaagagcattggtgatcaggctagacagttattattatgttatgtttcagccatattccgaaatctttcgaatacctcatttgattcttgcaacaatcttatgagatgggtactcttgttactcattttacacttaatgaaaggcttagagaggttatgtagtttgccattaacagccagcaggtagtaaaggtaggtttcacattgggcattgtgactccaagactcaccctttaccctcagggttgtgctacacaaagatgttttggccatccttgttgttggccctaattagaggaagaaatggaaagggcccatgtttcatcctaattgataaaaagtttgatatactttagtattactaacgatttaaattgctactttgtaaggttttaagacattaacatgtttaacatgttttaaaacattaacatcaagactgatgattgaaatgctaattctgcagaagtgtctggtctttggaatagaaatctttttttctttcaattcaacatttgtaagtacctgcagaatacctggcacagtgctaggagaaggattcagagacgaatgtgacacattttcttccttcaaggtgtgctcataagtaagccatttatcatttatgtattacactacgtgttgaaatactctgaaaaaattttttttttttttttttgctgatgtacttttcccctttcagccagtaaaaaagaagaaaattaagcgtgaaataaagattttggagaatttgagaggaggtcccaacatcatcacactggcagacattgtaaaagaccctgtggtgagtatagtaggtgttagcaaggcccgccagagctgagatggtgtttgacctggagcacaactggcctctttttgttccctcccccaaccctcatcattaagtcctgctttgaaagtgcttaatcagatataccatttaactagcttgggtctttctttcaaagagacctccacccacagactatttcttattcttctaggctaagagactgatagcactggaaactgaaatgtgttaatccattttgcaaactcaggtccgatgccgatgggcgatgggcgcattgtcgggctgcctagagcctggtgagacttcagctccatgtcttctgtttgaaatccatcccaaaaatgacctaagtgcggtgatgatcagagcggggagggcttgtagcaatagagggtttcttactactgaggcgaggactgccaaatttcaccacgcagcatccgcaaacattgtccccattaaagctgtcagggctattgctaatgtgtgtttttgtttttgttcttttcccctagtcacgaacccccgccttggtttttgaacacgtaaacaacacagacttcaaggtataatatataaccaactgtttcgggctagtgggtttttagaccacatagcctttggggatgatgctgttagaagagcttgcttcgcatttgtttttaaaaagcttttcatccttacagtgcaaattttaagatagaagaactcctatataagcagtgcccactttctgcatcttgatattttgcccatttgtttaatgttctttttaatgaccaacacattgacttctcactacttagttgacagtttctgctgatgtccaacctaatgaaggcagtaacacacgttcacttaggatctggccatatggcaattcgctttaaacaatagtgttcaggaagaaatatattgtatgtataaaagtagggactgcttatttcttaggattcctcataaactgtgggctatagatcttaaaaggcagggatcgaggaaggataatgtcaaattctgccataacacaaacctctataagagatatctcagaattccagtctatccagtggcctacttatttcacacagttccaattttacagaagaatatagctactcttttggagtaaaagtaaaaatcttcgatttgcctttccaccagtccagtatccagaatgttatatattaataaattagtgaattctgttgcagagatagggagaaaggaagaggaactgctttagagtcagaatgataatttcaagaaaaactttgtcagaagacgttgctaaccattaaagagacgtacctgtggctgggcatggtggctttcgcctgtagtcctagctactggggaagctgaggtaggaggatcgcttgagcccaggagtttgaggttgcagtgagttatgattgcagcacggcactccagcctgggcagcagagtgaggaccctgtctcaaaaaaaaaaaaaaaaaaaaaagatatgtccatgtaaaaaacattctgcaactctttggaaactggaaaggatacataacagttgttcagagtttactttccaattggaacaagaatagttttgttaaattgactcaacaggtttggtatcatgccatctgcatacccactggtgatctgcagggccaactatgtaaggcaaagatgagttagttccctactaaggaggcagtatatttgccaaaatgcctcttttgagaaggtctgaagatacatgaaaagcaaactaaattataggtgggtgtcagtgcatattaacgtatctagatcagtatgtttctgacagtggattatagcttccgcaatatatgtttaagtaattcttcatttttaagagttgaagacccaaagtatctctttaaagttaatgtaatgttggagaaatagagggcagtgaatggacagatcttggaacaacggtaaatgagccaagtcttggtttgaattactgtgagtgagggtgaaaaatgcctttctgtcagcattatttcatggctcaaacatttgtctttaacagcaattgtaccagacgttaacagactatgatattcgattttacatgtatgagattctgaaggtaagtgaaccttgaatactaaatattttttaaattggtcttctttttgttaaatagtcaattgatggtagaaaagccagcagattaactttgtaaagtatgttgaaagaagggacctctatataagtttttaataagttaatagtatcatacctgtaatcccagcactttggaaggctgaggcaggaggattgcttgaggccaggagatcaaaagaccagcctgggtgacatagtgagatccccatctctacaaaaaaaaattgtttaattacctgggcatggtggtgtgcacctgtaagtcccagctacttgggaggccaaggcaggaggattgcttgaggccaggagatcaagaccagcctgagcaacatagtgagaccctgtctctacaaaaaatttaaaaattagctgggtatggtggcttatgcttgtaattccagctacttgggaggctgtgacaggaggatctcaggaatttgaggcagcagtgagctatgattgttgcacaggctggagtgcagtagcacagagtaagaccctgtctctaaatacataaataaataaaaattaataataatagtatcagaacccttgtgctaagggttatggaatggggtctagtgggagtataatttagaacaatttgaaaaagggtatttgtaagatagctgggactgaccccttaacaaatatttgtaatttctgtggcccctatgtaagttaatattaaattttcaaaactcgtgaaaacacctgacgtgctagcttctggtatactttatctcacttaagagtcagcaaataaaacagtaaactttaactcagttctcaaagggtaattgtcctaaggattgtgtaaatttctgcttatagatgctaattgaaaatttacttacatttctaaagtggggtcaccaaatatcttgttcccagtagccacaagatcagcttcctagaagagagaattgctaaaagttggctaagctttcttactaaacaagagttgacataaagcctgctgttggagccttagaaatcccctgaggagattgtgccagcagagatacttgatctttccattggctcatgcagtttgtggcaagcaaggctttagaaagttacagatatgattgcccagccctgggaactgtaggaacccaagttgcccttcaggaaggacaagaatttggccaacaacgtcggctgactgaaaggctgggattaacaaaccccaaagattatactactcagttccctttagtttgaggttggaaacatttcagattggatttgatgacctaaatcaggcattggcaaacttctttaaagggccaaatagtaaatattttaggctttgtgggccatgtagtgtttgtcacactattcaagtctgctgttgttgcacaagagcaaccataaacaatatgcaaacaaataggcatggctatgttgcaataaaacattatttacaaaagcagacatcaggccaaatttggcctgtggtctgccaacctctgttacagactcttaatggctaaagaattactgttcttagaataagaggtttgtagtaaagatctgttttctttctttgaggggtctgtggaaataatctaggatctggacaagacagaaaaatttgaagtggtgcaatttgggtatactttgggtcttttaggacagaaaacatgttgaaacaactgtgtcagaaaaagatctctaagctcagagagctgagtttgcttgactgtgagatcatgaacaagtctctgaagcattgctgtggaagtgactgtgtcctcagcttgaatcccaggggtattgtgaggctaaaaggaaaatttacatggagggaaaagtaaaggactcttacgtattattcaggctaactcctttctgacccgttcatcccacaggccctggattattgtcacagcatgggaattatgcacagagatgtcaagccccataatgtcatgattgatcatgagcacagaaaggtaaagtgataggctgacaagtgttatttatctacatgatgtagctaattgcccatcttcaacactttatcccttgtgttgtcacaggccctagtacctattcggcagttgagaaatatttggtgaatgaatgtacgaatttacaagtcaacatgtttgaaccattatttatattcctaagaatattcccaagaaggaaacatgagtaaagtgggcaaaatgttcatcttctaagcccggaaacgtggcttctcgccttatttattgagtaactggtttcctgagaaactactttctctccatttgccttctttttcttacgtgtacagtgtgggtaataatagccctgcaggcgactaggtattcgtgagaattaaatgtgcacagttaagtggacgagatatacagaaaatgctgtttctgtttattggatgtcataagggccctgttgtctgcaaatgcttttacatgagagctgtaatggccacatgctttagcatttcagttttttaaggtgacaagctgtgatgacttgcctgttgtggtctctggggaggcaggtgatttatttatgcaactgaattacttttagacacacaccatgtcagaggcaccaccctagggctggggatatgtaagtgaactcaacatacaataaatgcttgtcttttaggagctacatttagggaggctggtgggatagaaagttattttgatgtagaagaaaaaacgaatagggaatggcaagagggtatttgcagttttaaaccagttataagggaaggtttcattggaaaggtgacattttagagagcactgggagggacccagccatgcagtcttatgaagaaacatgtcccaaggcagagtaaatagcaagtacaaaagcccttcaggtaaggatatgtttggcatgttggaagagcagcagcaaggataaagctgggacagaatgaatgcggggaaagaaggaggaaatgaaatcaaagaggtaaaaccaaatcatgtaaaaccttattggtcattgttaggccttttctctgaagatagagagcttttgcatattctaagctttagcatgttctcacttgaaatttaaaagttaactacacatttattagaacagctaaaataaaaaatagtgatggtaccaagtgctggcaaaaatgtgaagaaacttgatctctcatacattgctggtaggaatgcaaagtttggcattttggaaaatgcttaactattgttttatagttggttggtttcttgaaaagctaaacatatgcttaccatacaatcctgcagtggcatttatctcagagcaacaaaatcttaggtccacacaaaagcctatatatgaatgcaactatatttgtaatagcttaaaattggggggaaaagctgggtgcagtggctcacacctgtaatcattttgggaggccaaggcaggcagatgacgagttcaggagttcaagaccagcctggccaacatggtgaaaccctgtctctactaaaaaaatacaaaaattagccgggcctggtggcatgcacctgtaatcccagctactcaggaggctgaggcaggagaattgcttgaaccccggaggcggaggttgcagtgagccgagatcgtgccactgtgctccagcctgggtgacagagcgagactgcgtctcaaaaaaaaaaaaaaaaaaaaatggggaaaagtgcccttcaatgagggaatggttaaacaaactggcatatccataccatataatattattatgaagtagtatttctcagcaataaaaaggaaagaagtatgacacatgcaacaacttggatggatctcatgcttagtgaaaaaaggcagtctcaaaaaaagttatatgccaatgactccatttttgtagcattctcaaaatgatagagataaagagcagaggggttgccaggggttgggctaacacacaggacatgtgtgtggtgatggaacagttctatatcttgttgaggagattatatcaacttacatatgtgatgaaattgcatagaaacacacacacaaacacatgcgtgcatgtaaaactggtgaaacctgaataagatctttctgaattgtgccagtgtcagtttcttgattttgatattgtactgtagttatgtaagatgttactattaggggaaactgggtaaagggtgcagagaatctctactactttggcaatttcctgtgaatctataatctctccatagcaacctgaacaatccttttaaaaagctgtttatatttatttttaaatatttaattatttttaaaataactattaaactatttagtatttattaaactgtttagactagagggcaagagtgaaagcagtgagaccagttaggagaaggggctatggcaatatatcaaacaagaggtggtggtggcttggatcggggcagtggcagtggaggtgatgataatggtcacaatatgatagaaccttcagaattttttgacagattaaatgtgaggtctgagggaaacaagaatccagggtgaatcttaagttttggcttgtatgacaggatgagtatcacctttaaccgaacagggggagactgagtggaggtgcttttgcagggagtaatcaaaggtttagttttgagatacaggcagtaaacttagtgccagagcagtccgatgtttttcctcagggcctactgctggcacttcagatcatggtcatgctatgcacagtgggcagataagcttgcctcttacccctttttccatgtttaggatgcattttggtaaaagctgtattgtatgacttttctgttatttcatctatccagcaaatatttattcatttttctcctgtataccaggcattatgttgaattctgaaaattacaaaggtgaataaaacagtccctacccctaaggagcttgtcgtccatattgaaaaagaaaggtagaaaacataaagagtttaggttctgttaaagaaatatatctaaaattcagggggctgaaggcaatgatcagacttcattgagaagctgacttaaatattccaaaagttaaggaaatgcttaccaataggattataggctgggtagtagggacattttagtcattgagcagtttaagaaatttgtaaaagcacaggtgagattgtgtcttccaggaacaaaatcatggagaaagaggtttgtcaagctaagaagttttattttcattctaaaggctataagtagtcagtggaggggtttcagtaaagagtgacgtgtctggtatattttatcaagagtatgctaatggcacagtgtgggtagcttagagaaagataagattgctcatggtttattctttttcagctacgactaatagactggggtttggctgagttttatcatcctggccaagaatataatgtccgagttgcttcccgatacttcaaaggtcctgagctacttgtagactatcaggtaagaacagaagggcaggcacagttttgatcctgtgtttatttcgcacataatttaccaaaaaaaaaaaagtatcattttgtgcatttaggtaggccacttaatgcacattcacagctgtcctttttatatgaaatgtaaaatataaatcaccttaattcatgtaccatgacttacattacttttattgtcataatgtcggtagaatatgaataggtttgcatttgatcctgacttgagggaaagtagccaaagatatgttctataatcagcagttccagaactgttttgaattgtaagctgttttgtttttgtttttgtttttgttttgagacggagtctcactctgtcgcccaggctgcagtgcagtggcatgatctcggctcactgcaagctccgcctcccaggttcacacctttctcctgcctcagcctcccaagtagctgggactacaggcacccaccaccaccccagctaatttttcttgtatttttagtagagactgggtttcactgtgttagccaggatggtctcgatctcctgccctcgtgagccaccacgcccggccttttgtttgttttctgaggcagggttttgctctgttgcccaggctggagtgcaatgccatgatcatagctgactgcagccccgaacttctgggctcaagtgatccttccagcttagcctcctgagtagctgggactacaggcgtgcactaccacacccagctaatttttaatttttttgtgtgtagagagaaagtctcactatgttgcccaggctgatctcaaactcctgggcacaacccatcctcacaccttggctccccaaagtgctgagattacaggcatgagccaccatgcccatcctgtaactaagtttaaccaatcttcagagtaaattcaagaatgttttcttgttcttctgaattgtatactaaataaaaaggtcttctccccagctcccccaaaaagccttctttctcctcacagaaaaaggagaaaggaaccaaattaataatagatttgccaagtgtttaaaaatctgaagttttcttgggagtatcttttatgcccagtctttccaggttattatcagttgattttaaaagtttcagactttttgttcttgtaggaatttctttcttggggtcttaaggctatagccctgagttcaaaaagcattttatgcataaaaatagtttttacagtattactaataattgtgaaaaacagaacactgtcctattataggaaaattaaagattgaattctgaaacatttatgtaataaaatactaatgatacacattagatggtctccatgggctaacaatttggaggttttttttttttttttttcatgtaagtgaagaaaacaattcaaaatagtatgtatattagctgagcatagtggtgtatgcctgtaatcctacctactcaggaggcctaagcccaggagttggaggctgcagtgagctatgatcacgccactacactccagcctgggcaacagagcaagaccctgtgtctttaaaaaaaaaaaaaaaagagccaggcacagtggctcacgcctataatcccagcacttggaaaggccaaggcaagtggatcacaaggtcaggagctcaagaccagcctggccaagatggtgaaaccctgtctctactaaaaatacaaaaaaattagccaggcgcggtggtgggcgcttgtaatcccagctactcaggaggctgaggcagagaattgcttgaacctgggaagctgagttgcaatgagccaagatcacacccctgcagcctgggcgacagagcaagactctgtctcaaaaaaaaaaaaaaaaagtaaaaattgttttaaaaccgagtgaaagatgcataaaagaaaaaactaaaaaaaaaactaaaaaaaaaaaaaaaagaaaaaactagccaggcacggtgggtcatgcctgtaatcctagcactttgggaacctgaggcgagcagatcatgaggtcaggagtttgagaccactggccaacgtagtgaaaccccgtctctactaaaaatacaaaattagccaggcatggtggcacgcgcctgtagtcccagctagtcaggaggctgaggcaggagaattgcttgaacccgggaggcggaggttgtggtgagccaagattgcgccactgcactccagcatgggcagcagagtgagactctgtctccaaaaaaaaaaaaaagaaagactaaaaagaaatatatgaagatgttattagtgttttgattttgagtcagtggagtgatttttttttaattttaaaaattaattttttattttgaagtgacaagcctgaggattcacagataataacagtgagtttacttttatgcagatgtacgattatagtttggatatgtggagtttgggttgtatgctggcaagtatgatctttcggaaggagccatttttccatggacatgacaattatgatcaggtaatatatgttatacccattgaaaaatgtactggcctaatgcaatgatagccagcactgcctgtaactttcagttcactgtttattcagccaccccgatattgatccttagattgatgtttcgggagctaccagcttagccttttgaaatcagacattcccccctagtctttgtcatttgcattgcttattttattgtgaagaatacatataaattgtcatccagatttttaaaataggacattaccttagaattctcctaataaacccttatctccaatatggtgttttctccaatatgtgagcccatatgtggtatttctgtgatccttttggctctttatatgggttgagttacagatgtttcttaaactaactccacttcccccttgaagatcaaagggctctttcattcacaagaacctggaatgattctaggaccttgtggaaggtaccattgtcttgttccctttgagcaccatgtccaattttaatgagtcaaagaatacaacctgaattccattaaagtcaataactctgtatcaagtgcatgcagtactgaggaatacagaaaaaagaaagaatagttttcttcccctcagatagttcatagctgatcttgtaagggagtcaaacatacaacaaaataggttacagtcataacttcagagtagaaatgtggacaaggcacaaaaggcagtagtggtgagtagtttgagtgtgcaatgggagcttcccaaaagaagtgacatcttcaattgggttttgaggggagaaaaataagggttcaccagggtgacatttcaagaggaagaaaccagtttataaagtagtttgctttttctaacactatcacattgagttgaagtctaaactgttaggaggtagcattcatacctgtagacatgatgacccgtttatgtaaattcaatcattgttaattgttgatttgttaatataatatgcttgtgatatgggtttttgtctttctttaatactagttggtgaggatagccaaggttctggggacagaagatttatatgactatattgacaaatacaacattgaattagatccacgtttcaatgatatcttgggcaggtaagtcatgaaacaaaatatgtgcatctgtggcttaagcactttgagagtgaactggcacttaggatcttcaaaatagttatgttttctttgccagcactgtcaggatgtcagtggtccagtgccacaggatgctgcattgagcaggcctctgataaaggcattggattgaatggccctttattcaaattaacttacaggagtctgatggaggggttatagctagaggattcctacaaaatgaatgtagattctagtagaagggttacagttgaggcaaaaatcaaaatttaccttgcttctttaagtgaaaaacctctctccaagagaaagaaattgaagtagaaaatgcatgctttaagactgatgtgcaggctgggcacggtggctcatatctgtaatcccagaactttaggaggatcacttgagcccaggagttggagaccagcctggacaacataatgagaccctcgactccatgcatggtgatgtgtggcagtagtccagactactaggaagctgaggcaggagcttcccttgagcccaggagggaatgctacagagagcaatgaacatgtggctgcgctccagtctgggcaacagagtgagaccctgtctccaaaaaaaaaaaaaaaaaggctatatgcagacaaccgactcttaacagtagtgactagatatagtacttatacacttaaccactcaacaggaggagatggactttcctgatgcaaaggcttttgctggccaattggcagagatgccaggaatatgtgtggggatgggaaataggcctggtgagctcagccacctgaccctccttgctacacagaagcggtcacgtcctgtcaagtaacctgaattatgtttcttaaaattgagaggactcagatgtcttttttcactctagctatgttgtttccagtctccagttagctttgttgtcccactcagtggcagagcggtgcaagactaccctcttgagtttggatccctctttgcttttgtctgggctgttagccactaagaaaaatgtaggaatgaaatgttgggcttctgtgcccacgtggcccatttctcatgccctcttttggtcctgcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctgtgagtccagatatctagcccacagagtttgtgcaggcgcagagtcctatagaacagagtcgtaatcccagctcctgtcagcttgctgcaaagttaattcacccacactgagcctcagattcttccagtggggatagtgatggcaactacattgcagaattactggaagaattcttctgtaacagaatacatgacacaagagcattcctaaataaactcttttcatactgtgaggatgacacttctcagtgcctcagtctggaatggttgaattagaatacacagccctgtatctttcctgtccctagtaatcattcgttggaaagagctaatgaggcttacaaatcttaaaattgtatgaacaccttgacttagatttgtgagtatagccacctgtgccatcctaagtgaaaataccactgagacccaccccatctgcactgtgatgttagctgcaacatgacatttttccttcggtgtgatggttttgtactgaatcatttatacttttgcccaatacctgaagcagatagataggctgattgggatagagaatgtggtcatagccctaagctacatggacctatagctttggcctacttggtactgggctgtggacacactggtaatatattaccgtctttgccgagttacagtgtcttgtctccattaaacctcaacaggaccagggcttcattaaattcgctctgctataaataattacctcatctttctaccatttgattgaaaggttagcttttaccacagtttgataggaaagctatttctgctttttaccacttgtctaattcatggtgaaggcaattgccaccttaagttctttggggaataatgtagagtatatataaattgcaaagaatgaagctggctgctttcaggcttccagaccattagtttaatctttcaagcaaaacagaacctagcctttttgtctcttttctagacactgttgtgaaggaccaggctcgaatgggttcatctagcatgccagggggcagtacgcccgtcagcagcgccaatatgatgtcaggtcagttcattggtaaattttctttaaaaaaatgtggaagtcaattactgttcttagctttgtggtctgatttcttgtataccttctcttctccgtactggtggccttgtgacttttttttaaccaggtttcagcatgcttgacatttggtatactttagtgatactgtcttgagtagggtatccccttctaggctagaatctcagcattcctggctgaaaatttttggcataggggcttgaaagtgccaagccatgaaaaggaaaaatacaccatttcatcttatagtttgaaatgacagtagttacatggcccttagaaacaatgttaagaaatggggtatagaggtggggtttatacataggtgtgtatgtgtacaaggacagttccgtgacatgtgccagagcaactatagagtgcctatcagttgtaaaaacataagtaaaatggttttccattattggatcattgtgacgcacagtgaatttttatagagtacccagttattccaaaggaactacaggcacatagcataagaattatacatataggcaacatccaagtgggtgcatatctggtagtgaaggcatttacttacatatcctcaaataattgctgttgccctcctcttttttaagaaaagaactaactgccttctagaatttaccccttgagtatcctacctctgtacagagtaatgtatatccaaacttacttgtagccttatttgtaataacaaaacattgagaatagctatcagtaggaaactggttaaatcagttatggtatatccatttaatggaatgtggtgcagccagtagaataagagtttcatgttctgttagatctccaactccaatataataatgtgaaatttaaaacgcaagatgcagggccaggtgcagtggctcatgcctgtaatcccagcactttgggaggctgaggcgggtgggtcacttgaggtcaggagttcgagaccagcctggccagcatggcgaaaccctgtctctactggaaatacaaaaaattagctgggcgtggcggcggcgcctttaatcccagctacttggaggctaaggcaagataatcgcttgaacttgggaggcagaggttgcagtgagccgagatcgcaccgttgccctccagcctgggtgagagtgagactctgtctcaaaagaaaaagtgagatgcagagccatgtctaagaggagtggagaagaatgtataataatgttctcatatatatatatatatatatatatatattttttttttttttttttttttttttttttttttttttttttttggagacaaggtcttgctctgtggccaaggctggagtgcagtggcacaatctcagctgctgcagcctccgcctcccgggttcaagcgattctcccacctcaacctcccaggtagctgggactacaggcgcccgccatgacgcccagctaatttttgtatttttagtagagatggggtttcaccatgttggccaggctggtcttgaactcctgacctcaggtgatccgcccaacttggcctcccaaagtgctggcattacaggcgtgagacactgcacctggcctttgtatacttttttgaaccttttgtattttgaaccatgtgaatgtattacctgtgtgtacacacacacacacacacacacacacacacaaaaacatgattagagaggtggaagaaatcaaatggaaataaattccaaaacacaattttatcttagaaaatgctctttccccattcaaattgactttcagtaattttgaaagctgccagctatcaagacagcatggtgtaagagcacatgagctttgactgcagtcatgtgctgttcagtatggtagtgactagccacgtgaggctatttaattacaattgaataaaatttaaaatgtagttcctcagttgcactagccatatttcaagtgctcagcagccacatgtggttggctactggtcaccagggtggacatctctgccctagacaggcctgggttagaatccaaccatggttgccacttgcttaatcgtgtactttggacaaactccttaaattgtccaagcctagatttctttacctgtctcttaaattgattaggacttgccactttaacttgaatttgtgagggtcagacttgaagtatatgtaaaaatccagctaagaggaagtcttcagtaaagaattattgtgttccttttgcagtgagtgctatgagaaactggtaagattgccatggttggtgtctttggctcactgacagctcttttctttcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcgagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatgaaatgtccctgcagcctgag

SEQ ID NO: 12012 - DNA, 42381 bp, Human
tcttgaaaggtttcactgtggcttcccacatattttggacttttaaaatcatccacaagggaagaaaaagttgagggccaagttgcctttaatacacatgtggctattaagttaacttggaatgttccttctttaaataggaactcttaggcctcttctttttgaggaatgcttggaaaggacattaaataacaatgacgaaaattcttcctgagcttcagagggcacccccacccctttgctggccattcacactattgacatgcaactacactctataacatgtggctggcttaacgaggtaatcgtgcacagatgatatgctctatgctgaagttggagtggttatatttcttcttggctatttttcaacagactgtactgaaactttaaaaatttgatcagtttaaacaggctgttttcaaatgataaatctataatgcattgtttctaaagccgatctttgcaccagaaacagatatgcttatcttgaacccatgctctgaagcatcaacaacttaaaggaatctactcattggtaacaccaatgtcaaatgatgcggcattacagaatacaaaaatggtatggccctagaatcactctctttatataaaatgggaactggaggtattaacaaaaaagccactaaacaacatagattccaaatgaaagcacagtgaattagttgggtctttagtgaagctaagtagcactatattaagaaatggagatatgcttaggtttattggccatattcaacatctgcacacacccagggagaataaagcctattctttccttgtcctgacctcactccctcaggctgcatgttccttgggtaatgagaagtcacaatcactattcatagatgtgtggggagtcactaaaaatatattattcactgtcaatcttagtttatatccagatacaacagggtacactgctcttgtaatggaatcagacttcttattttaacaagacaaaccaaatccaatccacatttgaagattataggttttaatataagaaaatgcactcatttctcaaagaccctagtgaagctgtgtttaaatgctcctaggtgaaccccctttgcatcccagtgttcccaccctgacacccagagcccctacctacccaacacagaatcatttgctctgatagaacaatggatccctttttctggaaacattgatggccactcgtcccttgtccttgcctatataaaactcctacatatattaagagaaaactaagcaagagttttggaaatctgccccaggagactgcatcctgagtcacacgcgtctttgttctctttcttgtcccaaaaccgttacctcaagtgacaaatgatcaaatctcaaatatagaattcagggttttacaggtaggcatcttgaggatttcaaatggttaaaagcaactcactccttttctactctttggagagtttcaagagcctatagcctctaaaacgcaaatcattgctaagggttgggggggagaaaccttttcgaattttttaggaattcctgctgtttgcctcttcagctacctacttcctaaaaaggatgtatgtcagtggacagaacagggcaaacttattcgaaaaagaaataagaaataattgccagtgtgtttataaatgatatgaatcaggagtggtgcgaagaggatagggaaaaaaaaattctatttggtgctggaaatactgcgcttttttttttcctttttttttttttctgtgagctggagtgtgccagctttttcagacggaggaatgctgagtgtcaaggggtcaggatcaatccggtgtgagttgatgaggcaggaaggtggggaggaatgcgaggaatgtccctgtttgtgtaggactccattcagctcattggcgagccgcggccgcccggagcgtataaaagcctcgggccgcccgccccaaactcacacaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccgggtaagcgccgggagcccccgctgcggccggcggctgccagggagggactcggggccggccggggagggcgtgcgcgccgaccgagcgccgctgaccgccctgtcctccctgcagccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccatgcgacccgcacaagggcctattctgtcacttcggctccccggccaaccgcaagatcggcgtgtgcaccggtaagacccgcagcccccaccgctaggtgtccggccgcctcctccctcacgcccacccgcccgctggaaaaagaaaccgctcggactgagtttctttctccagctgctgccagcccgccccctgcagcccagatcccaactcgcatccctgacgctctggatgtgagagtgccccaatgcctgacctctgcatcccccacccctctcttcccttcctcttctccagccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcgggtgagtcgagtcttcctctaagtcagggtcgtgattctctcccagggagggagtcctaactgtgccgaccgaacgggggaaataccttatccaggcgttttacatggtgtttgtgtgctctgctctcgcagcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaaggtacatgttctgctcctattaactatttttcacaggaaaaacagtggataggacccaacttagggctcttgccacgcttgttagtataagcccgttatctccaaaactatctaaccattgagctgttttgctggaatgagagcttgtgtaatagcaaccaccagttttccactacgaaatcttccacagggttagttaattcaagacattccaagagaggctctggctatttttggacatagcaaatgagactcaaacttcctcccctcaaaatataaacagaagtcagacaacagaagactaaaacacagagggttgaagaaagccactcctcttgtagagtcgctgattttttttttcctctctcttttcccttgtcttccttagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaagggcttggttattcatttatccttctaaacatttctgagttttcttgagcataaataggaagttcttattaatcataagataattcaccaataattttctaaatatctttaattattctatacattaataaattgattattccatagaatttttatgtaaacatacttcacactgaatcaagtatcacagacttgcaggcatacacaccacattgactatacagccattttttttgttatcttcacagaactttatagacactttaaattcaattctctctagattacttcagtctccattaaccctgttgtattacacttggtccttttggcatttgtacctctctggccgttataggttagtttccaacccttcacatcacaaactagtctatgtgccttgcacgtggaaaatgtttacattttttaaaaattttatgctctaggtctgtttctgaacttcattaccttactgttaaatctgaaaattatgaaatgaaatcctcatttaaatggagctatttcataagtcttgttttgtataattccgtttttggttgccatgataaccaatgacaaacagatggcataaatagaaaagggaggatgagcaaatcttccattcattaacattaatagaaatttgttttgaaagtaattcctccatttgcccaagtctttagctttatcagacttccagattaatgcatcctaccttaccaagtggtttatacatgagaaaatggaattgttcaagaagcctcatgtggaaacaatattgtacctacccaggtaggtttttactaaagagtgaaccaaagtgaatggtaaacaaaagcaatacaccaaaggcaactagaatcttctccacatgaggatagctgaggattctaggggaaaaaaaaattgcagacagactaacttttcccaaggtaattagcaacgttgtagtgccaatgtcatttggacagacaaaaatacacctgaaaataaagactagctctacaaacaactgtccacaccacaaaccaaagggaaaacttcccgtgttcagaatgtgaaaatttatggtcaaaactctgggctttaaggatacacccacatctgtatatagcagtgctgccaggagcagcaccccacctccccaaataaatgcgcatgtacacatacacataggcacacacacagagtacactgttagttcacacttcctttctgtcaattaattcctaactgcaaagatgaagggccatgcatgataaacgagactgactactgaattagagcattctggaaatatagaagcagcaggaaaagcatagatttcacattttccaaatacccacattaaagaaaaaaaaaagagtcactagattgcaaaacaaaaatcccacaggcaatgtttctacaaaaattagatggcaatgcacactttcaccccccaaatatcggaggtagggggtgccaaatcatcaaccaccgtaagatctgcaccgtgtcagcacatgtgtgagaaaagcagagaaacaacaaggtatctgatgcttctgagaacacgagagctctcaaacagccaacaggtagtcactagatatatagaaggccaggctgacagcagctgttgaatctagtaggggtttggcctagcactccaacaaagcttacaagccagggctgcctcccaggagaagatcctcatactcctggaagtggaatctaaattgagcaggtcaccagacagatgtttctcaaaagaagacacacaaatggccaacaagtatatgaaaaaatgctcaacattactaaccatcagggaaatgcaaatcaaaaccacaatgagctatcacttcacacctgttaaaatggctactatcaaaaaaacaaaagataacaaaactgtcagcaaggatgtggaggaaaaaaaaccctgtgcattgttggcaggaatgtaaattagtacggccattatgaaaaacagaaagttccataaaaaattaagaatacaattactatatgatatagcaatcccattactgggtatacactcaatgaaaaagaagtcagtatgttgaaaagatatctgcacctccatgttcattgcagcagtatccacaatagctaagttacagcatcaacctaagtgtccatcaacagatggatggataaagaagatgaggtatatatacacaatggagtactattcattaaaaaagaagggaatcctgtcatttgtggcaacatggatgaacctagagtacattatgttaagtgaaataagccaggttacagaaagagaaatatagcactatctcactcatatgtggaatctaaaaggttgacctcatagaagtagagagtagaatgatggttactaggggattggggttaggcaggaaagttggggagatgttagtcaaaaaatataaaatttcacttaggcaataagaataagttcaagagatctattttacaatgtgatgactctagttaatgatacattctattcttgaaaaatgcaaagagaatggttgtaaagtgttcttagcacaaaaacgctaactctatgaggtaatgcatatgttaattagctagatttagtcatgccacaatgtaaatatacttcaaaacatcatgttttacatgataaattaggactttgtcaatataaaataaaacaaaataaaaattgagtgggtcagggacaacagagacattgaaggatttggattaaaatgaggagggaaacagaggtttaaaatctcagaaggtaaactgcaatatttttaatgctgcatgaaaacaataaaagagggaggtctgtgaatttagaaaattaaaccaaacctccttcctgagcaaactttagtaaaactaattttatataaattaagaaaacaaaattattgaagccaaatccctacaaagtcactatatttaaaaaaagaaaataaagaatagaataacttttctgcagataataaaaaatgtgagaaatacatatctacaaaatatagaaaaattataacctactatttcaaaagtttaagaaaatgatgttggacataaatgatattaatagtaaggaaatgatgacataaaatagcaacataaatcagaattagcaaaacttaaaaatatagtttcagaaatcaacagagatttagaaataaaggaactatatcaaactacaaggagcataagagtgaatatactcttacagataagaaaacaagtttaaatataaaagaagaaataaacatattgcaataaaaagtaataaatattgtggacaggcaaagaaaatccaatatgtggagggtagaaattcttaaagaagaaaaaaaaatcctaaaagctataagtcaaaaaaaactttactagaataaaaaagtatttgaaagcacaagttgaaagggtgtgccatgtgcctaaacaaatcaactaacagcaaaacacattctagtaaaactgctggagtttaaagaaaagggaaaagctatttgaacatgaagacaaaaagaacatgagccttataaataaaaagaaaattagctcatcgttagattttttttacagcaatactttatgacagaaaaaaatggaataacttatttaagatacttaaggaaagaaaatgagagtcaagaaacctttatcctctaaaactgattttcaagaatgacttgattcttgaaatcaaaccttgaatgactaggttcatccctgttgtcacaaatgacaggattcccttcttttttaatgaatagtactccattgtgtatatatacctcatcttctttacccatccatctgttgatggacacttaggttgattccataacttagctatcatggatagtgctgcaatgaacaggaaggacacagacaaactgttaaaaacacacaagaactcagggcatatttttcctgtgagcccttgctgaggaacctactagcaaacaagctcaaacaacacaaatgtctgagagatactaacctaaggactgtagtgagaattgaatatagctcacctttagaactaagactgaatgaaggttaaaaaggagaaagtactgtatacagtgtaaaaagtagaacatttctgcctgtttatttgcatatatttattggcatatatatttatttgcatatatattagataataaggaagttaacaaatgtcattaagatcaaatcaaaaggattagggaaacaaattgaagccaggcacaaaagcatacagagtagggatatctgctctgacaccatagagtacaaccatacaaagtggaagagagaatggagatagcatatgccttccccgccaaaaacaatttaactgcttttagtgatagtggtggtattaatattgttattctgggaatgttaggtgtggaatgtgtaagaaagcaaattagccatcatgaatgttctaactctatccccagcattcatgagtactgaaattctcagtgagaaagtcagaaattagagatataatggaaaactgctaaggaaagttctgtagtccagaatttgaactggaaatataagcataaattcgtgaggtattttgtcttttaaaacacacacacacacacacacacacacaatttttccccctacatctgcctacataagaggcttagttagaatgacaactcaagaccagtgaatatcactaggcccagattttacacttgaaatattactttctactaaagaatattaggacttcttggagaatgagtgattccaagtctggggcaagaaatgtgtaagataaattcatttatgtttagaacatcttttcacattagataataaggaagttaacagatgccattaagatcatataaaaaaaactctggagacaaattgaagagactccaactaaagatgacacaattgagttttaataagaatgagaaaggcagtacattgggcctattgactatgcttacattcattaatttataatgatcgttaaagaagaacaactggccaggtgtggtggctcacacctgtaatcccagcactttgggaggccgaggtgggtggatcacctgaggtcaggagttcgagaccagcctggccaacatggcaaaaccccgtctctactaaaaatacaaaaattagccgggcgtggtggtgcgtacctgtagtcccagctacttgggagactgaggcacgagaatcgcttaaacccgggaggcagaggttgcagtgagccaagatcacgccactgcactccagcctgggggacagagaaagactccatctcaaaaataataataacaatgaataaaaaattaaaaagaagaactaattggtaattttctgggagtgataaggaactaattcagtatatacaaaatataattttttctgatgacttcagtatcgttttgtgtgtgtgtgtattacacatctctcagtgcctcagaagacaggctgaatctttaccaacccccaacatcacccaaagatggcttttttaaaaaaaataaatcttttagtcaattgtgctcatccatgatggttactttaaagtaattttctatttcttttaataatttttaaactttttcaaattttttgaaatgaacatacattataagaaagagattttttaaaaaacaaatttccatctcattaaaaaaacagcaaggaatatgtcaaaaagtgttcaagtattttatgattttcatttagatgaaacaatacacaatacataaataagtaaataacttagctattcaaaccactatatcttaattagccacgtgcctaggagtacatgcaacacacatcgaatctctagggaatgcccatattcattgtatattcagtgttgtcttttactctatttctctataccataaataaaatggtgaacgattttcctctgtataactattccttacctcatgaatcatactaattatatatagactgtttctaagactaagaacaaaataaacaaagtaaaatatattcttaaaatactgtcagattccaaacctaaatataggattcaaagcaatagacatgtagacccatcttctatattacatgtttaaaagagagtcaaagaagagttagtaagaaatgaggagcaccattgattaattagaatttgcatcgcaagaatataaaacttttacattaggtcaacaaattctaacacaatttttgtcagcaagttaacatgtataatttagataactacaataacttttagtctttggtatatattcaagagaagtgagcaaaagacatacaaaattctcaaagcagtttcatccatccaaaaactgaaagcaaaaatctgaattctgtaaacagaaaaattgatagagtatagaatatttatataatggaacaatatacatcaattaaaaagtgcatttccccaaaacatgtttctttgccatattttgaaatggccccgcaaagttgttctttgtgagggaaaatttgcacctctaaagaatctctattaatatagatagatctttttcttccagactctcccaatcgtaaagagatgaactgagatctgaataggaaacatttgtcacttcttgcctctacaggcagccactataagacctcagaagaacttgggtttccacaatgtttatcttaacctgaacattccctttctatctatcccaggccttttttttttttttttttttttgatacaaagtctctctctgtcgcccaggccggagtgcagtggcgtgatctcgactcactgcaacctctgcctcccgggttcaagtgattctcctgcctcagcctcccgagtagctgggattacaggcatgcactaccacactaggctgattttttgtatttttaatagagacggggtttcaccatgttgcccaggctggtcttgaacttctgagctcaggtgatccgcccgcctcggcctcccaaagtgctgggattataggcgtgagccactgcgcccagcctctatcccacgtcttgagacaaactcaaccaattgtcaaccagaaaatgtttaaattcacctataacctggaagcctccccttcccccaccacccgctccacatctggaccaaaccaatgtatttcttaaacggatgtgattgatgtctcatgctgctctaaaatgtataaaaccaagctgcccccagaccaccttgggcacaagttctcaggacctcttgagggctgtgtcatgggccatggtcactcatatttggctcagaataaatctcttatatataaaaaagaaaagcactattatggtgagtgaaagaagtcaggcacaaaagcatacacactgcataatgtcatctatatgaaattgaagaggaagcaaaactaaatagtgataaaggcagggtagtggttactttggaggtgggggcatgagagaacttggcacatattgttaaatctctattatatttcaattaaaaagtttaaaaattaaatatattcaagcactttttttttttttactttaagttctgggatacatgtgcagaatgtgcagatttgttacataggtatacacgtgccatggtggtttgctgcacctatcaacccgtcatctagattttaactctgcatacattaggtatttgtcctaatgttttccctttccttggcccccaccccccaacaggcccccatgtgtgatgttcccctccctgtgtccatgtgttctcattgttcaactcccacttatgagtgagaatatgcggtgtttggttttctgttcctgggttagtttgctaagaatgatggctttcagcttcatctatgtccctccaaaggacatgaactcattcttttttatggatgcatagtattccatgatgtatatgtgccacattttctttagcactttttaaaaagaattttgccaaaacattaaaagtgattatctaggagttatctttttcatctttattatattccatactttccatatcatttacaaagagtacttattccttgcaattagaaaaaaaaacttatttttaaatatttaagatgagttcctgaaaaataacacataatgttcataacacgtttcattgcataattaaatttctacagcaccatataaatgtgagattggaaggactatttaatgaggatagaaactcaaagatagaagtacctataagaagaaattccctcaaagtgtacaaatgtcttagggagtcactgaatttcccttttaacatccaatgtgtactcatgtcaatttttatttaaatctgagaggatggcttgctgtctttcaacattcacattttcattaacatatcagcaggcttattcattaagtcatagttccaaaataaaactaatgaatagaaactgttgaaactatatatatgtatatatatagttatatatatatacaactatatatataaaactatatatagttatatatgtatatatatattttatatacatatataactatatatattttttatatacatatatataactatatatatatatataaaacgggactcaatcaacatcatttaactatagagcatgacaagattttaaggtttctggaatcccatgaggaaaataacatctcactatgtatgttccacttcagcaataagggttatcaacacattacatcatgtgtgtgtgcactacagcaggatactgacaggcaaataaatagaaaataccacttttatgaaaaacaaatatagctcttatttactctgcctttacctagttaaaagaaaaatacaaaaactaataaaaccaaaaactagagacactagttcatgaaatatactggaacagggcaggagaagccaaaagaagggaagagataacactttcagtcatttttactcacatgtgaataaatattttaaagcaaattcagcttctttttttaagttactctgcgtagactcactttcatacaagaaactaggtttgatgaatgtcacttagggcatgtaggtcccttccctgcaaaagctgggctataaataaatactgtagtaattacatttttggtccaagatacaataaagataaagagaatgataataataagtcccatgaatctaactgattgaggaccattttgtattcattgtcttgtattgtcaaataacctgcagtctatcatcatctttataaaaacaatacacaaaaacatgtaaagtgttccaatataactgctcctgtgctccatgaaaaagttggaatttagaaaatacagacatgtaacacaaaccatatgtaatccaagagtcaaaaaagcaatttgaatcaggaaattttgatcaacattttgaacttaaaaatcttcatttttaactgttttccatttttcaatccaagtatatacttgggatggaagccctttaaaatagaaacacttagcattaaaaatgaaaagataaactgccattcttttagtctttttaaaaatgttcttttatgtctttccagagggatttatttttaaatgagaataggcccaactccttatttttctccccaatctgaattcctccctagctaaattctttctgatctgtgtcatccttgttcagtatttgttataccctctctagggaggtatcatcaaactctaaaaatgacattaaatccaagggcttaggaaatattttctacaacataagcctggtttgtatgtgatttttttttgcattttatttgtttgtttttaacctttaaccgtaatttgggccgatgactcccagtgtgaagattatcttatgtcactcataattttaaactcaggattattaggcaagcttgcgtacttatgttaaggagccctgggaggtctgggctatttgccaggactctgtttacatagatgcctcaatatcaatagccggatgtggttagagaaaggaggcttgtggagcattagccaatgccatgcttcccttgcttttgctatttgggggaagaagttatgtgctttctagtgtgacctttggaagacaactaatagggaggacaggagctctgcctgagcactgggaatgtacattcctgtgtttggccttggtgaacagcaaaagaaagtgggaaagacaactaggaatgggaccctggatgatatgacacatactcgtagttcactcataacatttctagttggctttcatcctttttagtttgagtctgtcaattttctatctgtgttattagtctttctgttgtactgtccctaacatggtagtttagtgaccacccatatgcagaagttgctcagctaaccgaattacatggaggacccccttgatgagaaaacactcaccaatatttcaagcctgaagtccagaacacctgtcaatgggactcttctaccggaggtatgaatagtagccgatggagataataaaggactttgaaaaaacagtgtggcattctaactgaaccccagggcttcgtaaggagcctattgagacctggcttgggggtgctgctagaaatcaaatgctccctctagctattggagaaatccagacgttttgtagagaagatgtttgggattgaggtcctttaaagttgaacattttaggattcactgaatgagattctaggggaatggaagtcattaatcacttggagcagcattcaccagcaggaagatctgcagggaggtgctgcttgtggtaaggacccaggccaataggagtggctgctagaagctgctgctatggaaacccatgctaattactgttggaaggagcaaccaatggaacctgccatggccaggagcaacagccaagaggctctactgggagatgtttgaaagcaccattgggtgtatctaaaagagctcggtcaggggatcatctgcttgaagaatctttagggtggagggtgttgttttggttctgttgaaacatgcttaggtgaatcatctttgattttggagaaaaagaaaaagactatcggtcttattaccctccacactaagacagcatcataatttccctcaaaaccagcttctctgtgtgattctgcatttctattgcctgtagtactaataatctacttgttacccagatagaaacaccccattgtcaatgaatcctccatttccctttttcagttttaataaaagttagattttatttcagtacaaatctatcttgaggaaaatataaattataaaagaccatagacattctttcaataaaggcaattaactgattaattcaaacacctgtggtattgggttgccattagtagtaccagtagtcaaattttttaaaagccagattaaaatagagattttattcaaaaaggccacagttgacccttgaagaacatgggtttgaactgcacaaatccacttatacatgaatttttttcaataatagttacgccaagggacagcaagaccaactcctactcttttctcttctcctcagcctgcccatcatgaagacaatgaggataaagacctttctgatgatctattcccatttaataagtaataaatatattttctcttccatataatgttcttaatggcattttttcattttattttctcttactttactataagaattcagtgtcaaatatatataacacacaaatatgtgttaatctattgtttgtgttattggtaaagcttccagtcaacagtcggctagtagtagttaagtttatggtgagtcaaaaattttacgtgaatttttaactgcacaaggggtcagcacccctaacccctgtgtttttcaaggaccaactgcattgcaatatggggaagagaactttgaaatagggagaatactctattgcagaagtggcaaagtctaaaggtcgaacagaaaaagacctttcttttataaggagaagtaaatagggctagcaggaagtttgtgaaagagtggggcaagcgaatggaggtaggcagatggcatgagagtggctttgacagtaaatttttattctctttggtcactggattcttggagtaagtcattgagaagatattctgtaacttagcacttgcttaaaagcttgggaataagataaagttctgggacctgtagggagaagcctgactagcatttgatcaagccaagtcaatgggtaagtaatgagtaattgtgagggcttgggcatagcacagctcatggttttaatgcatgtatagatatacacagacataaatatagaatgggtttatatatgcacttagctgtatgtgtattttctgtcaactgagctgtcatcatcctaggtgctgtgacaccccagaacaattaacatatgtagaacccaaattttaataatgtccaataaaaggaactagggctttttggaaaaatggctgatttcatggctcaggcagagaaaatgcaagataaacctgcaaaaacttgtggcaccagcaagtaagaaattgctgaaaaaaatgttaggttcatactgaaaagacaacttgaaggagctcgcaataattaaacctgagacaatttaagcaaaaaatatatataatagtaatgagtcacaagtatcagaataactccatttctttttcaccaacactcaaatatttgaacttcaatttagagatttgtttatataaaaagtggtcccagatacagtcatgggccccctgtccctccacccacacatgttttggggagttttatctcccaaaatattggagaaaaatttccttgctcttccagcagtgggaggaggaaagtaaccattttgaaatacatctgggtactcttcttagcagggcctaccctcgggagaaagtattttactagagtttaacctatgcgtgttttgtcagagtctaatctgtttaacatgggtttcttacagacaataattagttgggtcttgattttttgtttgtttgtttttctttgagacaggttctccctatgttgtacaggctggtcatgaactcctaggctttatatcctccgcacacagtatcccaggtagctggggttacacaagtgcaccaccacggctggtgtgtttttaatatactccgacaagctctgtcttttaattggcatatttagaccactgacatctacagtgattattgatatagttggcttaacatctaccatatttgttactgttttctatgtgttgctcttgttctttgtttcttcttgtgttccacagggcttttgtcttttgtggcattaactgagcattttacatgattccattttctctcctttcttagcatatcaattctacttttttaaaaacttttttaacggttgctctagaatttgcaatacacatttacaacaaacccaagttcactttctttcttttttttttttttcttgagacagaatctcgctctgtcacccaggctggagtgcagtggtgcattctcggctcactgcaacctctgcctcccgcgttcaagcaattctcctgcctcagcctcctgagtagctgggactacaggcacctgccaccacaccctgctcatttttgtatttttagtagagacagggtttcaccatattggccaggctggtctcgagctcctgaccttgtgatgcacccacttcagcctcccaaagtgctgggattacaggcttgagccactgcacctggcccagccaggttcactttcatataacactgtacagcttcatagatagtacaagtactttgcaataacaagtaatccaaattcctccctcctgtcccttgtatcattgttgtcattcatttcacttatacataagcatgcatatatatatatatatttatatgtatacacacagagatatacataaacgtacataactgctctaaaatatagcgtttattagttaaaaagtagtcaagtagtctcaggctgtagtaccaacaaagcaactggtgggaggaaatgcaaatcatctctggaggaacacaccctcatctcatatcccacctccttcctcttgtatatctagttcctaagggttgaagggagctcctggagggatgcagaagcaggtttctcttacatatccggtcacatgtagctgggaaggaaggcatccctggtttcacttgggctgatgcggctgctgctaacggctcctaccaatgggactgtgaaaatgttgggcctagtttccttgggttggtgatcaactttcttcctgcctcttcaataattgggaaacccttcccacagggacagtcatgcctctctttagccccacaatctatccagacagccaagtgtggtttcctaaggggggctgatcactggctagtcctatcactcctgcccttcttctaacccctcatatgcttcagttagcagtggataccgaagtcttctttccttttttctcagagagcttcctgaaagtgagactgagttgggctttccccatcttattcccaggcatgaggtcccttcttgccctgatggtggaagttaccactgcaggccatcctatcttcagaaatgtctagacaagaagcaatcgccaatctctattcacatattcacataactccaaactcagaaaatctaaatcacctccaactttccatctccataattctcattacagccctcactatttttgacggcaatgtgtgtatgagtcggctcattagttttcctgttccaccctcattctccttcttaattactgatgcctgattaatatctctggtcccataagtttgttgctcaaaaaaaaaattaaatggcttcttaactattatcaagataaataccgacttttctgtatggtatcgaagattttctgcaaaatagcctcgaaggaacgacaagaatctcaaattactcttggacataccttttatgcaaaaaccaagctggacttactcatatttcctaaatagtttccacatgtaacttcacttaatctagtctctctgcctgaaaaattcttcccttgatcttctcataatgcatgtgtgtatatgtatatatataagcacatatatatttatatctaagtcaactttactcatcatttaaagcccttcccagaagtcactttttgaatgattttttaatactaccctgaatcccataacctcctagcagccctctttcctttcagatgccctaacaaatactgttcataactttattttatcatttatatcagttttgcccatattctagttttttgctgtccatagtagctgatagacaaatgtggctattacatttaaatgaattaaaattaagtacagtgtaaaagtcagcctctctgtcacagtagcaatatttcaaacactcagtagtgacatgtggctagtggcttccatactagacagcacagatatagaacatttccatcatcaccaaaagtgacatttgaaagcactgttctggttgtttattgaagttactttattcctcctcctttcagctccagttaaaaaggagacagtgttcagagatgaggctgggagggttgaggaagtctaggtcatagggaccttgtaaactctgctgaggtttagttttaaacataaggaagctgtgcgtggtggctcacgcctgtaatcccagcactttgggaggccaaggagggcagatcacctgagctcaggagtttgagaccagcctggctgacatggtaaaaccccctctctactaaaaatacaaaaattagccaggtgtggagatgcatgcctgtagtcccagctactagggaggctgaggtagaagaaccgcttgaacctgggaggcagaggttgcagtgagccgaaatcatgccactgcactccagtctgggtgacagaggaagactccatctcaataaataaataaatagcataatgagaggtcacgggaggatttagatgttagaaagatcattctggctgctgaattgagaaaggacagtagaggagcaagagggaggagggagactggggaggctactggagaagtccaggagaggcgcatggtgacacgggtgggagctgtgttggtggacgtagatggagtggtcagattcagtgcatattctgcacatgggacttgctgataggttggctgagggatattaacaggaaaatgagtatatcaccccagctttttgcctaaatgaatggacaaactgtggtgctgttatctggcattggaaagactagggaagaagtagattagtttttctgaggagagaggttttatattttagcatgtgaaagtgttatatctagaagcaaattatttgattctggggctgctactgtctataggcttgctaccatgaaggctgtcacctttcctcctggatcccaagcatttgcaaaagccaccacctggactctcagtagaccattttaatttgaggtcaggagaactttggaagaaaaagagcctcctaaagtcatctgttatgactcttattacaaagagagagaaaagctaaagacccagagaagcagggatatctatattattctatgcatgtggtggacatctgttgcttatttttatagcctgacttccagtctgataactgtacttaatctcgctctagtgcaggggttggcaaactctggcctgtcatctgaatctggcctgctctctgattttgtaaacaaagttttcttggtacacggtcatgcccttttttaaaaaaatgtagtatccatggctgcttttgagctacagtggcagaattgagtgacagactgtatagcccacaaaggctaaaaatatttactatggggcccttttcaagaaaaaaaattgctgatctttgctctggtggattattcccccaagtttcagcccatgtactttgggtaaagctgaccccactcatagcctctcaggcttgcctgggctaaatcagtctgcacattgactcccactgtcatgagtgataggttcagaggtaactgttagcctctgcttgtctaaaccatgaaagctcaagagttttattgggacttctgtgacaaagattgtaactttttgtgctggttctgagtccagaaaaatctagctctggaagtgccaatagccaccttggaacagcttatctgaggctgaaggtaacacaaaggagaaagaagagttatacagagatacagaaagtactaaatcctggtgatgtgtcttcagcttctttatccttctctgtcacagtagcaataattcaagcactcagtagtgacatgtggctagtggcttccatactagacagcacaaatatagaacattcccaacaccaaaagtgagatttgaaagcactgttctggttgtttattatcacatttttttttttttttttttgagacagagtctagctctgttgctcaggctggagtacagtggcatgatctcggctcactgcaacttctgcctcccgggttcaagcaattctcatgcctcagcctccccagcagctaggattacaggcgcccgccaccacgcccaaataatttttgtatttttagtagagacggggtttcaccatgttggccaggctgatcttgaactcctgaggtcaaatgatcagcccaccttggcatcccaaagtgctgtgatcacaggcgtgagccactacgtctggcctgttctggttgtttattgaaattactttatgcctcctccacatgggataatatggaaatgttcagaatagtgcaataatcccgagcttccaaagaaagacactctctctgtttaaaggttcattgcctggtcagacggttgcgctaagaacacttaaaagtagcattcaatcaatcaatcaatcagtcaatcaaaccagaaacaacaacagcaacaacaaaatctaagcagtttctacttttctataactaataaaaggttatgttcttctgagtcaagttacttcatttaagctcagagaagaaagaacagattcacaccatatggaaataagcagtgtgttaaatgaagccgttgggaactgaattgatttatttaatgctgattttccatcaagtgcagaaagtaccttgcaaagaattcctaacactagcaaaattggcaacaagaatatttcacacttgtaattgaaaaatgcaaattgcctacctcagtaaatcccaggaggtgtcattagggactaataagtaacattattggacactcaaatacctctataacttcactcccagcattctgacatggaaacttgtgacatcgtacaaggattaactttatgttaactctctaattctgttaaagtgctagttactgtaaggtatgcacaacactattctaggagagtggaacatactggttttggtttttgttttttttaacggattaatgcaaaaagccccatttttcaaattgaatcaacagaagaattactagggagctttcctcctgaacaactctattaatcagtgttcctgtagaaacaaacagcccccaaatcacagtggcttgtaacaacaaatgtttatttttttgcacaattacatgttggcagttgtacttctgttgctgtggctttgctctttgcaccttctcattccaggaaccaagctaaaagagtagcccctactggggacatatcatcattcttgaggcagagggaagaaagtaagaggcagagccaaatcacacaactccccttcaagctgctgcttggctgtggcattatacacttccaatggctgaagcaagttacacggccaacctgacctggtgcaggaagtgtatgctgccaaaggggggtgctctacaaggaacatggcaaggggtgaaaatgcatgattatctcactgggccgagaatgaatccttggaacagcaatgcaatctaccacaagatcaaatttgtacaaccaccttaagtgtatccttcccccaagagactataccaaatttcatctttttaaattttaaattgacacagtgttttgctatgctgcccaggctgatctcaaacacctgggctcaagtaatcttcctgccttggcctcccagattgctggattacaagggtgagccactgctcctggccacaccaaattttataaggataagtatttgatcctatgttcaattctactcttatgtagaattgaacagcctattcttccaccgtgtacaaagacctaacccatgttctcttttttccagactatacgaccaacccactaggtagcatcatctgtaatcctcccaggaatatctgcatattcaaataaatgaaagaatggaaaggctaatgaagctgccaaaattcttctcttttttttagatggaattttgctcttgtccccaggcgctggagtgcaatggcaccatctcggctcactgcaacctctgcctcccaggctcaagcgattctcctgcctcagcatcctgagtacctgggattacaggcatgcaccacgcccggctagtttttgtatttttagtagagacagggtttcaccatgttggccaggctggtctcaaactccagacctcaagtgatttgtcagccttggcctcccaaattgctaggattacaggagtgagccaccgcacccggcactgccaaaattcttactgctagaaattcatatgttccgctgactctttttgacacaccatgctagctacaatgtgcaattgtcctgtctgggaaatggaaaggccaggtatcgtctgggtggaaaggggttttcagtgtcattttacggccttaataagctctgagaattcttactatggaagttcctctctacagcatattaaaaaatcaaaacaaaaccctatcccacattaaatataattcaggactgtaatttttttgaaaggatgtttataattttgcttttgaaattatttgcctccaagtggcatttgacttatgattcgctatgatttgttagctatcatcaccatgtatacttcagaattctttcaaagtaagaaatcccaacttccaaaattattttcgaatgtaatgaaattagtatgcatcctaaattttacaattaatacagctgacatagtgttataggagcttcactcctgaggccagcgagaccacgaacccaccgggaggaatgaacaactccagaggggaggaacgaacaactccagatgctccgccttgagagctgtaacacagccaggtgcggtggctcacgcctgtaatcccagcactttgggaggccaaggcgggcggatcaccaggtcaggagatagagaccatcctggctaacaccccgtctctactaaaaatacaaaaaaattagccaggcatggtggcggtcacctgtaatcccagctactagggaggctgaggcaggagaacggcctcagctcaggaggcggagcttgcggtgagccgagatcgcgccactgcactccagcctgggtgacagagcgagacagagtctcaaaaaaaaaaaaaaaaaaaaaagagctgtaacactcaccgcgaaggtctgcagcttcactcctgaagccagcaagaccacgaacccaccacaaggaagaaactcctaagacgtccgaacatcagaaggaacaaactctggacacaccatatttaagaattgtaacactcaccgcgagggtccgcggcttccttcttgaagtcagtgagaccaagaacccaccaattccagacacagcaggacaagctggcaggaaccggaaaagccatcctctaggtctatacgtgaaaatgcaatttgaggtgctacggaaatcctttaccactgcactatgcagagccgtcgccactagccacacattgctactgagcgtttgaaatgtgtctagtgcaactaaggaactaacttttaaactttatttaatttgaatttatttaactttaaaaagcaatattctgttcagttattgaaaaagtttaatgtatgactagaataatttaagtatatgactctgttttcagtcataaattttataaaatctctacacaaatcagatattttcaatggaaatttagtgtccaagttgagatgtgctttcaaagactaagtataaaaaagtgtaaaatatatcaattttataatgattatacattgaaataacaacattgtatcgggcttaaataaaatatatcacttttactatgtggcattaacatattattaatatagtactaaatatattaatagattaatttaatatatttaaatataaatatactaaatatttgtatattttatgtaaaatatataactatataaatgtataaagtaatatatttaagaatatattaatgtatcattgaaactaattttacctgtttctttttatttttttaaatgggactcctgaaaaattttcaattatatatatgactcatgtatttcttcttttttttttttttttttaagacagagttttgttcttgctgcccagactggagtacaacggtgtgatatcggctcaccacaacctccacctcccgggttcaagccattctcctgcctcagcctcctgagtagctgggattacaggtgcctgccaccacacccagctaatttattttgtgtttttagtagagatggagtttcaccatgttggccaggctggtcttgaactcttgacctcaggtgatctgcctgtcttggcctccccaagtgctgggattacaggcatgagccaccacgcccagcctgactcatgcattcctattgaacagtactacactattacatgttggtgtgtatatccatttaaattgttcaataaatataattttaatggttaaatactgtacaaactatttgataaccattttttccacttctcaatatgtcaagaacatcttgccatagcaatagataatcatctacaaccttgcaaagactaaaatgaatgagagatccttatttgccagcatgaacttactgctgagcaaattatttgtgttggacctccattccttaattagaacatctcctaaaatactgagggcagagcagagaggtagcaggtaggggagccctggaccatgcaatgagatgtgtttccaagaatctaagtacagacttggatgaaaggagtatttaagagctaaacttttcatattacatctgccctagttgtagtaacaataagagacaatcatctgtcaatagcttttgtgggctattctgtcattcaggcttatgctcaagcaataataccatttttaggaggtgactatatagttgacaaaccatacagcacccacagactgcctctaagcaaccaatacaaaacagattgatgagacttgctgtacttaaagtcttgtaagagaacagggagtaataaagtctcaaaatagattctctaataagaaaatttttccttaaatgtcaacttttgaatttcagctcaactatagcaaatctgtactcctcatacttaaagaataattattcttagatggaaatatactgtatttgatatattgaatatactggcacaaaaaggctaaattatttcacaagttttcagatcccaaaggaatagttaatggcaccaatactccttgcacactaaaaattgtctagagacaatattcatcatcaacactacttctcagagatgcaacatggttttgggaaaaaattagaggtttctagtgtttcaacaacctgcatttaaatcctggattcacatttaccagttgtgtgatcttagaatgtaatttaaccttcctaaacctttccccatcttaaaaggaagcagtaataaatgcactgtatgtcaacgtaaatatcaacatttagtatttcattcattggatcctttgaagcatttattttgtgctaggtacatagtagctcatatataagtgctaagtaaaattctttctcttttcttttcccctttatgttacttaaacatctaacccagctacactggagaacacacaggtaaaagagcagagataggaagaaaacaaaaataaaacatgacaccctgccataaaagactaataggattatatacagtttgggtttttttccccctcatttcgcttgcccctaatgattttgtttcaaaagacattgcaatggaagtccactgcaatagagtcatttgctctttcttttgtattacactgacatcgtgtggccatctgaagacgtctctagaaattgacaactgtcattcccagatttttaaccttcagctgcagagatgccatatgagtagttgaatctctacatttaagaaccaaatgacaaaacaagtcccttttggaggctttaaacatattatatacatagataattctaagaattcagattagctgaataatttgacatattattctgttatggtttagatagttaataaaatatttattttttgtttgttttagggagaaaggtctcatcctgccacccagactggagtgcaatagcatgatcataggtcaccacagcaccaaatttctgggcttaagctatcctcctgcctcagcctctgaactagctaggactacagtcacataccatcatgcctggctaatttttttttttttttttggttgagacagggtcttgctatgttgccctggactggtctcaaactcctggcctcaagcaatcctcaagcctcagcctcccaaagtgctgggattatagatgcgagccactgttgtcagtccattagtcttgatttacactttagtaattttcttttgtgatttggagacaaaactttacaaacatttttgtaggcctttaaaactttatatccataagcactgtatctggagcacctaatagatgaaatattgttttatgacagggcttcccaagtcatcagaatccttggcataggatttgttaaaacaaagattggtggtctccatcctcagagtttttgactctgtaggtctgaggtgggatctgaaaatttgcatttctaacaaatttcctggtgatgctgatactcctggtcccagcactacatttgagaaccactggtgttgtgtttgcaactgctaggattcagagcagaccatgagtgaggtgaattccacttagaggagcaagggtatgtgcagctgtatagaagatatttgatttttacctcaaactgcttaccatgtggcaagaggtactgtccgaaagacatggtggtgctgcagtgggcagtggagttccagtttttctattaatttgtagaaatcccctgggaaggtcattgcctctctctggggttcggtgctgcctgcacagagtgagttttgaggatcaaaaaattatgagatagcagggcactgtatccatgagagttaatactttatcagtattaagtgagaaatcaaaataatgtggaagcataatattctttatatgcagtctaaacactaatgcaatgcaagagagcaggaaaacctaagtgagaaagaagtggtttggcacaccattagctaaggctaaaaaggccctcaggaccagctactctcccatagcttcagaatacaattgctaaaaacctggagtgaactgaagactgtaaccttattttacaaatgagagtaccagcacggatgaaattgcagttgcaaactggcctctgaacctagcaagacccatgtccaacagcgacaccttgtggcaatgacttagatagctgcactgagggacagctgactccaatgctctctgtctggggcttggaagaggaccaactccctttatattgaataatcctgaggaattcttcaataatttgggggagaaagtaagacctcaaaagagagacactggattcttgcataaagaataaaatccaggcatctggatttttttaaattacacagaaaaattgtgaccagatttgtatattaaaaatcagtaatatgggtcatgtgtgtaatataatatttgtttctgctgtgggagagtcaagcaggactcagtcttctgtatctagatctgtaaagggctccaataatgagagaaggagcagctgtcactggtcctactctgttgttaaatatatctatgggtgctaaggactacttgaatgaataacctcaggtgttaagaatttgctagatggatttatgtttctgagctgtagataaactgaacattctcccactacaaacctagaaattgtgggtaaaatatagccaacattattttaaatgcattgttgagctctcaagaaaaaagaggaattctacagggccttcaaataataataaatttaaaactatgagtgccaaataacacggaggccaccttggaagggaggagagtttccagtcccagtaaccaaaagtctgcagttttagcacccatatgagcacagaatgtaaaacgctgaacccagctgatgaagctgaaactacaaccatcaccccatgaccatcccccaataaagccagaacacttactgaaccaaaacttcattgaaggggtgggttagaaaaaatccactcactagcacaaggagaaacagtttgatctgtttggataggaaaacaattttcctcaccatttatatctgtgagtcttcccataaaactccttgaggtttgaaacagtactacctatatggtctgagaacccccaagccaggagattaatagttagtcccaatatacaaatatctcgggtgtctgactgaagcaaactggaaacctcttcagaggggcatagttccaagtcaggttgtagaggatttctacagatgaagtctaagatgagttcgcaattcaaaattacaaaacataatttaaaatgatcatccatgagagaatgttgggatacaaaagcaagaataatagaccacaccccacaagttaacagaaaggaggagcagaacatcagttagggatggggatgggataaggaataggtctccactccatgcaagtggaaatgactgctagtggctctcctgagctctgtgttgagaatgttctgaggccatgtccaggctccatgggaaagcttcattgtcatatttagtgttctcttcctattagaaaagtgtgtttatttttctctctttctttgtcaatcttctcagacaaatgaaaacaatttactttacccaaagcactaaaaagaaaaaaaaaatcgacacacatatttatctatttgtcttccctccctgccctcaccagcacctgtgactgttcttgacacatagaaggcgctcacctgatttttaatttttatgggtacatagtaggtgtatatattgatgaggtacatgagatgttttggtacaggcattcaatggtaactaagtgcagaatggagaatgggttatccatccccttaagcatttatctattgagttacaaatcatccaattacactctttaagctattttaaaacatacaattaagttattattgactatagttaccctattatgctatcatatagtaggtcttattcattctttctattttttgtacccattaaccatctccacctccccgccagccccccactaccattcccagcctctgctagccattcttctactctctatgttcattagttcaattgttttgatttttagatcccacaaataaatgaaaacatgcaatgtttgtctttctgtgcctgacttatttcatataatataatgatctccagtttcattcatgttgtttcaaacaactggatctcattcttttttatggctaaatagtattccctcatgtatctgtaccatattttctttatccattcatctgttgatggacacttaggttgctctcaaatcttagctattgtaaacagtgctgcaacaaacataggcatgcaaatatctcaatatactgatttcctttcttttgcatatatatatccagcaaaagtgggattgctggatcatatggtaactcaatttctagatttttgaggaaactgcaatctgttctccacactgtttgcactaatttacattcccatcaacagtatacaagggttcccttttctctacgtcaccaccagcattttttattgcctgtcttttagatataggccattttaactggggtgacatgatatctgattatagttttgacttgtatttatctgatgatcaatgttgagcacattttcatatgcatgtttgccatttatatgtctttttataacttttattttaagtccggggtacatgtgtaggtttgttacattggtaaacttgtgttatggggatttattgtatagattgtttagtcactcaagtattaaacctagtacccattagctattattcctgatgctctccctcctcctatcccctacacttcgacaggccccagtaaatgttgttccttcacatgtgtccatgtgttcccatcacttataagtaagaacatgcagtatttggttttctgttcctgcctttgtttgctaagggtattggcctccagttccatccacgtacctgaaaaggatgtggatggaaaaaaatgatctcatttttttttatggctgtgaaataccatagtattccatggtgtatatgcaccacattttctttatccagtctatcattgatgggtatttagattgatatgtctttgctattataaatagtgctgcaatgaacatacaagtgcaggtgtctttataattgaacaatttatttttctttgggtatatacccagtagtagcattgctaggtagaattatatttctgttttcagatctttgaggaatcaccacactgtcaaccacaatgattgaactaatttatactcccaccaacagtgcataagcattgccttttctccacaaccttgccagcatctgttattttttgactttttaataacagccatcagccattctgactagtgtgagatggtatctcattgtggttttgatttgcatttctctaatgattggtggtgttgagcctttttcatgtttgttggctgcatgtatgtcttcttttgaaaagtgtctgttcatatgctttgcccactttttaatggggttgtttttggaaatttgtttaagtttcttatagatgctgaatattagatctttgttggatgtatagtttgcagatactgtcattctgtaggttgtctgttcactctgtttgtattttctttgctgtgcaggagctctttagttttatttagaacccacttttcaatttttgcttttgtttcaattgcttttggtgtctttgtcatgaaatttttgcctgttcctatatccaagatggtattgcctaggttgtcttctattgttgttatagttttgggttttacatttaagtctttcatccattttgagttgatttttgtgtacagtataaggaaggggtccagttttaatcttcagcatatggctagccagttattccagcatcatttaatgaatacagaatcatttccctattgcttgtttttatcaggtttgtcgaagatcagatagttgtaggtgtgtgaaatagagaaccatttctgggttctctattctgtttcattggtctatgtgtctgtttttgtaccagtaccacgctgttttggttactgtagtcctgtagtatagtttgaagttgggtagcatgatgcttccagctttgttctttttgcttaggatttccttggctattcaggctcttttttggttccatatgaactttaaaatagttttctctagttttgtgaagaatatcaatggtagtttaataggaatagcattgaatctataaattgctttgggcagtatggccatttttatgatattgattcttcctatccatgagcattgcatgctcttccatttgcttgtatcatatttgattattttgagcagtgtttcatagttctcctcgtagagatctttcacctctatgctgaagactgggtgcaggctcctgttggatgtggtgttggcttgggggcagggcactggcgtgagcaggtctggacaccttctctgtgccccacaagcaggagtgatcactcagggtgcgagcagggtccactgttctctgcacagtgttagcacaagggccaggtgttgaggtgggcgttgcgggggagctggcttgctctgtgcccaccaaggctctgtcttcaatgacagccagacggggcaggggggcagactacactcccatgcactggcagggcaaggaaggcaaaacctacctgtgcagacttgtgccagcaaagacacgtgaggagtttcctgggcctagggaagctgcagtgtggggagggggtggatgggctggtgtgtggcctaggggcagccttgctggagctctccaccagtcagatactatctgccagcacagaagctatggcgtggcctccagggcacccaagactgccctgcaagcaggtctggccaggctgggaccccagaaaggccagcagaccaaggggtgctcaggtcgaatcagccctgtctgatggacaagaccaccctgcagagatcaggatggacagttcccctagggctaaagtctcctatgggagcaagtcaggcctggggagatggctctccctggctgtgctccactgcaggtgctcccacatcaaatcgtcctggctccacatcagcttgcttgccctcccacgacttctctaaggagctcttcttgccaacttgagtgtccatggtgatcaagggatcttctcttgccggggttccagaggcccgtggagagagcaggttgctccttgccagttcaagtcacccattctcctggagctgttgtggtccaaaaatcagtcccagtgagcagtatccccaggcagtgttcccaggtttcttcccctccagcccagcttctgtgtcttccctccatccactctcagtgccttgcctctgaggatctgttagaagcatgccagttatctgggtccctctgtgggagctgttccacctggctgtgtctattgggctatgtctagccagctatattgcattcccccacttgcccccatatctgtatgtcttcttttgagaaatgtctatttagatcctttgccctgtattttaatcaaattattagattttttcctatagagttgtttgagctccttatatattctggttattaatcccttgccagatggtgtttggtagatcagctttcatgaaacaaaccttctcttcctctttgctaagctacctgtcttcctgaaatcctcggcctgagtagtgacaccagctggttagaggcatcaaaggcagcaatcagccctcagaggacagtcccagtggggcacaggaagtcagctaatgaaagggctggccaccgaacctcctcatatgccacttaaaagccactatttttactctttgcaagatattttccacttcaaagctgctgcctttccccccttgatatacccttacttcccaattaaatttcaggcatgctttcttccagtttcaagccaaaattccttctgaaaagccatctctccaaacatggttttatgaggaaagctaacagacctgaactgtggggtgttgagggcacctttgatatggcccagagcacagacagccctgtctcctccagggtgcactgctaaacagacaactactttaaatagacagaactccacctctgccagccttgccctcctccctttcacaagccacatccgaaatctctatcatccacactcctctgtttggcctggacaacagagtgactttgacaaggctctcagaatattcttcatgaacgccagcattcctctttgtggtctggttaaccacagtagatgagtttagtttccccttttcacagaattttagaagttggtggacagatgcaagactgtagagatctgattacttagagtggcagaatcagaaggaaaaggagaaaacagcttcacagagaaaatggcatttgagcaagaccctaaaggaaacgtgaaaggccgcccatgaggagggaagagtacacacaaagatggagagagaagatgtgaggtggatatggggcaaaccaagggcgacagcttgagaaaaatctagcaaataccatgaagatgaataattaaaaggtaatgttaataggctggttggggtcagatcatggaacaaaaaagaattggaaagttattctgtggtaaaaacagaaaccacaaccatttaatgagcatctatctaccatgtgccaaaatctaccatagccactgaggttaccatgaagtctcagacacgggcctcaaagtcccctctaggaacacagaggctaatgtctagccaccaggttcttgtgaaacacatgttataaaataagagtattttaccctgtgacagaaacaaagtgctttaggaaaccagaggcaagggaagaagaggtgatggtgggagagtggccaagttcagtgtcactgcagaggaagaacagtttggactgagctttgtgaagtgagataatgagaggtttggggattgatggtgtattagtctcttttcacattgctataaataactacctgagactgggtaatttatgaagaaaagaggtttaattgactcacagttccacagacttaacaggaaacatgactgagaggcctcaggaaacttactgtattagtctgttttcacactgctaataaagacatacccaagattgggcaatttataaagaaaggaggtttaattggcttagagttccatgtggctggggaggcctcacaatcatggcagaaggcaaaaaacacatcttacatggtggtagacaagagagaatgagagccaatcaaaagtggaaaccccttataaaatcatcagatctcatgaggcttattcactacctcaagaacagtaaggaggaaaccgccccatgattcagctatctcccactgggtccctcccacaacttgtgggaattatgggagctacaattcaagatgagatttgggtgaggacacagtcaaacctaatcacttacagtcatggcggaaggtgaaggggaagcaagcacctcttcacatggtggcatgagagagagagctaagggggaagtgccacacacttttaaatcatcagatctcatgagaactcactcagtatgatgagaacagcaagggggaaatccaccccatgctccaagtacctcccaacaggcccctcctccaaatcgacatgagatttgggcagggacacaaatccaaaccgtatcagatgggatatataggcaggaaaagagatgttgttcagggagaaagcaagtgtgcttagatcagtgtaatattaataaatattgaataaacagctggaggtgaggggagatctttgttagtagaattacacgacttctattgtaaatgcttccattgtggatactttcaaactaccaatgtgaagttaaccagcttgcaaaacctctgacaatttatcaatggactcttctaagtaggtgaaggctggcccctgcacaccactgcttggtttgaatatgctgaattcgaggtgactagtaagaattacaggtctgttgatccactgagaagctgagccaaagcagggtcttcaaagactcaatggtctgctgtatttggggaagatggcactgagtaggtagcctccaggtcttatgcccctattcaactgaagcagctctgctgtaaaatctgtttacgctcaaacagtatgcaccgcttcaccattttagaggcacccaataaaacagtattacagttgatatctaaattgaaagctaaattcagattcgcagaatgttgaagagttaatccttccaagtagccctgagtatactccaaagtctcttacgctgatgcttgttaccatatgtctcgtaatcgcttactgccacctgctgggcaaagagatgtagcactcaaggacaaattgtatctcaagaacaaatttaaccctaagcagctgtaacatccagttcttggtcctccggtgtcactacagttgttaagacagaagctgttaaaaaatgacagtctaggcagttcagagaaatgtccccagtggcagctgcagccatcgccagtcattctgagagctttcacgtgactggtgaaggtcccattgattggcccagacttcagtgacccctgaggtacaagggaaggcatttctccccatatgatgctcctctcagtgttcaaagatcccaatggatactccaacacccaagccaacatcttgattcccccaaaattcccatggcatctgcatatctagttcatgggcactccttacttacatcaaatatccctaacatttcctaaactaaaaatatccaaggatgatacttcactgagctctaatatttaaaagactttgcattgtctattatacaaaaacataattacaagagctaaatatagttgctgacttacttttcttacttcacaaggaaagaggacttcattatgagaagaaagaaaaaacactcaaaagaaggcacaaaagatattttaaagttattgatgggctaattattaatgtgatcaccacttttcatatgataacaacaaggtgaaatttacagttatttatgaatatgctaatatgggtattaaaaatttttaccaggagtgaaaatttttctttgtattatttattattttttctaggtgtgtgtgtgttttaataactactacttagcatgactcttttgtgagtcacctgctcaacgtcacatgtgctatggtttaaatgtgtatcccaaaaggcatgtattggaaacttaatccctaatgcaacagtgttaagaggtgagaccattaaagaggtagttaggccaggagggctccaccttcaagagtggatcaaggccattatctagggagttggtttgttataaaaggacaaggttagttcattcctctctcacttgccctctcttgcccttcaccttcctctatgggatgacatagcacaaaagccctcattagcactggcaccatgatattggacttttcagcctccagaaatgtgagccaataaaaatttctgttttttattaaaaattaaaataaaataactactatttaatacaaaaatggaaacttcgtaaacataacaactaacattctgatttaacttgattgagaaaaattaaataaagtggagtttcttgagccttagagtggtggacaaattcagatgttacatttgtttctaaaaacagagcatactaatatcaacccccccttcccaaaaaaataccctacagctaacatcattcttcacgacgaaagacaatacgttcttgctagaatcaggaacaaggcgaaaatgtccacttaccaccgcttttcagcatggtattagaagttctagccagtgcaataaagcaaggaaaggaaataaaaggtatgcatattggaaagagaaaaataaaactgtccctttttgtagagagcatgattgtctatctacaaaagtcccaaggaatccaccaaaacaccctcctagaacaaaaactaattgtatttctacatactagcaatggaaatgtggaaggtaaaattttagatacagtagcatttacaattgctaaaaatattcttgagtgtgaatctaataaaaacaagccgaaaactacgaaatagcaatgaaagaaatcaaaaatctaaatgaatggagagacatactgtggtcatggatcagacaactcaacactgttaagatgtcagttctccccaaattgatacataagtttatcgcaattaccagcacaatcccagcaagaaattttgttgataaggacaaagacaagattattctaaaatttatatggtgctgggcacagtggctcttacttgtaatcccaacactttgggagaccaagctgggagggtgcttgagcccaggagttcaagactagccttggcaaagtaggaagaccctgtttgtttgtttgtttgtttgtttgtttgtttgtttatttagagacggagtctcaatgtctcccaggctggagtgcagtggcgccatctcggcttgctgcaacctcccacctcccgagttcaagcaattctcctgcctcagcctcccgagtagctgggactacaggtgcatgccgccatgctctactaattttttgtattttagtagaaacggggtttcaccatgttgcccaggctggtcttgaattcctgagttcagaaaatccgcccgccttggcctcccaaattgctaagattacagggaactgcgcccggagtaagaccctgtttctaagaattaaaaaaaaaaaaaaaaaattagccgggtgtggtggtccacacctgtggtcccagtcactcaggagactgagacaggagaatctcctgatcctgggaggctgaggctgcactgaacagtgatcatgccaccgcagtccagcctgggtgatagagtgagaacttgtttcaaaaataaaataagataaaatgtatatggaaaggcaaaggaactagaatagctaaaaacaattttgaaaaagatgaatcaagtgggaagactcactctacccaatttcaagacttactttgccgacacagtaaacaggttacatggtactgatggagggacagtgacataaatcaatagaacaggataaagaacccagaagtacacctaagaaaatacactgaactgagtcttaacaaaggtcaaaaagcattgcaatggaggaaagatagccttttcaatatacggtcctgcagctattgtatattcataagtaaaaatgtgaaccttgacctaaatctcacacattatataaaaattaactcaaatttttgaatcatagattttaaagtaaaatgtaaactataaaactttagaagaaatcataggcaaacattttcgggagctggggtttgacgaagagttcttagacatgacaccaaaagcatgcttcataaaagaaaaaaaaaatgataaattaaacttcatccaaattaaaagtgtttgtcctgcagaagacccagtaaagatgtgaaaatacaagccgcagactaagaggaaatatttgcaaaccacatatctgataaaggagtcatgtctagaattcataaacactctcaatctgcaacagtaaaaagttaaactattcacttagaaaatggcaaaagacgtgatgaagtatttcaccagaaagcatacataaatgtcaaataagcacatgaaaacatatgcaacacctaatccaattgtgaaatgcaaattaggatcactatgagctatcactgcatgcctattaaatcaaatcaatgaaaaataatgacaataatgaaaaataatgcctgtaagaatatggaaacactagatgtttcacacatcgcgggtggtgatgttaagtgttatggccactctgaaaaactgtttggcagtttctcaaaaagaaataaacattcacttactaatcaacctagcaatcatcctcctggacatttaactcagagaaatgcaactttaagtccataaaagaacctgcatatagttgttcatagcagtgttatatgtaacagataagaactggaaataactgaaaatgtcctacaataggtgagtgattcagcaaactgtgtacctccaaactagaaatataactcggcagtaaaaaagcaataaactattgatacacacagcaacttggcttgattacaggaaagtgcactaattggggggaataaagccaatctcaaagggtcacatactgaatgatttcatttatataacattgaagctacaagctattacaggttacaagcttagtttattctctgcattagatttgcatgatttacttctctgtgtctctttattagatgtcatctccagtgccaatgtcatcctttaatagatgaacagttgccagggtttaacgatgctagagggaggaggttagtagtattgtaaagcagtagccctggaagatccctgtggtaatgaaatagttatatatcttgattgaagtggtgcttatcaaatctaaacatatggtaaaaggacatagaattatgcacatgctttttatcattgtcaatcaactccttggttttgatgatgtaatcactggggaaaccaggtaaaggatacacagaacctctgtactatccatctctgcaatttcctgtgaatttgtaattatttcaaaatgaaagtcttttttaaaaaaaaatccaactcacaagaatagagagaggatgcgctttgacaattaatatatttgtgtgctatgcatgatcgaattacctcttcttggtaaattcaa

SEQ ID NO: 12013 - DNA, 27780 bp, Human
tataatgacactgatggaaaattccatcaaatagccataacgcatgtcaagcactctgctctgcataccttctgtcacactctaaggatgagagaggggagagttatcctggttctggctgtgtcctccccattttggccatcttatgagctccttatagaggtctgaaatgatttggagtccagagtccatggctgtcaggatatgactagggtgagcaggcagttgggaccaccttgacctccagcctcctggtcctcagttcctcgggtatcccactctgctgggggcttagtgaccatgtttgggctccagagattattttttccttccactcctatccttagtttgttactaaccaggcgggagtacaggcatgtctctgaagacaggctcagggctgtgtgacagctgacgaccaggctgcagggaaccaggtcccatgcagtcctactgccttcttttttttttttttttttttttttttgaggcggagtctcgcttttcgcccaggctggagtgcagtggcacgatctcagctcacgggttcacgccattctcctgcctccgcctcccgagtagctgggactacaggcgcccgccaccacgcccggctaattttttgtatttttactagagacggggtttcaccgtgttagccaggataatcttgatctcctgacctcgtgatccgcccgcctcggcctcccaaagtgctgggattacaggcgtgagccactgcacccggctactgccttcttactgtcgccacagcctggataaaatacgattcttctgagccttttttttttttttaatacagagtttcactcttgttgcctaggctggagtgcaatagtgcgatctctggtcaccgcaacctccgcctcccgggttcaagcgattctcctgcttcagtctcccgagtagctgggattactgacacgcgccaccacgcccggctagttttgtatttttagtagagacggggtttctccatgttggtcaggatggtctcgaactcccgacctcaggtgactcaccggcctcggcctcccaaaatgctgggattacaggcgtgagccaccgaacccagcccctctgagcctcttgaatacaactggggtcatgcctgctttgcaggtttgtcttaaggattaaagctgtttggggagtgtctggaggagggtgagtcttgagccaacccctgcatctcccttccagggcctcccggtaataaaccccaagtaaatgtgcactttgtccgtcctctcggagcaggtctccgggtactcctgtgccaaaccgatttccgcccccaaggtccttctcctcttagaaatcctgacgcagctcctaggttccttcgcagtgacagccactcttttctatttgtacgtagctgtagtgttttgtgggtacgttctctgaacaacaaagtggcccttctaaaggctgttctgtggggtccacagcctcgccacccccagcctctgcagcggcttctgaatgaatgaaataagcgacggcgccctctccaccaccccacccccgccaactcggcaggcagggatcccaggcgcgggttctggcggaggcggtcccgcgaggcggggggacttttctaggcggggtgggggccttgggaccacctttaggggctttttccccatcccctggccccaattcgcagcgtttcgccacccagggcccgcagggctccaagcccttcttccccagcccgcgcgctcaggcccccgcccgcccccggcggtggccccggaccccgagcggaagggggcggggggtgtgcggggccgggaagcggggagcgcgggcggcggaaggtggcgggagggggtgggggctgggaagcaccgtgcgcgggcggcgggagggcccgggcggggctgcgcggtggtcacgtggggcggggccgggagggtacttagggccggggctggcccaggctacggcggctgcagggctccggcaaccgctccggcaacgccaaccgctccgctgcgcgcaggctgggctgcaggctctcggctgcagcgctgggtgagtgctggggacccggggccaccgcagcgtaagtgaccttggcggggacggtgctacccggccgccgagacgggttcctctgcgccctcagtcgggcccaggcgcggccccgcggcgtccctgggggccggcggggagccgggaccctcgggactgtccctgacgggcgggctggggtgggagtccgcgcgctccgaagcgtcggcgagaaaagcagaaaacaactccgcccgccagccctctgccctccgctcccctccccgggctgtgcgccggaccccggccctcggagcggggacgcggccaggaccgccgagggaggcgcctgcgaggaagagctcggccgggtccggagactgctgcctgggaccgcgctcccagcgcctgggcctcggtgtctccgggccaaactgccgacataatcgcatctgccggcatctattttcggtttatttccccctcattgcgaaggatttgcctggccaactttctgcgcaagatcccacgcaattcctgggaccccagaagacaggtcctgttgaagaacaggaatctggcactgggtgggctggggaggaagccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggttagtagccctggaggccggggggagttggcctctggggagcagtgggtgctgggtgtggggcgttgcaggcaggctggggtgggcgacccaggtggaagtgaattgcacttggcttcctggtgggcctctgtcacccccttcccaggcgctgagaaagccagcaggctggcaaagaaaaggaccctagcgcaggccccacactcctcctcctaacggacgagagaccccccaaacccactggagaagtgacgctgtggggttcaaatgcagacctggcacctttttgtagcctggaaaaacattcccactgcctgctgccggaggagaggatagctgagatgcactctctttgaatccaaacgttcaggaacgtaaggcgaagaggcctaagagggcgttggctggctctgtctctcaggctggagcacagtggcgcgatctcggctcactacaacttccgcctcccaaattcaagctattctcctgcctcagcctcccgagtagctgggattacaggtgcccgccaccacgcccagctaatttttgtatttttagtagagatggggtttcaccatgttgaccaggcagatcttgacctcctgacctcaggtgatccgcctgtctcggcctcccggtgagtcacggtgcctggccaagaactgtttcttgttggctctggtgctggtgacttagaacccgccagctcctggagaaaggggctgggccgcccaccctgtgtagctttcccaaagacagagtcaaacgtctcctggagaacagaggcttcccttcgtctttggtcatttgtcctctagctgggggtaccccctggtggaaaggcacaggtcccttgctccccaggtggcaacgcaggccagacacggccctggcacagctctcctgggtgttggctcaggacagccctgtttccaactggttaggcggtgaggggtggtggccctttggttccaggttgaaactgcctatgtggtgctgatttagcagactggggaggctctttttgtaggcaggttcttttctttccccagctgctggacctgggagttggaagagaagttgcacccattttaggggtaacagatattttctgttgctcttggttggattgggaagtgaattgaagggaggtcacgtttcaggggtgccttgggatgtctgtcagtgattttcttttctttcttaatttctttttctttcttttttttttttttttgagacacactccctctatcgctcaggctggagtgcagtggtgcgatctcggttcactgccacctccgcctctcatgttgaagcaattctcctgtctcagcctccctcccaagtagctgggattgccagtgcccatcaccacacctggcttttttttttttttttgtatttttagtagagacgggctttcaccatgttagccaggctggttttcgaactcctgatctcaagtgatccgcctcagcctcccaaagtggtaggattacaggcatgagccaccgcgcggtggaggggtaattttcttaaatctggtaatgagttgtggttgtgtagagtaacataccgtcctttcgagatatggactgaaacattgagagggaggagttacaggtatgccgattcttcttttctctctctcctttttttttttgaggtggagtctgactctctcacccaggctggagtgcagtggcaagatctcagctcactgcaacctccgcttcctgtgttcaagccattctcctgcctcagtctctcaactagctgcgattacaggcatgtgcctccacactcagctaatttttttatttttagtagagattttttgtctctcctaaaaaaatccaatgtaaaaaaatcccaatgtgggggttttgccacgttggccaggctggtctcgaactcctgacctcgtgatccgcccacctcggcctcccaaagcgctgggattacaggtatgagccactgcgcccagtctgctgcctcttttcaatggtctggcctaaggaaattattggaaacatgtgcggttgagtgatatttactgggcacttccacatggtccatgtaaagggagatggttggggtgacaggcagttgagtctaggggaggcatgtacagatgtgctgtgcctctgggatatcagggtggcaggcagcagtctctacgtctggtcccaggctgcctgagaaagagcatgtgggaggcaaaccttgcgccctggcatggttgttaatgtttatatttaccctagcttgtgtggggtaggaggtttagggatcaaattccactctgtgtttagacatttttttctttctttttttttttgagacagagtttcactctgtcacccaggctggaatgccgtggcacaatctcagctcactgcaaccttacctcccaggttcaagcaatgttcctgcctcagcctccggagtagctgggattagaggcatgcaccaccatgcctggctaatttttgtatttttagtagagacctcaaatgatctgcccgcctcgcctcccaaagtgttgggattacaggtgtgagtcactgtgcccagccatgtgtttagacttttaactaatctcttttttagtttcaagccttatcgtccgcctctgtagaccactcctgtgcctgtttcctgatccttccaagggccattgtattccctgtctgctgcccctcttttggattcttctgcacatttttttgttcatgcattcattcatttattgtttgattaatgacagggtcttgctttgtctcccaggctggtgtgcagtggtgcgaccacggctcacggcagcctcagccacccagatgtaagcgatctggttcccacctcagcctcccgagtagtaagtagctgggaccacaggcggtgcccaggtttttttttttttttttttttttttcgtttgtagagacagggtctcactgttgccaggactgctctgaaactcctggtttcaagtgatccccttgcctcctcccacttaggccttccaaatgctgggattacaaggcatgagtcacctccaggcctttttgtacttttaaaactctgcatcagtgtataaacaatgttattaaagtttatatgacttcagttacactacatggatcctttttcactcacggttgtgagatttatttctgttgctacatccagttctagtccatttgtgttaagtgcccagtgtgtttatctactgagggacagttatgttatttcgtgttcactattatcccatgctacaataaatatcctgtgtctcccagatacttagaagagtttctgcagggcacatgtgggagagtttgtttctgggtcatgaggtgtgttcatcttccatcttgctagatgctggcaaagggttctccagtgtggttgcatcaatttactcgcccagcagtgtgcagagttcctgttcctcacatttaccaacactagatagtaccagactttgatttttgccaatctgatgggtttgaagtggtacccctgttttaatttcatgaccagaaattcaaatttaatctttgctgtaggacaacagtaacccacttatgcctagtgttccattattagaacgctaagcatgtgggagtttttacatcatactgctcaaggtcatcgccaaggtctgatgtttttactcgtgcaaaaatttaaaaaattgcaacctctggcataaatgggttgagtgacacttttcctgtttttattgttggtcagtgatggcatatttgctggttttttttgttttttttttgaaacggagtctcactgtgtcgccaggctggagtgcagtggtgtaatctcggctcactgtaacctccgcctcccgggttcaagtgattctcctgcctcagccccctgagtagctgggattacaggcgtgtgccaccacgcccagctaatttttgtatttttagtagagacgggatgtcactatgtttgtcgggctggtgttgaactcctgagctcatgatctgcctgtcttggcttccctaagtgctgagattacaggcctgagccaccgctagcctatttattttttattttaaattttaattttctatatagagacgaggtcactatcctgcccaggctggtcttaatctcctgggttcagtcaatcttcccaccttggcctcccgaagtgtcagaattatagatgtgagccactgtgcccagcccagaactgatgttttctaaatgctgggtgctgagaaggatgtgtggctggcagtcttgactgtgttatctgtctttaccaggccagtaacttctttggtctggtcatcaagataatctagcatcaccagcaagcatgcatggagaaggatgggcccaatgtggccaagatggtaacgggaccagtagagagccctgtagaagacatctagatattctgccctaagagcccggagggccgggctgtctcatgaccctctgacgtgctgacctggactctggcagaatgtgcacacacacagtcacacagcttcctggcttgcgcaagtcccaggagggcggtgccagccacaggcttttcccattcgagggttggaagcgtatcatcaaaccacatcagagtgctgggggccacctgccacccattcccaacccactcagccttcctggtgtttgggacatgctttgctttggcagtcaagacagcagaacaaatcaacttttaaggccttgtcactgatagtacaatttccattatttttcatccaaattaggatacttctgaaaatagaaatgatgactctgggatgcaaacgttggctgtcctatgtataaggagatggcttttcacgctcccagtgactgaggaagtttctcccagatggcgctgctctgagcctggtgcagggtaggcactttcaaaagagtgtctccttgtatcttccatcagccttgcgagatgggtatctgttcccagggccccaagggaggaaaacaggacctagctggatccaagagctaggcctttctttttttttttttttttgagatggagtctgactctgtcgcccaggctggagtgcagtggcgtgatctcggctcactgcaaactccgcctcccgggttcacgccattctcctgcctcagcctcccgagtagctgggactacaggcgcctgccaccatgcctggctatttttttgtatttttagtagaaacggggtttcaccgtgttatccaggatggtctcgatctcctgacctcgtgattcgcccgcctcagcctcccaaagtactgggattacaggcgtgagccagcatgcccggcccagagctaggcctttctgtggctggccttcgcgtcagcctcaactaccctggtgtaatctcgcctgcggttgaattagggaaccgccgtgttctgcaagctggagaggcagaacactaatgagcagaacactaatctcattgcaatctcaaaggatctctaaaagcttttataaagcaggcccaaggtcctttggtatccgatgcagacgtggtgaatgcattggctctgtcagcatctgagcaagtcagtaacagaaatggggagtaaaagctttcagaactttccagaatattgactaaattgtcttgtttacaaccaacaacgacaacaaaaaataactgctgagggccttcgtagtgtctgctgtttcaagtgtacagtagtcattttgtctgcaggatgtggggttgctgtggctgaccttgtacaatattccactcataggtgtcttcaggcctatggagagcagcttgcgtgggctgggcctgcagtacctggtttgcatagatgattggcaggtgggcagcacggggaaggacctgtgagtggccaacctggttcaggtgagggaggtggagtggggcttctctgcttcccctggttccctggaagcctccaaggctggtgagcatcactgctgcctctgcacacctgtgtgctgggtgggttttctgacaggttttcagttgcttcggggctacagctgcagggagcctgctccatgggacagatgggcctctggtgcccgttcatcaggggactgatgagaccgaggcctgagagccctttggattttgtttttgtccttaatttaatcataagccaagaatctactaaacacagttccattaggggcaaagacgtaacacatcagaggccacagcaaggctgtgattcatactcagaaaggaaaggtctctgggtcacaacagagcatagttgaggtcagcacactcccacccagtgcagggctgctccagcattgaggtgtgtctggcaggttgaagtaggggaagatgaaactcgccgaagtcttgttttgtggttgcacttaagtggtcaaaacttcaggagcaactgccgttattagcggtgagtgccaagactagtttttatagaagagaaagaaacaaagtactctgggaaggtcttactgagccttcacagtctccccacctttccactgttcccgtgctcttagccgctctgctggcctataaggcacagtcttcatttgtggcttctggcaaaatgtaagcacttgacttttgtttttgttttgttttgttttgtttttttgagacggagtttccctcttgttgcccaaggtggagtgcaatggtgcgatctcagcccactgcagcctccacctcctgggttcaagcaattgtcctgcttcagcctcccgagtagttgggattataggtgcacaaccaccacgcctggctaattttttgtatttttagtagaaatgggatttcaccatgttagccaggctggtctcgaactcctgacctcaggtgatccacctccttggcctcccaaagtgctgggattacaggtgtgtgccactgtgcccggccaactttcaattctttagagctgactatgagaggagccagcagtatagccacagcaccaacgaatgaggaagagcaaaatactgcatgacagctttgctaagaattctttcactttttttgtctatcagccaggagctagcaacttggcttatttggaaattttaagtgtacatatcctgtctccttaaatcctttacagatttaaagtgcagtctacctgagggctctgtgaccatgtaagaaagctttttctttctttttttttctctgagacagagtgttgctctgtcgcccaggctggagtgcagtggtgtgatcttggctcactgcaacctctgcctcctgggttcaagcaattttcctgcctcagcttcctgagtagctgggactacaggcagcaccaccatgcccggctgagttttgtatttttagtagagacagggtttcaccatgttggccaggctggtcttgaactcctgacctcgtgatccgcctgcctcagcctcccaaagtgctgggattacatgcgtgagccattgtgtccggcctttttttttttttttttttttttttgagacagagtctcgctctgttgcccaggctggagtgcagtggtgtgacctcagcttactgcaacctccgcttcctggattcaagtgattctcctgcctcagcctcccaagtaggtgggattacaggcacccaccaccgtgcctggctaatttttgtatttttagtagagacaggagtttcaccttgtttagtagagacaggctggtctcgaactcctgacctcaggtgatccgcctgccttgacctcccaaagcgctgggattacaggcatgagccactgtgcctggccagaaagccttctttattgagcttggtggcagcccaaaactgattctttaagggtgtcaggacttaacacctcctgtgacttagccgcacctcctctcctttgactttcattccacctccttccaggatcgcaaggtccctatttgtcctggaaacggcttcaaggtagtctagggtgccgtttgccgggggaggaaggtgctctggttgatagagtcgcctggccgcacactctttttggcacataacaacgttctacagagccggggtggagcgtgctttctcataagtgctctgcaggtttggagagagaggatatgaggagcacccttttctgttttttttaacccaaagattagcttggaaaaggggcagaggggtgcactggaactcaggtctgcctaagcagcacagcagaccaaggtctagagatgacatctgctcgcagctgttcttccaccagcccgcatcctggaaaggggtcttgtggcacacaagagttcacatccttccctcgtgaaataaggactttgtgttcatcatctcttgtaagaagcagagcagaaagcacagaattaagaaataaaagggaagtgggtgcctatataaagggaagtgaaaatgggttgctgtcccatgcaaagaccctggaaagctgttaacagctcagcttgtcactttcaccatctgcatttgtccagagtgattgagatttgcgttgttgtggagagaaaggcgcctgttgcacaatggagtgagattgccactgctgtcaggacctctgtgtttggcttgacactttttgagttctcagcagtctcgggaccctcaagagtggaagcatttttggatgttaaatgctggggttaattgaagttaagagcttgttttactgggcatggtggctcacacctataatcccgacactttgggaggccaaggcgggcagatcacttgagtccaggagtttgagaccagcctgggcaacatagcaaaaccccatctctacaaaaaatacaaagctgggcgtagtggtgtatgcctgtagtcccagctccttaggaggctgaggggagcagatctcttgagcccaggaggcagagtttgcagtgagccatgatcgtgccactgcactccagcctgggcaacagagtgagatcctgtcttaaaacaaacaaaaaaaacaaacttgttttcatttagactcttcctggcgttggggacctattggaataggtttagtgtgaactgagagctagaagtgttagaggagagagggagggaacagagcccgctggagcgagtgcccttcctaccttatcactgcatgccaggcatgtgccggcgctttggtcctcctcatttcattcttgactgccacctgagacacgatggttactagctccattttataggtggtgaaactgaggcttggggaaggtcagaccccaagggtgccatttagtcagtggcagagccagatccaaatgcaggtctcctgactccaagtgcagggctcattttatcgtccggttgcagcacgctggcggccccttgagccccaacctggataccataggggaggagcagagaagccaggaacaccacagccctgggccaaggtgcggggctgaaagaacttcccagcgctcagcctgggactagtggaatgggctgggccctggggctggcagcggtggccccggggagcctgggaatgagtagggagcacagggaggtgtgggagggcctgggaaccatgaaaaggagggcgggtgcagggaagtcgcctgctagtgaagtggcgagggggccctgtgggactccagggaatggccacggcaggttgtcctccaggagttgagagccactggacatggcagctgcctgtgttctcagccaccacagtaaccaaagaaatcttggttttaaaattcaagttgccatggaaacgctcccatcctcgacttggcttattatttaaaataacatctctacagcacaaagcccccgggtacatccaaggacactgctgtctgcccacgagacatgctaacctcacagtgtggaggctgtgtgggtcactgacatgcatggccacgtgagacgctgcctacccacgagtcacggaaaaggggaagattattaagaaagtcactaggggccaggtccagtggctcatgcctgtaatcctagcactttgggaagctgaggcagttagatcccttgaagccaggagttcaagaccagcctggccaacataacgaaacacggactatactacaaaaattagccaaacgtggtagcacaggcctgtaatcccagctactcaggaggctgaggcacaagaatcacttgaacctgggaggtagaggtttcagtgagccaagattgcgccactgtactccagcatgtgccacagagcgagactcccatctcaaagtcactagggaggaagcctcattggtgggaaggaagaccaaattggaaatgctctgaggaatcattaaaacaaatgtccttttatcagtttggtggctcagggcctttagtaatactgccaactatttttcctagaagaaacaaaactgaaataataggaacatactcacttttttttttttcttaaaagtaagggtatgttgtgaaaaaaagtctccccaccgtagtgaccgactgccgtgcatcttccttggcattttgcatgtagtggcaggagtgttcctacatgtgtagattgctgagagggtcagatgcttatggtcctcagtcacccacagcttgctttttccccacttaacattgggacttggggcatttttactctgttaatacaatagaattcacttcaactagttggttttttacttttattttattattattatttttagatgaagtctcaatctgtcgtccaggctggagtgcagcctctgcctcctgggttcaagtgattctactgcctcagcctcccaagtagctgggattacaggcatgcgccaccacgcctggctaattttttgtatttagtagatacagggtttcaccaccttagtcaggctggtctctaactcctgacctcaggtgatccaaccgcctcggctacaggcatgcgccaccgtgccccaccaactaattgcttttttaatggttgcttcatattctatttaaccacttaccgtaatttaacagttactctgttattggatacttgattcatttccaggacatgcagatttagaaactggtgggcgttgctggttgatgtctcggtggttgtgcccacccaccccaggcactcattatcatgccttccgtttccccacttcctaagccctgcaagaagtgccaaactgtccagcccttgccaatctgatacatgctgaatacctccttgattttatctgcacctccctgaggttgaacttattttactttattttattttatttttgaggcagagtctcactgtcacccaggcaggaatgcagtggtgaaatcttggctcactgcaatctccacctcctgggttcaagtgagttgaagcaattctcctgtctcagcctcccaagtagctgcgattacaggcacctgccaccacacctgggtaatttttgtatttttagtggagacggggtttcaccatgttggccaggctggtctcaaactcctgacctcaggcgatccacctgcctcagcctcccaaagtgctgagattacaagcttgagccaccatgccggttgaacttatttttatctgtgttggccatttgtagtttttctattatgctggttccatttttctgactttgaagagccttttgtggaaacgaagcctaaagtatatgtgagtactgctttgtttcgtcagtttttgttttaaagagacttttcagtgtaatgcaagcattttcccttgaaggctgtgtttcctgtcaatcctaagctttcctccagcattacctttttaaaaaactttattttctatattgatggggtctcacaatgttgtccaggctggtgttgaacacctggcctcaagtgatccacttgccttggcctcccaaagtactgggattataggcatcagccaccgcacccagcctgtttttcaaagggcattgatttttttcataaaactttttaaattaagatctgtgggcctggtgcggtgcctcacgcctgtcatcgcagcactttgggaggctgagtcaggtggatcacgaggtcaggcgttcgagaccagcctggccaaaatggtgaaaccctgtctttactaaaaatatgaaaattagctgggcatgatggcacatgcctgtaatcccgctgctcgggaagctgaggtaggaaaatagcttgaacccaggaggcagaggttgcagtgagccgagatcatgccattgcactccagcctgggggacagagtaagactccgtctcaaaaaaacaaaacaattctgtgttgcatgtggtactttttgtgtgtgaggagtccagtgtgaagattcagacttcaggcagccacttgtacaagcactgtcctgttgcctctctggcctcacctaggtaacgctgattcctccacggaggatgtgcttctgagtggtccgttgggtgctgtgctgatgagcatcacccagcattttacgacacatgtgctgccccagagggctgggctcccgtcagagctcttttccactggctgggtgcggtggctcacacctgtaatcccagcactttgggaggctgaggccagtggatcacctgaggtcaggagttcgagaccagcctggctaacatggtaaaaccccatctctactaaaaatacagaaattaggtgcgtgtggtggcgcacacctgtaatcccagctacttgggaggctaagacacaagaattgtttgaacctgggaggtggaggctgcagtgagccaagattgtgccactgtaccccagactgggtgacatggcccacagaccaagaccctgtctcaaaaaaaaaaaaaaagcttttttccagagccatcttgctgtcctcatatatttattctcctagatgaattgttgcttaagcaacaatgaagtttaaattgttcttcagatagaacccctaggtgccaggcagtttgttaagcactgacaccgcagtcctgtgactttcatgacgacctgtgacctgtgggaggtagaacacctcacccacccgtgggagcccctggagtgactgacaggaacccctgcctcacccagctccccgcgccgcggctctccccagccctggatgcaggcgcccaggagacatgtattgcttttgttgagctgctcacttaggagggtgactcagagttcaagctggaaagcactggcttgtgactcatgagccagtgcaagatcaaacggctggggcatcgaggtgagagttttccttctcagaagcctcatctccgcagccggaagcagagcccttggctgactggaaaaaccagagaggccccgggagtgggtggatggccagcccagccccacctctcagcctcaacctccaccagcccacaccgagcttgtttgtctgtgtcctgtcgaaactaggactcctggattgtaacttttcttacatttccctgtcccctgggtcctccacttagggtgtaatcacacagacaggctcttaactgtttcatatcactcacttgggaaagtgtctcaagctgttctacaaatccatgcaaaggccgtttaaaaatagcagcgaaggccctggactcggtctcgtccagcacagccccttggctctctctctgggctctggccgcctggcccccggggacccacacgaggtcatggcgtgctgcgggcagtggggcggggatcccatagacacctcagctccttagagttctccgcctgggccaggacgagcatgggggtccccactgatgcccgagacggtgcccctgtgtgtgtgagccctcgacccacataacagagaggtgtcctgatgccctctgtcctctccaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggtaggctgtggggctgcgtcctatgtatgtcccctcccaggtcggtctgtgcacactgactccaggaatgggaagccagccctcactgtggcccacagaacattgtcctggactgttgaaaaatggccctgaccctgagtcatgtcggctctggaccacgcctccctcctttgtcccataccccacgtgtgtgcatgagtgtgtgtgcttgtgtatgaatatatggttgtgtgcacgtggaggtgtgtgggggagtaagtgagcttcggaagtgttcaaaaccagctagcccctgtgacgcccgccgtggcacagtggcagtttatcagtcccgcccctgattccctttgtctctgcccagccctgaccctcggactgagaaccaagaatgaggagtgagccatgttgagggctggagagggtctctgattgtcagcaaatgggagcagatcaggggagacacccactttgcccgtgtgtcactctgggctgttccccagtgccccccaacccttgggcccttgaattgggtagggcctctggttttccctgggttgggcttcgtgtgtgggcagcgtgcccatccaccgccatcccgggagacccttcagtcagtgggtgactctcttccaggccgggcacaacttctacaacgtggacatgagctacttgaagaggctatgtggtaccttcctgggtgggcccaagccaccccagaggtgagtgcctgctcctctgcaccgctgtaatgtgagtggcaggcgttggtttggggcagtgggaagtgggagagtgaaggcctctctggcgtccgcagggctcatgctgcccagggctgccgacaccgcttgaggtacagtacttgtttcttttcatttttgtattactttctttttttattttattttttccttctcaagttattagtagagaagatgctggtgcttttttttggtttttgagagagtctcactctgtcacccaggctggagtgcagtggcacgatcttggctcactgcaaactctgtctcccgggttcaagcgattctcatgccacagcctcctgagtagctggggccacaggcttgcaccaccgtgcacggctaatatttgtatttttagtagagactgggtttcgccatactggccaggctcgtctcgaactcttggcctcagcaagtcatctgcccaactcggcatcccagagtgctgggattaccggcatgagccacccccagtgttttctattgtgcttctccaaggtgtctcagccgcagatgtgacagacaaggtctgggtccccactatgtgggcagactcaatcttgagtaatttaagggaaatctaagaaaagccagatgaggccaagtatggtggctcacgcctgtaatcccagcactttgggatgccaaggcaagcggatcacctgaggtcaggagttcgagaccagtctgaccaacatgatgaaaccccgtctctactaaaaataaaaaactttgccaggcgtggtggcgggcgcctgtaatcccagctactcgggaggctgaggctagagaatcgcatgaacccgggaggcagaggttgcggtgagctgagatgatgccacttcccacgtgaggatggggtagttaagttgcacgacactgccttctgcacaatggggatgatatgagaaatgatgagaggatcctgggcagaggttgaggcaggagagcagggcaagaaacactatctggactgaataaacttatttaaaaatgagtttataatttgtggataaattcatcttaaaaaatccattacataagcctagaaagaagcgtacaatatcgcaagtcaggccaggtgtggtggatcatgcctgtaatcccagcactttgggaggccaaggcaggcagatcatttgaagccaggagtttaagaccagcctggccaacatggtgaaaccctgtctttactaaaaatacaaaaattagccgggtgtggtggtgcatgcctgtaatcccacctactcaggaggctgaggcacgagaatcgcttgaactcaggaggcagaggttgcagtgggcagagatctcgccactgcactccagcctggatgacacagtgaaattctgtccactcccaccctcccgtcccacccaaaaaaaaaatcaaaaggtgcattgagcaacagaatttccttttgttttatgaaattaccaaggacacctgtctgcagccttcttcggcatgtcttgtgctcatttccttgttaggggagtgtggcccagccaaagtggcctttgcagggattggggagggagttgtgggatcagagcttgtaatgaagaccttcctttatccagagttatgtttaccgaggacctgaagctgcctgcaagcttcgatgcacgggaacaatggccacagtgtcccaccatcaaagagatcagagaccagggctcctgtggctcctgctgggtaaggccctgctggctggcggggaagcgctggagagaaagtgggagcaacactggagagtcttgggggattcggggtggggacaactctgacaaggcaagttatagaaactttctgagtcccagtttccatcagtacaaaaatcacaatccctctggccatgaatgatggcgaggattaggtggagtggcgggcagagcatccagcagattgcaagtccacgtgtacaggtggcgaagcagctccctttccctgacatgctggcccgtccgcaaataccaggagctctcactgctactctgcttcaagaaagcatccctttagtgtcagtgagctgtcttaattttgtcatttaattgtggtaaaatacacgtaacagaaatgtaataatcttagcaatcttcttttgttttctttttctttttttttttttttttttttggagatggagtcttgctctgtcacccaggctggagtgcagtggtgggatattggctcactgcaacctctgcctcctgggttcaagcaattctcctgcctcagtctccccagtagctaagactacaggcgtgtgccaccacgcccagctaatttttgtatttttagtagagatggggttttgccatgttggacagcctggtctcaaacgcctcacctgttgatctgccttcctcggcctcgcaaaatgctgggattacaggcgtgagccaccgtgcccagcaactattttcaagtgtacagttctgtagcattaagtacattcacagtgttgctcagccatcaccaccatctgtcccccgaactctttttcagctcgcaagacagaaactctgtccccattaacaccaatattgtagcccctggtaagccccactctactttctgtctctatgaatttgactcctagggacctcatacaagtggatcacaacagtatttattttctgggtgagctgtgttttttgttaagaaaaaaacacagccaggtacggtagctcacgcctgtaatctcaacactttgggaggctgaggcaggcggatcacctgaggtcaggagtttgagaccaacctggccaacatggtgaaaccctgtctctactaaaaagacaaaacttagctgggcctggtggcaggcacctataatcccagctactatagaggctgaggcaggagaattgcttgaacccaggaggcgcaggttgcagtgagctgagattgcgccactgcattccagcctgggcaacaaaagtgaaactccgcctccaggaaaaaaaaaaaaaaaaaccacacacacacatacaaactaatactacacattttgcagatttcagaaatgaaccgagttcccaggcagaggttcacggtggtgcttctcttgctttaaaagctgagttgggcagatgttgaggcaggagagtggggcaagtggctcatgacgcctctaatcccagcactttgggaggccgaggtgggcaaatcacttgaacccgggagttcaagaccagtctggccaacatagcaagaccccatttctaccaaagaaaataaaagctgagtttgagccccaggagcgtcccctggtgttgagagatcagttgcctacaaggtctgaggtgcccctgtggccctttgaggggactgctgcagagggcccagcccggacatggcagcctcacccggtggggctcgttcctgcaggccttcggggctgtggaagccatctctgaccggatctgcatccacaccaatgcgcacgtcagcgtggaggtgtcggcggaggacctgctcacctgctgtggcagcatgtgtggggacgggtgagtcaggctgtgcttccacagcgggtttagtgctgagagaccctgggccccagcttctcagtggaggggactttgaggacttcctgggactgctgcgagtcagaagtgtttcggggagactccgagagtctggcaggcagggcctggcaaggctgctgcttcctgggaggtgcctgaaccaaggctggcccggcagagctgtctgaggggtggcatcccagcaaaacagtcagtttcagaaaatgtggtggaatgtctggcccctggtctggtttgtgtcatcgcatgttcctttttcctgcttggggaaccagtttggggcgtttccttatgtgtagttagcggggatggctccaccttaacaacaaggtggtggcacagaactttctgctccagctgcctgcagcctcgccttggttccgcagtagcggtgttcactggcggctgcagatccgaaatgcctgagggcttaaaaaaatgcatgggcttctcccctaactagttaaatgggaatcactggcgattctcatttcagagaactggtggtgtttttaagtaccttagggaagtttagcgtctgctcagttgagaatcagtgttctacccggaagggcactcgtagcctggtctggtatggacatgaacaggagagcctcctgtcttctcccggatctttgtgggtaggggtggggctggcggttattccctgcaagctgtgcttatctagggagcgtcccttggagggtttggggtctgggaggtctgctcgcaccacttgctgcagctgggggtgggtccacgagtggcctcgggcacttgggtagcacacagtggtctggagagctggtggtgcttctctcagaggttttcattagaggctgtcttttcagctgtaatggtggctatcctgctgaagcttggaacttctggacaagaaaaggcctggtttctggtggcctctatgaatcccatgtaggtaagtgtgtccccttggccactttctggccagatggattgtttgagcaattaaccatcatggctttatttgcctttataaactgggggttgagacagaggggctgctgagaggtgctagccaggtgtacaggcctctggcaggacctgcctggcgtccatgctgcaggcacgaggcttgccttgccccaggtctgcctcgcccagctggggcttctccgtgggggctgtaggttgactccgctttctcccgggtcccatcagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggtaaggggcctggggcctggccacggcgcacgtggaggctggggagctgctgcatccctcctcacgctgcagcgaagaggtcagggctgaggagccttggggtcccggaactctaggatagaggagggggagtgatgccctcttgccaggagaagcagcacactctccactttctgcctgttccaccctgaactcagcctcagcccttccaaactggaagggaccaaagccctccttttacaagggagtggcgtgtcctggagtcttgaggtatcctggcctcttccggggcctcgtgctcattgctcccttctcccatttctgagcttccagccccagccctgtccttagttcttcaggggagccttccttgagctcccctggcagggcaagtccccttagatgcagtcttcccctggaggccaccagaaatcagtgactggctgaccgtggcgtgccacgaggcacggtcactgccctccccaaccccgagctcggttcattttccaggatacaattcctacagcgtctccaatagcgagaaggacatcatggccgagatctacaaaaacggccccgtggagggagctttctctgtgtattcggacttcctgctctacaagtcaggtgcgtgctgatggctgatggcaatagagggtgggggtcgggaggggagcctgggtgccaggatggttcatgttgaccaatagggctggattgggcaggcaggggaggggctggggaagagggctgtgtggggccttccatataggctcactcctctgtggaccagcctggcacctgactgtctttgtccaggtgttgtgccaacacacagaattccagaggcctctcccagagcctctgggctagttccttcccatccattggagtccagctcatacatgttctctgtgggaacgcccccctccctggtggctggccacgcctgccctcgccttcctggctttgcattgctttaccagcatgtttctgttataatggcaggccgttcgtgtttgcactggctgacacattttcttcatctttctctttgcaaaggcctagatcgtgcctcacaccagtggatgaacacacagggaggaccttgccctgggtagtgccatagggactccaaccaaggaatctggacagtccccatccccaagtcctgtcttagaaatcccttgctccagatgaacagtctttgctgactgcatctatcccattaatattttgctagattggaaacttgtaaaacaacagtttgacaaaggaagatgattctggcaagaaaaagtttctgtgaagatggcacttcttagcatagtcctcgcccttattattaaaagatgcatttccactttgacagtgatttccccacccgagagcctggttgggcagccctgagccccttagccagtatctttcccatcagctagcattagctgccaccagtcctcccttctcctccctcacctcttcagggtgtacctggagcagctattaaaactctttaagccgtgtaacgcttttgacaaacccttacttacatggaatcccagtataaagaacagatgaatcagtcatctagcattaaatgttttatcaattagaatgtattagaaattctatttttaaagccaacaagcacattttgtaggaatctatttcaatatttactcaacaactttgagtgtgttgggccttcaaaaatatatttaattccccagtattgtgggaccccccctggagcctcctggtggagcagcaggttccctctggaagctgtttctccttcccggagcatgaccagctgagtgtggggggtgctgtggggcgtgggacagtggcccggtctcggtctcagccagttcttcccttttcaggagtgtaccaacacgtcaccggagagatgatgggtggccatgccatccgcatcctgggctggggagtggagaatggcacaccctactggctggttgccaactcctggaacactgactggggtgacaatggtgagtggctgcccccttcctgccaagaacagtgaattgtgagccacaccccgtggccatctcggctttctctgttctacccaccgcacagccttaaaccctggacctacggccaggctgtcagctcctcctaagtgccaggcagtcaggagttcccttttgctgtgagggcagactctgagcagcttcagagccaacgcctgcaacagttcccacagcatcgcgccagatcctgtgatgggaagggtgaccgggcagggggcttgcccgtggaggtgtgccccacggctccagaagccttgtggtgttgaggactgtgctagtgggcccacagcaggagtggccagggatgagtgacttaaggtcttttaaggatgagtctgactatattggttgacccttgtcacactttaaaagcaccttactttttattcccaggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaactgagttgattcattccatgcgcactgtctccctcacctccatcgtatacgcacctgcagctccttgcctgcttctagcatggagccagcggggatgtgctggtgagtgacaaggaattgtggggcatgtcgacatcagcttaaggctttgttagaaacacctgccttgcagtgtttgtgactgggaaagagctcagtgttttaata

SEQ ID NO: 12014 - DNA, 39433 bp, Human
ataaccgaaacttagaaacaactcaaatgtccattcacagatgaataaaattactttacaaagtagtttattcataaaatagaacagtacttagtaataaaaggagggtcaagggagatatgaactgcaaaggagatagtgaaaagttaaggtgatgatggtaaggttctatacaaagtattagttttacaagtatatacatctgtcataactcattgaatgtattcaggttatggtatattgatttaaataagaaaagacaagacatgggaaatgttagtgctgcgtatgagatctgtctccagcaacatgggcatcatgacaaaagtagaggttgtaaagatagagacagccaggagtcaacagctgtgaagggacatatccagtgggctgtataagtcgtgatacatggcatctgtgttaaattttcctattccatgttatggtctccctaatacctaaatccaaatagtatctgtgctctgtggattgaagagaagggtgagtgtaaagcgtgggacagccctaagaaattcatcctttggtgttgactcattattacagaaagaccaaaaaagatttatgaagaagttcagggtgtgaggtgcaagcaacatgaagtaattcttgaaattccatctcatgtggttttttataaacacataggaaattccccaaaaatttcaccatcatgcaggatgaggtactcaatttatgtttcttgtgtgttgaaggaaaaggcaactcaaaatggtggggaaactgaagcacatctagttacctattgcatctcattctgaattatttttgagaaacattgggaagttagaaacaactgatttgattttttccaccttcttaataagaaactaaacacaaaccagttctagttataagatgacagtagatgttttaggggaaaaaatctaccccctggcgatttaatacaataaaagttaatttcttgctcataaagagtccaatgtgaatattcattgatatgcaacttgcttttctgtggtgatgctggggtccagactccctctgtcttgtggctccaccttccctgagatgcttggcatcctggcattcagctggcaaatggcagatgggagtgtgaaaaatgaaatcccatctcacatacaccttcatctagaaatgccagccatcacttccactcacattacattagtgagtattaatcatggcacctccttttgtgatagtcagggatagaaagtgaaatccctgatgaggagctgctctccagagaaaatatttggtgggttctttaccagaagctgcatgttttcagcaacagaatgaactacattattgataaatgtcctgccagactccaggaagaattcccataaccaaactcaggtatgaaaaagaattggagaagccataaaataattttcataaaatgggggagtcatgggatagaattaaagagccttccatgcatacttcccactgtattatcttactgctcaaatactgatcctttgctggccaaaatgaggagatcaaaaacactgtttatctaaagttaatttctagggtaacaaaatattttaaaatccctaaactgtgcctccattaaactatttttggcactagttttgggatcagaacttcaagaagttcatgtaaaattgcatagaagacagtatttcatgtttaacaatgtgaagttggaaatagagaggcaattcattttaagaatatcttacataggcttttgttttcatgtttcctgaaagcaccacagataggctcttgaatctctaagttatttgttaaatttcactctttactgtgtctggcaagataagatgaccaggtaatggaattagaaacttccttttagctcagcagattcacattcaaaaaagcccttgtaaaaatacaaaatgttgctcaccacttaattttccaacttaatatctaaaaggattattctttaaaagctggaagaaaggaaaggatgtcaagtagaacctgaaacttttgtttatgggcaaaataccagactggatagaaatcactaaaggatgagaaaacattttcaaaatagttacaatctgatgaaaagattatgtaacataaagagaaacactgaaggagtggaaagaaagacctcttttgaaaatcattttttaggaaacaaatgttgacagctctatcttctattctaagttaatgctgaataaattgtatatatgaaataagagatattgagatagaaaaaatagaaaactggatggtaggcagagtttaaataaatgaaatatgatatgagaataaaaaaatgtatagcttcagaaacagtacagaggtgaataaacactacagtaattcaaatgggcaacatttctgatattggttatctactaggaggccaaagaaaagacacaaaaatgaaagaatctaatatgatgaaaagtaaatgtgaaaagagaagtctaccttatggataattggtgatctttaaaaagaaactaatctaaatagtgcagaaagagtatcaaaggcaaagcagggggaaaaaaaccattttctgtgttgaaagtttaaattttcaggctaaaagtgggccaatgaagcattaaaaacataataaaacctgatagagtatttgaatttcaaaaatgaacataaatatcaatttaaaaagtcacacaaatataaatggggataaacatgaatgaaacatactctgtacaaataaaaaacaaaacaatgatagttacttcagactccacagcactaaacctcagaagaaaacgaagcaatattgtcagaattttaacagaaaaaattttaactctgcctatgtgcttctttatgttactttcttgggacttggatcatagtaggcagtgaataaacatttgttgaatgaatgaaaaaaaggaataataaaaatgtgagtggagcacatcttttcaaatcaccaggaaacagtttagtgtactgattgtggacaccctgaatgttaaacaagaggaatagttttttctcgtcaatttttaagtactagtagtatacctggattccaaatgtgtttgctgctaactggtattagtatgcttagcctttttcttccacgagaacatattatttttatggcttcagggttgtaataatgaacaggttcttacttacctatataatatagcagcatttattcattcattgaaaatctaggaaaaatttttgataatccattgacaagtactatcagtgtgccatacaaaacttgtcctcaatattgttttttgataatctctcctgctaccacccaattcaacaccgcaatcgctcccctgggctgggaaatattcaaagggatttttctgcttccattctactctctttctctctctctacccaattgcgtcactcagcagtctcagttcctttataaaacctagattgaatcatattactccatgattaaaccattcaagaacttcccattatatttggacaacaacacaaacaatgagcctgtacaggattacttctttgcccaactctccgcacttaactcttaccactgacatgacaacccttacctacttcaggatatttatattagctcttctctctgcctgagatacttccagatctgtggtcacttgtcacttcccttactaccatttatactaatataaaacaacatatactctcatcactttcaatcttttatcctattgatttttcataacactcgttatttttaagaaattatattgtttacttttttattacctttcttctcccaagtacataagctccttaaaagcagagacccttcctttctagttgtgttcccagaacacaggatgatcccagacacacagttgggcattctgtattgactgaatgagctaactcaataaatgagtggttaaacaaaggagactatttgattagtctttcactttcaaaacaattattcaaaaggtatggaactattattcaaaactatacttttattttatgtttgcttttatttacttccttttccttaatttggagtgatggtggcggagggcaggggaggtcgaattaaagggatgttttgctacttgagttctgccagagtgcctcagaaacctgaaggagtaacttggatactagagggcagtggggaaagctcaaggagacacagcactaccacatttaatatagtcatcatgacttcttgttaatatccacagatatctgcactataaagcaggtgtgctactagcaattttgataatgaaaactgactctttcaataagattacttccattttgctatgagcgtccaaagagtggttccaggaaagagaaagaaaaagacagggtatgaggaggtagaaggaaggaaaggtagtgaaggaaggctaggaaggaagaaagaaagggaggaaggaaagaagaaaaaagaaggaaggaaggaaggaaggaacgaagggagggaaggaaagaaggaaggaaggaaaaaggaaggaaggcaggcaggcaggaaggaaggaaggaaaaaaagaaagagaaagaaagggaagagaaagaaagaaaaaagagaaagaaagagaaagaaaagaaagaagaaagagaaagaaagaagaaagaaaaaagaaagaaaggaaggaaggaaaaaagaaaaggaaaagaaaagaagaaaagaaagaaaagaaaattaaaaaaagaaaataaaagaagagtgatctatttcaacagctggaccaaattagaaaaccaaatgaaattctctggtttggttctggacccaaaaaactacagttgtggtagaacaccacattgttttcagctagcaaaatgaaggagagtcaactccacagttactgggttgtgtgtcttggtgagctaggcagagcccttaggaaatggtccttaggaactatgaagtgtcattactggtgaaatggaaatttagagttaatgaagtttaaaaacagtcacctcaaagatttctttttgcaaactgggccatgtcttgtttgaggtttgcttatgtttacactaggtataatgtctgaaaagtcttctttggtcattggactgtgtgtttcttttaaaatagtgttgttgtttttaagtgaggtaatgatttccaagtaatcagattatgttctttaaaataagtataggtatatggatgaggagagaggtacttgacaaaatagatcatatttatcatactatataaaaatgtagtggcattcatagaatatataattttattcataatttttcttttctcaaatcagaaagtacaatttcatctaagaaaattaccataactaccagtgtaaaaattaaatgaaaagttctcaaggtttcatcaaaaatgcccaaataaatttaacaggtaaatattttacattatttttgtttggagtaagaatacattaataagatgagagaattaaatcataattttaaaaaagggcacataaaataacaaatcccatatctgcatcaggaattatttattgatagagttgtccaaaattataatactaaataaaagctaaaggaaattattagctcaaggagataattcaatgatttaattaaaatgtattttgcttcattgtttggtgtgtattgcaatccaagtgtacattgttatatcactgcagatagaaattatgaacttttgtattacatgtttgctgatttatattccctgaatagtattgtttccactttattatattataccatgtaattttaataatatatattttattgcttgaattaactatatagtcacttatctgtgttattcatcctctattttagaatttcttttgtttcttttattatatagtgttgaaacatatattgtcctggttttaaatcacttaatattttatttatatagtgggattgctggatcaaagcatataaacattttgttacacacggctaattaaaaatatttcttaaattagcattataataaaataaagtacacttatttgatcttgttatttttataggttcaaaatgatacctcattttaatggcattttatatgcttgctattatttttgtggttattttttacataattacacttcattaactttctaaaaatgttaaagattgtaaagataaaagaggttacatgaccgcccagaaaaagaaagaaaaagtaccaagctagtgaaagaaccaatactactgcttgccctcaagtcctatattcttatcatttatatgcaactttagtgttcataatacatgttaaattggcaaagacaggctgttaaatctgtgggatccagaacatgaatatttttgaaacaaaaattagttgagaaagaggagttttaagagactactgtgatataaaagaatcaaactcaaatgcttgcatgatatggcttggaaaatgtggggaaattctggtgtctcccaacttcttcaaagacattgtttcatctctgcactcccccattttggtgtaattcttacagaatattcaagaggcacttaatagaattcagaatcctttggtgtgtataaaagtatgaacaatgactagattaaaccaggatcttcatttgtggattgactcatttaacaaatatttgaattcctaccctgtgcagaatgttgtgttagatactaaaagtaccatagtgacaacaccataaataacaggcatgggcccattctaatgagggatacatgcacacacatacatatacgtaagaaaagtaatcagaaaagtaaataaaaggtaaatcgtgataggggctatgacagaaacaaaagagtaactgaaactggtaggcagcatactgagtgcaaagtccaagggcttatgtgaactatgtatgggggaagagtctgagttgagtttggggcggggcagggtggggtggaaaaggctggtggaagaaccaccactcaagggcaaagggaaaacatgagagaaaatattatctatttcaaggctggtagaactgaaaagtcacagaatcttggaggctaaactcctgtgcctgaggcctgactttcctcatctttaatatagactaattgtatttctctgggttttaataaggatcaagtaaaaacaatatgcatgcaagaatgtcctatgtcatgaatcacttggcactttagagtcacagtctataaaagaaaagtaatatcgtggacatctttcgccacctcattcagaaagacttttgatttggtgggagagggagacattggaattttattcatgtttgaaactcatctctttcccagtgttatttttttcctttctacactttaaaatattctttaaaataaagtaatatttggaattgagaaagggagggatgggattcaagttaagccacatattaactatatttaagaatacatattttacttcctttttaaactttttctaataaacgttcaaaatatatactctaaccatatagtttaggccacagtggatgtcagaaacaattatatataaaggattataaagtatgaggtagtgaatctaaaaatcatgagacaccccctgcttttgtactttcttgttctgttcagtccttgtttgtgtggagagcatatgtactgaacacatatatattcatagaacaatggcaggtgccacaagtgatcacaggaatgatgaagggaaataggattgacaagaaggcagagaaaggagggagataagataaatatgaatcctaatattgttcttgaccaaagtgatattagaaatttgggaaagtgttttcaatggttgtggtccatgatccagcacaattgcagtgtgtttttctactcaggtacttgtctttttcctttttccaaagtgccaaaataagattataatttattttgagattccactctgagtcatgatcacagaaccaaatccagacttgccagcactcacaccctccctcttctgtttgcccagtctagtgtgcagcgtcacttttgggaaaaacaatccacatacccacaagcaaaattcccagtgtattttttaggttaatccaaagtctattcccagaaaggatgttaaccagacccagaataagttcactataattttatttcccctggcttccaaaagaatactaaattaacaatatggagatgtaacagctgaattactttattaaaggtcacatctgaactcaccttcccaactggatatgaaaaacataaaaacagaaagtcgaattctctaatgttagagtatatgttaggagatcccatgcagtgtggttataatttattttttaagttatcaaacatattagaagtcatagatctaaataacagagtttcttctaatcaaatgtttttacagattttatttaagtgaacttgtaatttcacaaaatgttttggaaaccgtcctaagtagagtcatggcttctcaaaggtggccacattttaattttcagaacttgtgaatattttacattatatggcaataagggatttaggtagctgaaaaaattaagggttctattcatctgaccttaagataaggagattgtcctggatcatctgagtggacctaatgtaatcagagcagcttcgaacatagaagaaggagacagaagaggcaatgtcagagtgatatgatgcaaggaagactcaagtggccactgctgtctctgaatatggtgagtttaggagccaaggtattggtggcttttagaatctggaaaaggcaacaaaatggattctctcttagctactccagaagtaatgcagtcctgctgacactttgattttaacccagtgaaacttattttgggcttctgaactacagaattataagataataaatttgtgttgttttaagccactacatttttggtaatttattgtaggagcaatataaactaacacaggaactcacctgggtccgtcgtctcctgccctcactaagctccctgcactctgtccttggttctgttactgcagagtcaaccaccaaagcagggtgtcttagtccgtttttacactgctatgaagaactgcccaagattgggtaatttataaaggaaagaggtttaattgcctcatggttcagcatggctggggagacctcaggcaacttacaatcatggcagaaggtgaaggggaagtaaggtaccttcttcacaagacagcaggaaggagaactgctgagcaaacggggaagaatcccttataaaaccatcagattgcatgagaactcactgactgtgatgaggacagcaaggggaaaaccgcccccatgatccaagtacctctacctggtctctcccttgacacatagggatcatggaaattataactcaaaatgatttgggtggggacacaaaaccatcacaggggtcagatgagagtcagagcaccacattgatgggttcatgattgatgtaaaagatgagggtgcaagctcatgagctacaatctgcagatgcagaagtcaatcagtaatgacacaagaggaacaaaagaactatcacacagttccctgtagccacttcttatcctagccctctatcaccaggaggataagctaaactttcccactcacagattacatctcatagatcatggtgcgattgttaaaatccaaaagattaaagtgactttttaaattaaaaggactacttaaatagaaatcaacaaaataccaattataaaaattcaaaatgccaatttcctaccatccaggtttgaaagaagagagaacaaataaaacatgaaaaataaatatgctaattttctttgtaggcctgaatatagtttactaattttcaaccaacatataatgaataattattgggttgatgcaaaagtaattgtggtttttgtcattgaaacgacaaaaaaacctccattgaaatgacaaaaaatgcaattacttttgcaccaacccaatactctgtgggtagctagctttcagtcttttctgaggccatgtctgaacaacagaaatattgttgaagaccctgaatcttttgacatcttcttttcttacatttttattatatgtggacagaacaggtaagcaagagtcagcccccaatgaattcatctctccatcccctgtgagaattttctgtttaactctgaatttcatccattgtagtcatacattttgtttttatttcaaagaaaacaataataaggcaaagacactgtctccaaaagacaactgaaaatgcacagaggttagaggggggctcttcaattggtgtagaaaaccataagaaatcagggatgtggaatctgagaccctcaagagaagattgtttcaatagtgcgaagaaggaagttctttgttacttattggcattaggccttcaaatttggggtaacagaatcttctactacacagaaagatagaaatagaaggatgaagataacttacttacactacttgattattctagcctctttgaatgcttgtcaaaaatgtagattccttggtcatgcgtatgtaatcatgatctccaaggaaaatctcctaggtatctatattttttagagttatttggatgattttgatcaacaaccaactttggaaatcattgacctatttcaaaacctgaattatggccaactctaactagagaaaccaaaaagtatagctttaaagaaacggaaatatttcaaccaactaattgctatcaaaattagtaagtatcgtgtatcacccatttttgttcttgcaaattttggaaggacttttattgacatcaaggtaattccctttttgtggaaaagaagaaattcagcctgggttggaatataataggtttgggtgagtatccaaaaatgtttattctgcagaagagaagcttagaagcatactagagttttcaatattgaaataattatcatgaaaatttctttgtggcttatgaataagtcaactacaacttgctttttaaaaccccagagctattttctgaaattcccttctgaagcttgggagaaaccatataaccctggaaaatgtgtatcatttaaaagtttattaactacttaatcctaaagttcacctatttccttgcaaatataaccaaggaaggatatttggaatgacaggtacatattaaatttcagaatcaaaactttcaacactaaaatgaggagtacttacaccattttctgttagaggtctatttgtttttagtggaatctattttctaatgagtcaacattatgtcactttcaaaacatgccacaggacgttggtactaaaaaacacacagtaggattatttaagtctttaaaaccatatttttatgaggatatgcctattggactcttaggaaagtattcatttgttaataggttaagttaaaaatatttttaatcgcctgagcgccgtggctcacgcctgtaatcccagcactttgggagcccaagatgagtggatcgtttgaggtcaggaattagagaccagcctgaccaacatagtgaaactctatctcttctaaaaatataaaaaattatctgggcgtggtggtgggtgcctgtaatcccaactactcgggaggctgaggcaggagaatcgcttgaaacctgggaggcagaggttatggtgagccgagatcgcgccactgcactccagcccaggcaacaagagcaaaactccgcctcaaaaaaaaaaacaaaaaaaaaaaatttttttttaatcttacatgttacttacacagttaaacctttgatgaatttagctccttgaaaaatggtgtgttctgagccattataaagttaattcaaagaaaaaggaatttacttctttgaatgccactgcagaccttattcatgaattctgtcacagagaatgacccatttacttgggcctttaaaactctccctctgcctggaattgtttggactttttcccctggctaacatcagctcattctttactctaaattttcatcttggtcttcacctcctttttagaaaccttctccaataacacggggttgtgcctaaggctgctgctctaagatctccacgtattttattcactttccttgtgttaggcctttcttgtgttgctataaagaaaaaattgagaatgggtaattcataaataaaagaggtttaattggttcatggttctgtaggtcatacaggaatcatggtgctggcattggttccatttctgggaaggcctcagggagcttttacttacggtggaaggcgaagggggaacagcagttcacatggccagagtagcagccagagagcaagtggtggggaggtgccacacattttgcaaacaactagatctcctgagaattcactcactgtctccaggacagcaccaagacgagggttcctccctcatgacccaaacacctcccaccagaccccacctttaattctggggattacaattcaatatgagattttgagaagacatccaaactgcattacttcatgttatcataactgtatgtttatttgcatcttttccaactagagtttgtgcttcttgaggtcaggggttgttttctagtgtacctaagtcttcatggatattcatgtatgaactgatgaataaatgcttgtttttttcaaggagcaaatcaaaaattctaagctgttctacactgattttataggtttgtattgattttaattcgagttgtgccattacttatttactaattcagtgcataggatctttaacattcttaattaggctcttagtgggaaagaaagagagatcatcttatagctactttaaaaaggttttgataatttttctgatgtcgcctttactttctggatctcatatcttcaccaaatagctgattttggaataaaataataaatagaaaaattggttctaatgaactgattaatagaggaaaataaaatatgtattgaaaacagtaaaaattttaccataaaaaattatacatgtcaaaagacactaactttaaaatagtacaaaaaagtaagggaaatcctgaataacagaaaagaaagtcaaatttatttaatgaaaaaacagatttaataaaaattaccaaatacacaccaaaaaacacagtagtactatgtattgactcacaaaacggaaaagcagtggtccgtgactactcaagatggcttgccaattaaaggaaaaaaaaaaacaaacatacacatgtgaacacacacacacacacacacacacacgcaaacacacatgccaaaacaaaaaagccaatatgttttaaaagtacaatcaatcaacaggcccctgtgtgtgatgttcccctccctgaatccatgtgtcagaggttgaggggcgaggggagggagaacattaggacaaatacctaatgcatgtggggcttaaaacctagatgatgggttgataggttaggtgcagcaaaccaccatggcacatgtatatctgtgtaacagatccgcacattctgcatatttatcccagaacttaaagtaaaattaaaaaaaaaaacaatcaatctacagcaaatacaaaactcagaaggacatacacaaagacagagaacttataaggggatatttttgtttttatcttgttcactgtgttggggcttagaaaacaatatcccaaaatatgatgtcttgacatgctgaactaaataacagcctcaaggtctctctgacctctcccccacaagcacagggagggactctctggaatttccttatctgactaaggaaccacctttcaaaaataaatgttaatatgttaagacacttgccacccctggaaatctcaccaaataactaggaaagattaaccaccaaggaagagaaaaaactaaaatcaggggtcaccaggcccagactgactttatctgttcttcagagggcattactgaaagattacctgggagactatccacatactacgacaaccttggttcacagtgcagttatgctcctgatcttcctgtaacttgtcagccccattaagtttcttaagagattcatttccaagaaaatgtctgcctactgggtccattaattctccctaaaaataattcagtacttctcaaaattgccacatttctctcatctctcctttacttatgaagaggggtatataagcaactggacctcattgggttattgggtaatcactttcctgtgattttgctctatgcacattaacaagtttgtacatctttctctcctattaatctgcctattgttaattcacttccagcaaacttcagagggtggagtagaagctttgcctattttttcctacacttgattacattgcaattgcgtattctaaattctatgtatctttaatgtcacgtctctagtccattatcttcatttcttgcctggactaatactgttgtgtcccattttgacttcctgcttcctcttgtgactctactgcttataatcaccagcatcctaaaacacttaaaaatccaaaatccatagctatagtatgccctgaatgacttccatgaacccattatcattacatgtctaataacaattttcatgccgttcaaccaccaagcttttaccatctggcccccattcaaaatcctgaaacctctacattgaacatcttttcttctactttctcacctttccctatccagtttaaatattggtttatcctagcgggaggccttctctgctttctcaaccttttattctccctcactgcctgctcattactttatttataacatttatgataagttgttatttttatttggttttataactttttaagtgtaaatattagtatatcaagcataatatttataattattataaatatttatcaacaatttattaataatatttatgaatattagtatgttattaaatgtaatttatgtaaacataatttgtatgtttcagcttacataaaataaatcactatatgcttacaatgctttaagtgcttaatgtatcaactcacttaatactcaacacccacatgataaaggtaattaattctattttatgaaagtggaaaatgaggtttaaagagtttatgtacgtggacagtgatagctgcagagcagacaaggaaaggcacagaagcaaagattctgatctcggggaatttgttgctcctatacaatgcaacaccgtccttgttattctctttcatacatgctgaaaatgatggatttctataacagaaataataactaacatttattgaatgcttaccttatgcaaaggattattcaaggatttcacatccagtaactcatttaaactcacaaagaaagctttatgaggtaggaacatgaccattcttgtttcagtgataaacaaactaaggctaagtggattgcctaagatcacacagtacatatgttgtaaagaagtcaactgctagaatgtattcactaattacatatacacttgctgattactagcggacagaagaaggcagaatgatgtcatcacttttctatttgtagttggtatagtacaatttgtatgtactttttattttcatatttgaaatagtatattacacatcttcctatttaatttgaattaaatcccaggctatgtgtaattattatgtatatgatactcaaaacatatcacaccttaacatctggcagacatgcttcacatacggtggtgtttatctgctatgagagcttcaaagcacacgtcagagaaacacctgggtttgaagtctgaaagaagactgtaactgttacgggcatatttcttgtgctttacttgcttttatgtgaaataaagagaagtttaattttttcttgcttatcctgtacaacaaaattgaaacctttatcagcatcagccatcataggactatatcttccaggtttggctggctcattgattaaaataaaataatctgaacctgaagaaaagattaaaaatatatcattttaaattatttaacacttaaagtgggatccatattccattatgattctggcatagtatggagttttcaaaagttaattaatttattattcaggtgcaattaaaagctagatgttcacaaacacacagatgaatgcaaagacaatctacccttggatgtcaaaacacaatataataaagttgtcgacttctttaagataacctataaaatcagtgtgactgcattcaaatacgattatattgtttttgctataacaaaatttatatggaaattcatctaaaaatatagacaaatgaagaatcacaagcaatattctggaaaaatattctagaatattttccttcaacaaatatgtgtggagagccttccttgtgtcaagcctaagggacagatcaagtacttattttcatggaagtgacatactacaagggtcaaagttaaaaaataaatgattaataaatatactaaatattaatataatttccaagagtgacaaatgataagaaattataatatattaaaatggtagagaataactgaagcaggctctaagactacttcagattttgtggttcaaaagcctgtctgaggatgcagagacctaagtgagaagcagtcaatgataaaacagtccagggcaacagctcgctaagtgtgtatcatgaaccttgggatcctttcgggaagtccaaaatgaaaaaaatatttttctgataatattaagatgttatttgtacttttcactttaattatctcagaagtgaacaatggggttttccaaaaaccatgtgacatgtgatgatgtttttgttctgatggctgtagaataattgcttatgtatttttattttttctagaattttctgtagtcatgattttggaatataaatgtgcttttcgtggttaactcagcttgttctcagtaacactatgtattcctatttatctttgtttatctctgctattatttgtgcaatatctagttattgtccaataaatcattcttttgtaatctttgcaggcttgttttgtaatactatttttatttgttcaaagtttgttaactctttaaattttatttaacatatttttattttgaatttaatgttatattcaatgataaaaaattataatatgttcttcttatatttaaaaaatgaggccaggaacagtggctcatgcctgtaatcccagcactttgggaagctgaggcaggcggatcacctgaggtcaggagttcgagaccagcctggccaacatggcgatacccggtctctactaaaaatacaaaaattagtcaggcatgatagcaggcatctgtagtcccagctactagggaggctaaggagaattgcttgaaccctggaggctgaggttgcagtgagcagagattgcatcactgcactccagcccggacgacagaacaagactccgtctcaaaaaaacaaaacaaaacaaaaaaccacattatcttccaaaagggagatagaagactttttttcttaacccgtagctacactgcacaaaattcatatatgaaggagttctctgaattatgggaaagagcacccttctccaaagaaagtaagcgaaaattaaaataggcaacagaaatataatgaaaaccaataaataatgttaataaatattattaataaataatgaaataatatttacatttcaattgtatatattaataatttgatttattttgtcttatacaacaaaacattttaaatatttttatggtaacaactgaattctagcaacattttgagaccaatcattcagattttacagaaaaatgagctaaatagttaattgtagatgtaatggactctaaaagccaaaaattatttgttatagctttcaaactggaaattgcaaagccactgaccattttactagataaagcaaattgcatggtctgagaaatacgcacaaacgctgaagactacaaaacccttgctgaatgtctgctggacaaaaagtcagcaaaataaattacagcgagctactttccaatgatacagtaattaatcaaaataaagatttactcaagacatgaagattgaattaatactatatctgtggattgtacttttgccttacaaatggacaaatctacagctgactctggttgaactagccactttttttctggaacccgtttttaattaaaagtgtggtttgtcagattagagtatttggtaaatacactctcaaaaaataaagtctatttttcgtttcaagaaaaacaactgagagtagttggcaaaatttaaactttcgagcaaaaattagaatttggaaatagtagaaaaccttcgttgatgtaattttaaataccacattgcaactagcctttgagaaactaccacttgatgagttctgattgttcttcaaaaagaagagtagttgaaaaaaataaaaatactattccaaaacaagactacaaagattacaaaatagtggtttattggacaataactagattgcagaaataaaagcagacataaacaaagataaataggaatacagtagtgttaccgagaacaaactgggtcattgaaaacacatttgtatttgaaaatcatgactatggaaaattctggaaaaagtcagaacacacaagcagatcttctactagccatcagaacaatgtcattgtcagatgtcctgtggcttctggtaaaattcaatgcttacttctgagataattaaattgagttgaaattgagttggaatttaaatggaataaaattgagttgaaattacctaaaaaggctactaataatgcttgttttctcaattaaatatttatgtagggtgagtttttcattatatgcatcaatcaaagcaacatatcttaacagattgaacaagggaacagacataaaaatccagctaacttcagacacattaaataggtgtgcaaatatataaggcaataccatttttctcattgtttttttctggaacatgttaatattttcacaaaaatggtatttatattaacatggcatggacttgttatttttatcataatgaattacttaaatgctttaaaatatttctcagttttaattttgaatgtgatacacactggtagatggactccacatacgtctttggggtcctcaaaacgtcaacaaattttaagtacatagagtcctgtaggcaaaatgtttgagaaacgctagtctgtgggaacagcacttcagtcaaagagaacagctggtaaaggacctgaagtaggaacagacttctcatatatcaggtcctgggtaaaggtcaaaatggctagaatgtaaggcagaaggaggaaagaaaatggcatcagggagtttagccatggtcagatgctttaaggtttgataagcctacacttaaggaataaagaagggagactggcactaccagatattatttaagaaataaaactttaacaattagatcatagatattttaagcttgatcatattcaaacttcatgaatgactggtgaaaaagtgtattctcatctacctttgatgggagtgataagcagaacaacattttggaggtaattaggtaataattataaaatttttaaatatgtgtacaaatttgtgttctccagaaagcccacttacttttgggattttccttaagctatcttgcacaaaacttcctcaatacagcattgcttatcatgagaaaagaggaatttctcccaaaagcaaatttatgactgtgcacttacctaagtgaagaagttatctgagttctgaactgtctgagttatctcataggctgccataaaagaggaaagagaaatgaaattctcttgtgtatataagacatgtctgaaacatctgaattaataaagtctaaacaacaattacttatagaaagtgcaattggagagttagttaagccaggggttatttaatgtttaaccttatatactgctatgctggttaatgttttggtatagtgttccaatttatatatattactcttataatgcacacttattactgaaaaacatataataaaccatatcattgataattccaaaaatgtacttgtcatgtaagatactaagaaaaataaaagcaattgtagagtaagtttgaaaatacatacagctatgagtataaggactatgtaaataaaagatagtttcatgacttgtaagatgctaaaattaagaatgggaattagattgttgtgagaagagaaaaaattcaaatccactccactctatgatttgaaagcataaaccatttactcaaaatatgctttcatttaaaatgtatcttttgagataagcagaatagacaaagcaggtacaaccaatttaaagattaaaatttcattttatgtgatagtgctttgcaaattttaagagaaatcaagtgttcaatattaaaaactaacaactacattatggtatatccatataacagaatttcatgtagcaaataaaaatgacagtagagaatgatatttaatgatatagaaaaacatcaatgatttactgttatatgaaaatgggtctggcactataagcataatgttatgatatatgtgaaaaccaaattgtctgtgtgtttatgtttatacccacacattaagaagatataccaaaagatagttatctctgggatggaatacttaatttattcttttcccctgtaagtccagggctgggttcagaacacagtgtgtgaaacagtcataacatactttattatccttgctggtctcaggtaacagggaatccagtccctgggctgaagagggcaattccatctttttttttttttctttttaatttaagttccgggatacatgtgcagaatgttcaggttcgttgcttagttacacatttgccatggtggtttgctgccgctattgacccgtcatctgggttttaagccctgcatgcattaggtatctttcctaatgctgtccttccccgtgcccaccaacccctgacaggcccgggtgtgtattgttccccatgttctcactcataagtgggaggtgaacaatgagaactcccatcattttaacctgtattgtgatgaaatgcatttagcctccaatgctcattatcaccaatgatgtgaatcaccattggccaggatggaatgtttatacgttacccaaaagttctgagatgtggatgtggctatgcatgttatgtgttagtgtgtaatgtaaaaggaaagaaactattgcttaattaacatttgactttttaaataactattgcctatttaatatttctgctttttctcaactgatagtaacattgtctataaagtattttaagctgattgagtgaactacattgtctcagctccatcctgttcaccctcttcccagtgagtgaagatgttcatggttttattcttacatttacttgttaggtgacttttagcaaatgaatgagactttctgactctccatttatactcctgaaaatagagtagtaaaacataccataggaattttaatgtatgaaatttaaaggaagaaatgtgaaaactctgagtataaatcatggaatatattagctccactataaatgttaatttcatttctttctattggaccctgaaaatatgctctgaaacgcacaaaattattcaattattggtttcacagaactgattttattaaaaagtatatgttgacaagactttacaatgagctaaatccaatataatgcatttgaggtctgttataaataccacaacacatgtattgctttataaagaaaaatcttaaggaatggataggtggagtttttctaacaagagctcagattatagaatttgatacactcaaaattaatacatagcattgttttaagaatcctcttataacaagatcacttaattatattcgattgatttgtctttttttcttaattccttataaatttattcagttactttgttgaaactgaggcctatcaataattttcttaaaataatattaggaaaaatgttatgtttatgaatcatcttacaattccattagttactttcaagaagattactttttgtttttgaacactgctattacaaaaataagccatttattctaatagtctttttttcggacaaatgcagtattagtcatggagttaattttccacaagtctcactgctaaaatgtgatatagttatttttaaagacaaaaatacaatgtgacaacttatattaaaatatattgttgtaaaagttcttataaacatgaggaaatgaacattttagaaaaaaatctcataaatatatctgataaaatcacaaaatgaaatagacaaggatttaagtacatctctcatttgctgaaaccatgcatcaggagctgataatgaaagatatatccagccaggcctttgggagattataactttgaataacttttaactttgaaaaaaaattactagcatgcaatgaaagattcttgccttgtgatacttttagtataaatttatttttttctctgttcttttatgttttttggcattaagctatagaatgctctccccaagtaaggttttgggtgaattcctaaacgaaatccacaaaataaaaaacaggcaagactttgctgattggttccagacctgaataacataaaatgagtctccttagcattagaagtaaacttgaaatgttgatatttatcatgtgtatccaagtgtatatgaagcatattttatatttttaaaactaatgtaagctaccctcatggccaaaaaattaagttagtccaagtaaatcaatattgatttcaaaagtgataggcaaagggattcaattcctctgagtctgttcatttgcgttttcctgaaattatttgccctgcttatgatttctgagatctttagataaacatgatagttggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggtaagtgctgttttaactattgcactggggatgttaactgtttgggacagcgttttttgtaacaggaacaggaaaaattccagagcaattttgccaattgctattcaacagcaaatccacagttctgagcatttagtttcacattttgttaatatgttttccatgatttatagatttgagattttatacagtatatgctgtattgcttggcaagagaagttataaaaagtttcaaggttagaatgagaaaatagttaaagtagacacagtgaaaaaatatagaaattaatatgtttgttatgtatgctagttagttatatatgttagtactggaccctaatactggagcaaagaaaagtcattttaatcagcattcaaaatatcttttaataagcatattgtgacaatttgttataatttacaataaacgttctatgttataaaacatgagctaaaagatttaggaactcttatggattatttatttctgttttgttaatttaaaaaatttgtttcttggatatatgccttaaggaacgagttttttaaaaagttctgggaaatgatttcgtttttgaaaacagcattttctctatagccacaggtatttgaaaaaactgagggtagtacagtgtgattttgcctcatagtggagtcattatatggttgcaaactctcattcaattcagcatccttgtttttactttgccaaaaaatatggaagcatttttcattactatttaatactcacattatagttgccatattttggtgtatagtaaatttaaaatagcttattaataaagcaagacaaatctttacagtatttacattctataacttaaaataactctgggaatatgtcatcacgttctttttagtgctatgcaattattattatggccaagttctgtcagcaaaattaaatgcccccattaaaatcttagagagtaatttactgagaatctggctacatgttaccttatgtcagcaatcaaagtatttctaaaagctgttttataacgttccatctgatctgaaataaagtgccttacaatttcaaattaaaacaaataaaagacgttttcagtttctaaccccaaagatcctgcttatcccaaactactttgatccaaaagcttgtaatcatactttcatagaaagatataatattctcagttatctattagaatgtagatctttcgtcacattaatgatttatctcccagggctaccaactttgcctcagccacaactgttcactctataaaagtctaactcttatattccaattttcccatatctaaattgctgcacctaagacattgaaatgtacttttttgagcctcaccttagaaacatgttcctatgagaagataactgttacacattatttcaaattcatattctcaattgaataatttactagatagttctaacaccagtattaaatccaaactttaaaaacatcacacctctctcccacctccattctgtgaggccactaaaagccagatatgcaaaccatggcatcttcgattttggcatgaagaaagtagagaacttgtgagtaattgagagagactataactctaattgaaaacttggaaaatactatctttctctacctgttgaatctctttccagaaagagaaaccttcagaatgtgtgacattttcctgataaacattagcaattattaaatattactaatattttgtttagtaaatagctaatttatgaaatattagtttcagaacacagttttgcaatgtgctttaaaaagtgtagaatgttaagcacaacatgaactagtatgcatgcacaccagcaccaagaattctgttctccttcctcagaaccaacagtaaccagacacttttaaaggaatgtgccttccatttccctcccacatacaagcaaaacctcaggttgcccatattcccgtaaggatcttcttcatgagtcattttaatgatgtcgaatggtagggtagagtatacagttaaaaactgtcttctcattctctttttttgagagatgatctgaagcagtagtctaattcggtggtcaatgaacaccacccagaaacctcttacaggaaggcatttcattaaggaagagcctgaagagattgactggaacaattaggctgggctcgcccagaagggggcgcacgtgtacgcaatctaacctgaaagctgctcactacatagttgtaaacatacacctttgtcctcatacctaaataaaaatttaaaagacgctgttagatgcactaaaaatagctataaaataacaaaatgcacattttctaatgaatttaatgttgcaaattgaatgtctttttcttgaaagtatatatttttttaattaataaatgtttcatctttatttaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagagtaagtaaaaagctgttcctgtgtttgatgtgtgctcaagtgtttaaatacctgggctgcacaacacagatattgcatctggctccattaaaaaaacaaaatgtcgcccgggcgctgtggctcattcctgtaaatccagcattttgggaggccgaagtgggcggatcaccaggtcaggagttgagaccagcctggccaacatgatgaaaccccatctctactaaaaatacaaaaattagccaggcgtggtgtcgcacttctgtaatcccagctactcaggaggctgagccaggagaattgcttgaacctgggagatagaggttgcagtgagccgagatcgtgccactgtactcaagcctgggcaagacagccagattctgtcttggaaaaaaaaaaaatgtccacaaaatatccctctacttcaaacaaagaataattctagctcaatcatatatccaatatccagcctttctttggtgtatccagataaggaacaattaaggtcacagaatttaatatgtaagtcttcaaactaaaaattccgggccaactcatcctgctgtgttacctcctcatatatatctcttattattttctcctttatggcttagatttgtgtcctacatttattttttgacaagatctagatgagggaggaagaaatgagttcaaaagtggcacagttggcaaactccacagccacaaagaagcccatattgtccctccctccctccctctctctctctttttctttcttccttcctttctttccctttctttctttctttctttctttctttctttctttctttctttctttctctttctttctttctttctttctttcctttctttctttcttctttctctctttctttctttctttctttctttttctttccttctttctttctttcgttttctttctttctttctttctttttttttttgacagggtctcactctgtcgcccagactggagtgaggtggtgcaatctcggctcattgcaacctccaccccccaggctcaggcgattctcccacctcaggccaccaccaccaccaggctaatttttatgtttttagtagagatggggtttcaccatgttaaccaggctgttcttaaaatcctgacctcaactgatccatctgccttggcctcccaaagtactgggattacaggcgtgagccactgtgcctggccccatatagtctcatggtcttccctgacatcaactacttgggactcaccatgttactctgctgtcatgatcatcatctgcctctgttatctctgttatggtgtgtggccatcacagtgctctggaggactgtgaagaagattaaagagaaaaagaaatatgatgggagattctaacatctttttttttttttttttttttagaagaaaaatagtgttacagagctttttttttcttgggtacaatcctgcccctcatttgatatttccacactttctctttctcctctctttatttttcatttatcttctggatgaagtttgatctgatgcatttggactgcttatgcacttatgtggtcttcagggacattcttcaacttaagcagtatagattccaatgggaaattgaaatccaccatttcctaccaggataactctgccattaatctttggcagagcttggtagaagagaaaaaccatgattcacagataaggctttctaaatgaaaaaatcaagcaggaaacattgattcacatataaagtaataatgtctgcaaaataatctattgaatttgaacatctctacatgatgaaaattggttttctggccatgctgaataaaggtattgctgtcagaaaatattacaatatattttatgcatatgatgtttgttaattctgccagtttcatataacctctagtagggttaaacgttttcataaagaagaccatactcgccaactctgaagctccacatgttctttgttgtttctgaaaagcagccaaggtaagggttggtgctgtttgactgtcacacaatacacagtcaggctaacacagctaaacccctcttgttgtttccagtggaaaattcactatgtggccatatgtgattcctcattttaaacatatgtggttaggaggaaggatactctctgacagaccaaaatgctaaaggaatttacgatgcttaagggatgacggagtacattagatttggtgggtagagattattcgtaagagcagggctacttctttctctgaaacaaagaaggatacagaagtaggcacatttgaaggtatacattgcatgagtaaaggatggaagagaggtctatgggagaaaggccaatggcctgtcagtgccaagctgagatagaaaccacagtgcccagtacatagtggtcatttgaaaaggtaacataatagtttcctttctttcttccttatctttgtacatttagtcaggtattctccttgtctttttatgtatcacctcagtttaggttattttgccagataataatcaactatatcaacatttcacattcacttaatacagaaagttcccctcaatgtttttttctaatattagggaatatatagccaaaacaaactgttttctatttcaaacttgcaactctaagcattagcccaatcagagatcttcctagtgtagagtaatttagaaagacagcaaaatcaaaaggatattagtcattatttaggacatactatgtactagtattgtgtgaagtgctctacacaacttaatttaatcttcatgcaacacggtaagatagatgtgttatttctaacaagatcagataagtgttccagtgttgcccagctgggtaagtggcagaggtagaattccaagatgggactatgcccatcttctttccatttttcctcactttctcaaatgttggtaccatagaaaaatccctggaattaactgatgagttattttaaaaagcatgtgtgtttggggttccactgaagtctttgttaactagagtttgaaaatgaaaacaagataaaggacttgaaaatgttaatctaaaatagacataggcaaacatagtttctgtgtatacacaggtcagtcaattcagtaacactcttggtttctattacaaagtaagtcagtgtttcatttgtggcagctttttgaccatggacaaaaataaacaaataaacaaaaacatgagttcagatggtggacatgccatgattaggtttttgccttagaattttgatcattgctatggtgtgtgattgctggaatgatttggtttttgtcttggaatttttatcatggtcatggtatgtggttgctagaaaattctttatagatcatctagttaacccttcttatttttagatgtaaaaccaaagagtacttatactgagattgttcatacaacaatgggatccatttatatttcttcaggttatactatttcaaaaaagttgttagataatatgacacacttattgaatgcctttttaaaaacaacttctagtaataaaataagttctgttatttaaaatattccactgaatatcttgatctaccatgattactctttactaaatgttactgtgccattttggtagcctgaaatatgcctttaatggttgcaaattcaaacatatactatattatgacttttctaaatgggaagaggtcctattttataatatattaaacataaattttttgtattgttttgagccagtgtactgaaaaatgattaatgttttctattctttaatttttagagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcttgtgaaatttctgtactttgtatataaaatacataaaacaatagattagaaatcaaaagatatctctggcctgcaatattttactgatgtgaacataggattttccactaaataatttgtctacttctagcattcacttacaaagagttcttaaaaacacctataataggtacttagatttcacaacttacttagatatttgtcattattcccattcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaatactctgcatataatttataaaaataacttctgttttacctagttaacaataaaacctatgtgtggagccaaatgttatgcagacaaaggtctgctcatcccataccagtgtatatatagtcaaatatgtgtctagtacaaataaaatgtatctctaaggcataaaatgttttaacacaccacttttagtgaactctatcttatggtacagcggcctttcatcaaaggatcatcattgagactgagttgactggcagatatgtgcgatggatattacattaggtacaatgtgtatttttgattttcatgagttttctacattaaggtaaattccttagagtgtgatagcagcctcagtttatttgttggtttaaacttgaaatctactttttctcgataaaactataatgtagatgaattgaaaatgaattttcttttccctgtctacaaaagtcactatcaagccttggaaacctattctcaaatagagggtagataatgtgccataaattctcttttagaaagaatgtgatggaattaaatgagctttgtctctatactacttagaggaaacatcttctcagcagacagtctgtctgcatctttaaaagcctttgatttctctctatccaaagtcctatgttattctcatgcctaagaagcaaaactatgacttttaaaacagcagttccctttgtagttaatgttggttgacaaagacaaagttaagcacttagtgacactttgttgtagaagcatctgggaaaggaatataccctgtttaggaacaactcctctttttagagggaagacttcatcttttcagggcaaagctggagaagagaagattcccacttactccttcactcactgggcagccctagtgaggtgctgagggaagaaaatctggtgaaacttttatcagctttctcctcatctctccatcctcaccctatttagggtagtgtttttcaaaatggtaagtgtataaccagcctgtaagggtgtatttctacatccaggttaccagacatgccccagatatacagacgtaatgaattgtgcaacataggattttgcatttttaaagcgcatccacgggtgattcttataccggtgctcagtgttgcatatttttcaaaacaccgacttagtgtgatactatgattaagttactgaaatcacaaataattaaaaagcagaaaagtactcttttctagggaggcagaatagaaagtagcctgcttttcacagcatatctatctatcatctatctatctatctatgtatctatctatctacgagaataaatatttttttttctatattctaactaatttaagctctctagccctctacttcttcatccataagcaaggaatgcagatacatctttcattaagatagcatgagacacttctgccatgaaacttgcttgagagtggctttataacacttcttacccacctaagttccttttcccttcagagttgtccaactggtattctatcaagagaaatggctaagggttcactttgatgaaatttttaagaaggtacccatggggaatgtcaacagcaggttgaatttaaggcaagagattctctcaactgtctcactaacaatagtgatcttgattttatctccttttggataaagcggataaagtcctccatgagtggattaaagcaataatgcatataaattctttctttcccaagactgatgcattagaaccttaactgtaatcccttactgtggggagaaaatggaaaaataaggaaagttcctttttgttctcaagacaaaaattagggttaactggtgcctttatggtgaaggagagctataatgtactcaggctttgaggtttgtgaggaattatcatgccctaataagtacaaaaaatacagatgaataatagaccactaaatgagcaagaggaatgttgatttctcagttaaaagttctccaaccggtaatagctatgtttttagaaatcctgaagagtttaaaaggttggttttcaaaaagactaagagttttttttttccttgtgatcttttaagtttgggttccggtttttctatagttgtaattttatcataatgatagccttagacttttctttggttggattttgcaaccatcataaatacttaacattcactcacaagtaaaaggaagttctcattttatttaaagggaactgcaaagtaattttactaccagaagtaaaaatatatataaaaatggcaatgttataaaaaaaagtcttgtttttttgaaatatatgaaatgaatcaaaacacattaaaaatgtctagcaaattatattgtttttacacacatattcaatagattttgtttccagataagatataacaaattgcaatacaacacatgaaaaaaaaaatagaaatgtcagcaacataaataagtgaggtctcacgcattcatcctaatctcactttgatagccctaaaatgtcacttcttctagtagctttaaaatttggattggcccaaagagtaccatctatatttgtgtcttgtccccttacaatgcacctgatgttctattttttaaaatgtatgttctaaaaatattcaagagccttagtagtaactttaccctatggattgtatttcaaataagcccctctctagcctcactgccaagtctttatttcaagacttcctgaattttcacttagatttctgaaaatcctcatgttttgcctaacttaatcatcaagtgcgttattagagcaagttttctgacatataaacctggtcccatattatttatctgtttaaaactgttcagtgatgtaccattgctttcaggatgtgatccaggctcctcagagcagcacaaaaggcattccaggacaccaaaggtcctttgcagttttcaaaggtcctttgcaatttagtccttagttacttctctagacttatctcttaccaggttttgtcagacttcatcatgcactacattaagttgcttgaactgtttcaaccatacttactaatttgcagctgcatttgctctggtgtctatgaaaacgcctttcttcctggaatcccctcatgcccctttcacttggaaacacataaacatcttttaagactcgtcttaagctactctaacccttcagcagaatacctcctctgaactttctcaagtagaattaatatcctttattataaaacaaacatctgttaaaaaataaaaatcatttatcaaagtttttttaacaactcccttcattcattgttcatccatctgtaccttttccattaattcatttaactttttaaaaaataaagcttctactatactccagaaatggcttaggtgctggagacactgtagtgaacaagactggcaaatctttatcctaacaaagttgacatttataggggattcaatcagcagataaacacacagtctatgacatgatgacagtagtgataagcgctatgaagaaataaatgacctgaaggactatgaagaaatggagggagtggtgatttttttgggtgataaggaaagacttgtggggagcagacctaactgtcattataacatatatttggacattaatttaaatgttacaatacattagataattcaaggaatgttctttaaggattattttagctcaaataatagttataaggtacatttctacttaggcatggaaaaaaacctgggtgtaggatcagacatgatttgaagtgttgtaactctcatttgagaccagatctctgttctcagagtgtatattataacttagtaaccccccgtggcattaaggggggcttagatgtgtttacatgtgtgtttgtaaatttcctcatcttagccctgacaaaacacagggcctggaagtaagttttccagacgtggttgctgagtagcattaatggaatgaagctgtggttggaaggaacaagttacaaaggtcagtcatgaggctggcctctcctggtgagctccagcacaattgcttctgctttactccctttaacattacacaaaacattgcaatttactttaatccatggaattatctacaaacatctatctattaaatatattttttcattaaagtgtacttgacaaataaaaattgtatatctttacagtggacaacatgatgctttgatatgtgtatccactgtgaaatggttaaagctaattaacaagcacattacctcacattcctatagttttctattgtgagaacatttaagatctgcttttattagcaactttcaaatgtacaatacactattattaactgcagttaccatacaccataaatctcccatgcttatttatcctgtctaattgaaactttgtaccctttaaccaacattttcccatctacccagccctcaccctcagctcctggtagccaccattctactctttctgcttctatgagtttgacttgttttagattccacatataagtgacatcatgcagtacatttctttttgtgcttggtttatttcacttagcagaatgttctccacttttgtctgttattccaaaaataggacttcctttttttatggttaaatggtaatctactgtatatgcagatgttccttgacttatgatggtgttatgtcccagttaacctgtcatgagttgaaaatatatgtcaaaaacacattgaatacacctaacctatggaacatcatatctagcacaacttatcttaaatatgctcaaagcactcacattagctacagttagacaaaaatcttctaacataaagcctattttataacaaagtattgaatatctcatgtaatttattgaataatgtactgaaggttacaattgtgtgattgtatactcgaaatatggtttctactgaatgtgttatcacttttgcaccatcataaagtcaaaaaatcataaaccgaactattctaagttgaggaccatctgtatatacaccacatttgtatccatttatacatgaaggaacccttacattgattccatatcttggctattttgaataatgctgcaatgaacaggggagtgcagataactctgtgaaatactaatttcaattactttggtatatacccagaagtgccattgctggatcataggttagttctacttttaattttttgggaagcctcttactgttctctgtcatggccgtggtaacttacattctcaccaacagtgtgtaagggttcccttttctccacatctttgcaaacacttatctttcaacttttcgataatagccattgtaacagacacgaggcaatatctcattgtggttttactttgcaatcctctgatgattagtgatgttaaccattttttaatatacctgctggtcatttgtatgtctttgttttggaaatgtctattcagattctttgcccatgttttaattgggttatgtgtttccttgctattgtattgtacgttatattttggataactccttataagatgtatggcttggacatcttttctcccatttcataggttgtctcttcacactattgattgttacctttgctgggctgaaggtttttaatttgatgtaatatctattgcctgtttttgcttttattgccagtgcttttaagttcatatcctaaaaatattcgctgagactaatgtcaaggagcttttcaatcctgtgtgtgcttccagtagatttataatttcaggtcttatgtttaaatcttcaatccattctgagttgattttttgtatggtatgaactaaggatccaatctcattcttctatatgtgaatattcagttttctcaacactattaagaagagtcttctttccccattttgtgttcatggcaactttgttgaaacttaactgaccataatatcatggatttactttggggctctctattcagcttccttgccctatgtgtatatttttatgccaataccattttcttttggttgctgtagatttaaagtcaaatagtgtgagacctctaactttttgctcaacattgccttggatatttgggatcttgattagttctatgcaaattttagaaattatttcctatttctgtaaaaaatgttattgtaattttcatatgtattgtgttgaattttttttggatagtactatggcttaagtgtgtcccccaaatttcatatgtcgaaaacttaaccccaaatccaataatgttgggagatgggacctaataagaggtgatttggtcatggtcatgagggctctgcccaaataaatgaattaatttcattattggaagaaatagttttgttataaaaatgaatttggcttattttgcacatgtgcatgtgttctcctacccttccaacatgagatgacacagcaagaaggccctcgccagatgtgagcgccttgactttgtactttccagtcttcaggactgtaagaaataaaatcgacatacttattttaatttataattacatttttataaagttattcatttttggtaataaataatttgttataaataaaatttataaatatataaaatacataaataaatatatataaattgttataattacacagtttcaagtattttgttatagcagcacagaacaggactaaaacaggtggtacagacattttaacaacactacagttttccctatgaacacaggttatctgtcaatatatttgtgtcttaattttgttcactaatgttttacagttttcaatgtacagatctttctcttctttggttaaattaattgctaagtttgttttgttttttgtttgtttgttttgtttttttttttgagacaaagtcttgccctattgccaggctggagtgctgtggcgcaatcttggctcactgcaacctccgtctcctgggttcaagtgattctcctgcctcagcctccagagcagctgggactacaggtgtgcaccaccacgcccagctcacttttttgtatttttagtagagatggggtttcaccattttggccaggatggtcttgatctcctgacctcgtgatctgtcaaccttggcttcccaaagtgctgggattgcagacatgagccaccgtacccagtcaattgataagtatttttgaagctattatagatgatattgttttcttgataccttttttggatcattcattgttagtgtatagaagtgctactaatttttgtgtgttgattttttatcctgcaactttattgaatttgtttattaattctaacacttattttagtggaatgtttagggttttctgtataaaacatcatctataaacagagtcaatgttacttccttttccccaatttggatgccttttatctctttttcttgtctaattgctctggctaggtcttccagtactacactgaacagaactggtgagaatgggcatgcttatcttgtctgttatcttagaataaaagctttcagcttttaaccattaactatgatgttagcggtcagtattctatctttttttcagagagtattgtctaccctcataacttgggatactgaatagagacatattaattcatatgaattgatttactcatatttaatctattgtctcagcccaattttgtgctgctctaacagaacaccagagactaggtaattataataagcagacctttactggctcacagttctgggagctgggacttccaagattgaggggctggaatttttcaaggacatttttgcttgtttgttttgtatcatcccatagtagatggggaaagagagggagagagaaacaaaaggagaccaaactcat

SEQ ID NO: 12015 - DNA, 44064 bp, Human
aagtcatgatagcctgcatttaaggcctcagactagctgagttatctagcaagtgtggaaatgaaagaaaagagatcctaggacttcgacctggggcattctgacataagaattattgactccatcagttttaacatccaagaaattttatcttaacatttatggagccccaaggcttcacaaaaacctggaataaaattcccaagtgtcacaatgctggcatgaagtggcagtcaataaatatacatggaatgaatgaatgagctccaaaataaaggtttcaaaaacccctgagattttgcgattttagaaccccaagtttcttcccacccatgatgtgttaggttgaatggtgacttccccaaaagatatgtccatgtctcagaacctgtgaatgtgactttgtctggaaaaaagagtcttctttgcagatgtaattgagtgaagaatcttgagatgagatcatcctggattatctgagtgggctctacatccaataagtgtccttataagaaacagacatggaggaaaaacacagacagatggggagaaggccatggggctgtggcagacattggagctgcggtttcaagccaaggattgacagcagctgccagaagcttgaaaaggcaaggaggattctagcctagagtctccagggagagtgcagccgcctggctgacacacgccagtcctgccaacaccttcattttagacttctggccttcagaacagtgagaaaatagatttctgttgttttcagtcatccagtttgtggtcatttgttacagaagcctcaggaaactattgcacatggtctcttttagctgatgctgatgcaatatttcctttggagctctgctgtattctgattcagtgattctcaactctggctgagcattagaattgcctagatgttttctaacaaaggttggttggtgtctggaacatcctcagagattctgattcagtagggctgtggtacaggctgatattggtgtagagtcagacataagaattgccatttaattagtcacaacaacttaacatcaaggggtggcacagaggtacagggggtgggaatacctatataattgtttcaccttaggaatttgctttgaaacataacaatatgtgtctttacattcaagtatattcttagaaactagctgaagccgtttcgcatccttgtggcactaagtcctgtttccactgtgaaacagttaccaagacagtcctgtttccactgtgaaaaaataaatggatgttctgacaggtggccaccattgctgacctgaccattctccagaagcaccaggaggcattgctttctagactgaagctcagtcatgcttcactttagtctaatcaaaaagatttgcttgcaagccttcattccaaatggttccagtgccttccatacaatcagataatgacaattgtgagtttctggtggcatgctacttcatgtaattaaaaaaaaattgctgcgtagatgtgctgaataggagaagagtaagttattatttggagggaagaggattcccaattgtggaacaaagcaattccttgtaccctggttctacataaatgtttctttatttttgaagttgcatgaccccctgttgtggtcttttttgcacacatgtcagaaagcagccatgagtgcattgtagttggcaatgtgagcttctgtgtaaagggtctttgacgaagagctcactgcatctactgactccccaggatgtctgaggtcacaagtttggctggagcacatgagcccagataaagaagatggttttgccctcctgaaataaagccagaagtgatctcctttattgtgcactttgggtcatgtgctaatgatgagggtttctgtaatactaatccccctaatgaaggcttctcccagcccttacacaagcccccaaggccccgtggcttggcaagccagagagaataaaagcagcacggtgtttggcttttgaactgagttcaaggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggtgaggcccatgctccaagcttggtggggagggccagagctggggaaagagctccttctaaggaagagatgagactcttgacagagactcttagattaggctttgaaaggcaaaccaatgatggttttggtcggaagcatattcaataaggctgatgtgctggtttattcttcacaccctctagtacatctagttatgaagactaaataaatatggcgtgggccaagcctgcttatatgaatgcatgccaacatactattggcttgtttgttggaaggggaatttaagagcttaaaagcgtcagctttgaaactcggagcaagtcctttcaagatggattcggtgccctctcctgaaatgggtttgcacttgttgaaaagggatgggtgaagcttggcattcggaagacaggagtcaaaggcaggtgttctggtctcagcatttctcatgatttgaacagatctctctctctctcttttttttggagatggagtctcgctttgtcaccgtggctggagtgcaatggtgctatctcagctcactgcaacctccatctcccgggttcaagtgattctcctgcctcagcctcccaagtagctgggattacaggcacccgccatcatgcctggctaatttttgtatttcgagacggggtttcaccatgttggccaagctggtcccgaactcctgacctcagcagggtgcatgtttctcattaaagcttatgaccaggttgtaactttgacaaaattgtcgagacgtggcaagacagagctttctcgaggagctgggggtggggggggcgggcggggggttgttattagataacaatggctttttgtcactcttctctggacttgaaccggacatcacaaaatttgctcagtgtccttcctttagactctggtctctctcattacctgttgctttgacatctctgtgcatttctcattcctctagctctttggggctttttcaaatcctcttcaatctttcccacctccagtttccagcagccatatgcccttcgggaataaacactcaaagcctggcagggggccactgaaatacaaaaaacacaagtggcaacctcaggaaagcccttggacactgttgtaggctgggtggttgcagaagactttttccttttaaaaatactttttacttctcttctcataggatgctggaacataggaggatataggtcattgagcttcataaggggttgaataggtattactaagggaacatacaaaggcctgtgatgttggtgtaggaatgacattcgattttttttttttaattttaactttcaactttattttagatcctggggatacaagtgcaggtttgtgacatagatatattgcacagtgctagggtttgagatatgattgatcctgtcacccaggtagtgtgcgaagcacccagtgggtagtttttcaacctttgacccctccctccctcccctctctagcagtccccagtgcctattgttgccatctttatgtccatgagtgcccagacattagatttcttttttcacattaagagttctggctttaggcctggtgcagtggctcacgcctgtaatcccagcactttggaaggctgaagtgggtgggtcactttgaggtcaggagtttgagaccagcctggccaacatggtgaaaccttgtctctactaaaaatacaaaaattatctgggtgtggtggcaggcacctgtaatcccagctactctgggggctgagacaggagaatctcttgaacccaggaggcagaggttgcagtgagcagaaatcacaccactgcactccagcctgggtgacagagtgagatctgtctcaaaaaaataaataaataaataaatagttctggctttataatcattttgtagtaatatttttaattctgtcattcagaagaatatctaggtcctggttttgccctgggtattaatcatgacaaaaatttcaataacatattggatatatattatccagcttttctaagttttttaagcatttgcttctatagaccttctctcaaaattatcatggtgttttagacgaatgaggagcaggttgctggtgtggttagcgtgattgaaaaccacactaacacagtaacttctttgttcaaaaccccaaaatacttctagaacaattatttctatgtcaatcaatgaaaaagtgctggccaagcgcagtggctcacgcctttgggagccaagcactttgggaggccaagacgggtcaggagttcaacaccagcctagccaacatggtgaaaccctgtctctactaaaaatacaaaaattagcgaggtgtggtgatgggcacctgtaatcccagctacttgggaggctgagacaggagaatcacttgaacccaggaggtggaggttgcagtgagctgaaatcgcgccactgcacgcagcctgggcaacaatagagtgagactgtgtctcagaaaaaaaaaaaaaaaaaaaagaaagtgccaacactttcaaaaagttgtaaatctgcattgcatagaatcctgaggcagaggactttaggaagtcacatataaccataaactctttttgttaccagcttcttcatatttttgccatggctagcaagttttgttttgttttaggtagggatagaaagaatagaagggatcattgctatttccctttggtaaggaaatgtttataaatattgctctagaagtaataggaacttaggatcatggagacctaccttcaaaaaaaaaaaaaaaaaaaaaaaaaaagaggctccccctgctctaaaaagcccttgggccagaaataaatagggcctgttctttaagtccaggctgtaaggaagtcccatgtacataagccagtccaaagaagcagggcttcctccagggagatggtctgcctctccagccattgtcaaggcccggcctggccctgaggccccatctccaggctgtggctcacctccccccgtgatctgctcagtccaaactcatcaggaacagaactctttccacacctacatttttttaaaggtaacttaagatttactgtatctataagttcaatttactagacttttaatgtttcccagttttattgaggcataattgttacacagaacactgcacataattaacgtgcacaatatggtgtttggacatacctatacagttgtgttgccatttccacaatcaagataatgaacatattcatcatctccaaaggttcctcgtggttctttgtttttgtttattttttgcttttgtggtaagaacagttaacatgagatctgccctcttaacacatttttaagtgccgaatgccttattgttaactataggcactatattgtacagaaaatctctggaacttgctcatcttgtatcattataactttacaactccctatcgcccctcccccatcccctggtaaccacaattccgtcgtgtacttctctatgttcagctactttagatgcctcatataagaataatcatgcagagtttgtccttctgagactgacttatttcacttagcacaaatgtcttccaggtccatccatgctgtcgcaaatggtagaatttttttctttttaaaggctgaataatattccattgtattgtcataccaactttggatggctctacttatcttgctagatggtctttttctttgaatctcagggcacgagactaagtccttagtgactgagctgggaagttattttgtgtatgtcataattaccattctgtgatgagccgtgtgtcccaaagcaggacacatgtccttcaattaattattccccaaagagtaagttgctagccttcctagggtagcttttttatggtttgtggggcaatctttggaattgaaacctgatcctgagcctcccagagaacatcctctacagtagcctgatgactcttttgcgaatggagtcactggggcactcctgggatgatccaaaatttctcaaggaagagatgtagattagtgtcttgtaacagactattgatgaccccaaatgttgttaattctttggaaaataaacacctcatagtttccataatcatgaagctggtaaagtaatttcagcctaataagtagaaacacatagaaattctgggatttgttttttaaaactctaaattctatggtgaaattctctgtagagagcttctctatagtctctgtagggataaattgaaacaaaaaagccactgagcttaattgtcaggaagagctgaattgcaggagactttgaatttgctattcaccttataaggcttacctgccagttggctttatgagaatatgccatttgcagctatgtcttttggcttctgaaaaacttgcgcaccaaatagtttttgaacagttgacggtgaacttcttgtttgtacaagtgactaattgcctccattttccaatctctgaaatggggataatgatgaaaccacacttgtaaaatccttttgatttctgtagatgaaaggacctatgtaagtataaagtattgttattaaaataatagaatctctaattaaaaggaataggctatttagagttccttgtaaattcactaatcggtggtctttaagcttatttagtctaatggctttctgaggttgagctgatgcagttcatgtaggaatgtgtggtgtttagatgatctcactcttttttccatttttatcatagtcctttgtaaacatgagactttgactctttaaatttaattttcactgaaggacatactcaatggtcgatagattgatattatctaggaatcattttttttcctctctccatttcccagtaagataacacggttctttctaaaacacttctcttcttatattttttgcattggtagattaagaagaaaaaactaaatcatgttaaattgatggaagatgctattaggaaaactaaattaaagaaataaacattttgtctgctaggctttcatgttgttacacttttcagtcatctccagcatttcaacaaattcttcaggtcaggtctataaacttagaaatgaaagggacctgactgcagagctttggaataatttctctgagacatcttggaaaaggaattttttaattgaataaatttctgggtcataaatgggctccaaaacagacacaagctttctttacccccccacttcccattcttttcacagatgttgaaagctttcttattagaacttatacattgccttttggaggcaactctggttacattaaagtttcttgttcactgtagttgtgaagcatctctgattttctgaatcaggattaatcatttcgtcatttgtcatccagtggagcttgacttattcctctgttttcacttttcccacagtttgacttgtgttgaaatgtcattgtgtacttgtccttcatttccactagactaaggtattattgcctcatttatacagatgctccctgacttatgatggggttacatcccaataatccatcataagttgaaaatactgttaagtcaaaaatgcatttaatacacctaatctatgaacatcacagcttagcataacctaccttaaatgcactcagaacactaacattagcctacagttgggacaaagcatctcacacaaggcctattttataataaggtattgaatatctcatgtaatttactaaatactgtactgaaggtgaaaaccaaaatagtcatatggatattcgaagtagagtttctactgaatgcatattgattttgcaccatcctaaagttgaaaaattttaagttgaaccatcataagtcagaggccatctgtatttgtattcactagtgtctgatcccttttattcaattattcattgattctttcaccacccatccaagcaacatttatttagcatcaactaggcccttcagatacagagagggggaaaaactgacgtgattcttaagatgtgcacagtatagtcatatgtaagacagatatgaagacaaacaattgctatactatttgataagtggtctctaataatactagtaataataacacaatatagaactcacggcagggtgcggtggctcatgcctgtaatcccaacactttgggaggccaaggcaggtggatcacccgagttcaggagttcaagatcagcctgcccaacatggtgaaaccccatctctactaaaaatacaaaaattggccaggtgtggtggtgtgcacctgtaatcccagctactagggaggctgaggcaggagaatcgcttgaaccggggaggtggttgttgcagggagctgagatcacgtcactgcactccagcctgggtgacagagtgagactgtcttgacaaaaaaaaaaaaatatatatatatatatatatatatatatatatatatatatatatatatgtatgtatgtatatatttaactcactgtataccagatgtagttctatgtgctccacattaatgtgcttgttttttataacataaaagctatggtagcataaaggaagatgtgttgattgttgtattttttaatagactttagagcagttttaggttcacagcaaaactgagtcaaaagtacagagagttgccaaccccctgccctcacacactcacatctccctcactgtcagtgcatgtttagtgttggctaccttttagatagtagctgttcaataaattgtttgttaaataaatacatgagagagccaattattttgtttctgccaactacaaagaatcatggcaaagaaaataagagtagtcttcaaattcatggcataagttatgaatgactcagtttcaacagtcaggcccccaattcaaaaacaagtgttatgcctttaaatgtaaaaaggtattaaattattattataaattttaggtgtgttatttattaatatttttaaatattgagactttattattttagatcagttttggattcacattgaaattggggagaaagtacaaaaaattcccatctaccttctcccccacactctgcaatcttccactagcaacatccgcaaaccagggttacaatcaatgaacctctaccgacattattatcatccaaatttctcagcattatgaagcaaggaattactcttctactgcagagaagtgactagacatttacctccaatcagctatagataggcagctggaaatttgactgaattttaatctgggtagctactcttctttagacacagcattttgttcactcagttctcaaaacagtgttccattcctgtactgtcatagtaggtgatatgttttaatcaaatctgtttttaatacatacagttttagtaaggttgccccagggaaaatagacttcaaggtccataaaacgaagcatcttgcatagcatctgatgagatagtagccgcttcataaatatttgttaaataaatagtttgtatttaattatctccaggaatcaatgtacattttaatgtttaacttaaactattcaaaaacattgttagtcttgggaagagtagaatttttccttttttcaatattttaacttatgttctcatagagtgctgtaaaagaaaaatacagataattgagctacgtaaaaggtgggatatatgatatattataaaaaacaaaaaaactcaaccgattacaattagaaaaaattctccctacttacattttaaggaaattttctttaactatcagaaaatccactgtagaaaaggaagcctgtgcattttctttacagaatgctgttaatcattttgttttcatgctgttggaaaattttcctttccttgagagatccaaataactccccctcccctatggtcatagtactttttacttacctctattttgctacttgtagtttaccaaaattatttataggggctgctttttctgcaaacccacagaacagggagagaaaatgtatgtggcatcatctgctacatgctcgatacttctgttattcactcaacacacatttgttttgaacaaggctaagcacaggcctaggcagtgagttcacagccttacagctgcctggagctgaaacaagtgtagtaatgtttacaatcagtgtaaataaatgtgaagaaaggggatgtatgaggtgcaaggaagtaactgacccgaaccccgacctttggaatcaagaatgaccttagagagcacaaacgtgaagcttaaaggagaaatggatcacgcaggtaaagaggaatttagggagacagtgagggaaaagtgtttcaggaagaaggaaaagcaagcaaataggcctagggcatgaggtagaggaggaggagtaagtgagctggtcaccctctttaaatgctttacgtaatccctttaatcttctgggagataagcattatcatcccctttcgtttcaatcttgtgctctaatgatatttaaattttaccctctaacctaaggaatgaaatgttggtcatacccaaaggcaataagttggaaggctaagaagggaaaagtctggggcaagctacaaggatgtaaactttagatgctgatcagagagatgcccagagcttgatcttattagtcctgtcctccttccctgggctttgagaaagcagggagctttgtgcagctgacagaaatcctgtggtggtttgtacttcctgacatcatggctactgattcaccctgaggacttgacagcttccgttgattttgtcttaatgctgtcaacttcgtgaaataagtcagctttttaaatgtgagatttcttctaaattcctagaaatcagttaatttatgtatttattttctttctttctctctctctttctttctcttcctttctttctttcttttctttctttttgagacagagtcttgctctgtcacccaggctggagtacaatggcatgatctcggctcattgcaacctctacttcccgggttcaagccattctcctgcctcagcctctgcagtagctgggactacaggcatgtaccaccacgccccgctaatttttgtatttttagtagagacgaggtttcaccatgttggccagtctggtctcgaactccagacctcaagtgatctgcccgcctcggcctcccaaagtgctgggattacaggcgtgagccaccgggccaagccatgtatttattttggtttcatctttagcttgctgtgtattttcttccttctctaaatcaatgaactgttctgtgtcatccctttttgtgggcgtggagtggacgcaggaggagacacgcctgcgatcctgggaggaaggagtgtgtgcatgagtctgctactgctgccgtaacaacatcccacagactaggcagcttaaacactgaaattcaccctcccacagttctggaggatggatggctgagatcagggagttggtttcctctgagggctgtctccttggcttgcagatggctgtcttctccctgtgtcttcatgtggtcttccttccaaaactgtgtccaaatttcctcttcttttgaggacaccagtcatattggattagggcctactctaattacctcatttacccttaattacctctttaaagacactatctccaaatatagtcacatacgaggtatactggggctaggacttcggggacacggtttagctcattgcagtatacagtgtatttcatgtcctgtttctttgctgggaatgtgtctaggaaaccctctagtgcttagtccacttggagatataaacatttaagaggagaccatgggaggaaaattgactttctttgcctttgtgtaagcaccttcatcttctcttccattcaaatttcagagtacaaattcagaaatttcttccaaacgacataaacccccttcctttccatctttctgttttgtgaactaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggtgggttttttccttggctgaaggtatattattacaggtttgtgattgggttgagggtatggcagtgggaagtaatttcatgcaagttaattaagagagcaaccacaaggcagccttaggtttatgaaagtcgtagaattatcaaataccgcctggagttagaaggaagcagtttcttcctgtgcattggatgcagacactttaaatgttctctcctctaccgtatgttcttggttcaaagtgtaaacttttctctgtgaagctgttaatcatcaaagatgtgagttggtgaggtggaggcgaattccttttgatttcagaagaaaatatttgcgaatctggccatggaagccctctctgaccttttctccaaattagaggaattaactgaacatgtgctaaggcacatgaagcttctttgtgcggaattagagtgctcatgttgggagtgggcatcttgttaaactcacaggatagatcaactttggatggattttagacagtctatcacatgatagactttcagataatcatttatggtactcctgcatggtccggaatccccaggtttcttggagctttattgtcaaggaaaagtacaagcttagccacagcaatgtagagtttctgctgcttagctctttgcaacacagtcatgttggatgcttgagaaattggtgacctgcccttccaagtcttaaaaattgggggctgggtaggacttggaatgagggggttgtctgttacaaacttcatgtatcaagtaggttcagctttgtccttatttttcagtcaaaggaaagccatagacaccaatgtattccaggagggcttgactccatcctagattcttcccatagcagttcttgaatgcatggctgcacgtgcacctctccccatttttggggtccttcattggggtcaggatgaatgaagacatcaagctcactttgaagagcaagattctgatttggacaggttcatccttctgctcatcacttgttccccttcaattgataccctctcgttgttgggttctgagaatttgaaaccttgctctgaattgaacatgaaaaagggccgtgtagccaacatcagggacagcagtgcttttctcagtgtgagtcttttaaaacttgccttacaggtaagcatctgtctgtctttatcgatagataaggaggctcttttggctataaacctttatagttttcctgttatcactctgaggaattattgctttatgagagagtactctctcaagaggaaaagaaagtcctagtttctggtcatagctacgaattaaatttatattcacgtctgttcagctctctgaagttgttataggtattttggacaagaactaaagttagctaaagtttccacataaccatcaaagctgttatgaaaaagggaagaaggatggaccaggcagtaaggaggtcattaaatcgtccagagcttttcactaaaattggcagttccagtgtccagcctaaatggcttgaatgtatttttctctcttctggtctcagcgaacatgcttgtcagctagtagttataacagattgatgggtgaggcaaaatacgcgaaagttctttttggttacataaatactgcattaggactaagtgcagttgaagttacaatattattaattaatccctcccttttaaatttatatctttgtgaagcataggttagcaaatgcctttaaaaaatatatttcctttaggtcttaatgatctattcttttggatagtctatttcacctgaatggattgttgcttacaaattaaatatgtatcaggggctcccaatcctgaaagtcacctgaatttcctggatctctgctagaaatcaaccttttaagagataaaggagggtttatcctaaaagtactagttacttctgaaattcatgtcattactattgcttttggagatataaataacaacaaaacttttttttcttactactataaaacatcatggacttattggctctatagatacagcccaggtaagatttaacattttaaaaaattctattctgtcatctctaatatgtttcccaattgtttcaggaccaggacgcccctacagggccatagatttctcacatcaaggacctgcatttgttacctggcaccggtaccatttgttgtgtctggaaagagatctccaggtaggtcaaaactatgcatttagttcttttaattttttaaaaaatttattgtatatatttaaggcatacagtgtgaattttgatatacttatcttgatactcatacaagataagtgattagtgcactaaagtaaattaacatactcagcatcacatagagatatctctttttgtgtgtgtgtggtaagagtacctaaggtctactctcttggcaaatcaccagtacacaatacaacgttaactatagtctcagacctcgagttatttatcctacataactgcaactttgcaccttcagcctacatcttcccatttctcccagtcccttgtaactactatgtaactctctatgtattcactctttttcttttttcttcttttctttagattccacatataagtgagatagtgcagtgtttttctttctgtatctgtcttatttcagttggcacaatgtcttctagattcattcacattttgcaaatggcagggtctcctttttaaaggctgaataatactccattgtacacagtatatatatatatatatatatatatatatatatatatatatatatatatatatataaaatatacacacactgatttatgtcacagtttcttcattcatttatccatccagtagtctttgtcttggtagatatttggttcagatacatatcagcctttgccttgtatgctttcttgttgtatctgatggcatggattaaatgactaggcctgccctttgcttttagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgataggtaatggctcctgtacctgcaatggcatccagagattgtcttttctgatgtctgagacatggaggagaagtcactttatagtgctgtttcttatgcatgtggtgtcctatttacatgtttctaaaaacagttttcctctgggaggtgggatttcaaaaattcaaagctctttaattaaaaaaaaaatatcaaaatcacatttgtgaattggttatgcttggccatcattttgagatcaggttagttttatcagattagtgcaaatgtaattgcggtttttgcctttaaaagtaatagcaaaaaccacaatttcttttgcatcaacctaatcaaattaagagtagttcttgcattcaatcaacatttgctaagcaccaatcatatcccatgtgatgtggtactgccgggaatacaaagatgaatgaaataaaacctcccttttgaatattgtcttgtattaacgagatagatttcttgtaagtaaattacagttgagtgtgggaagtactgtaatagatgtatacacaaagacaagaagagagtctgggcaagtccccaagaggcagagatgatggctctgagaaggggaggggcacagacctgaggtgtagaggagggtgaggggagtgtgggagggcagtgggtgggtccttgatggaggaacatcatgtgtgaagctagataattctctggaaacagcctggtatggctgagtcacaggatgctggtgagttgaggaggacaggggcttggggccagccggggaaggatgatctgtgacatactaaagaccatacacaggtcagtggcctggcctgcagcccatgaagagttctgtcctcaaaggctccttgaatttgtttctctgtcctggaacacctggaacacatttcagccaaaaatttcccaagaggctcctcacctcaccttcctttattcatttttttcctccaaaatttgttttgttttttgttttttgtttttttgtttttttgagatggagtctcactctgtcaccaggctggagtgcagtgacgtgatctcggctcactgcaacctccgactccctggttcaagcaattctcctgcctcagcctcctgagtagccgggattacaggcatgcgcaaccacgcccagctaatttttgtatttttagtagagacagggtttcaccatgtttgccaggatggtctcgatctcctgacctcacgtaatctgcctgccttggcctcccaaagtgctgagattacaagtgtaagccacctcacccggcctcaaaatccccatgtttttaaccccactgctctgtctttcgtcccaggtccttagactgctccagggcacagagctgtggctcccccggcccccaggcttcactgccaacaccctgagcctgcataggtgtgcgttttgaggggcccatgcccagctagcagggacttcgtcttccacatcctgtacatttcctacagtgctcagaacagtgctccacgagcagggacatcatcagtgctttttctgtgactgagcttaattccatcaagcgccatttcccaccataccttggaatagtagtggatggtatgtgaaaagagatttccgtcatcaagtaaatttagagaaggctgagtttaaaaggtttttaaatttttagaatgtcgtcaagctttccatagataaatgtggtattctttttcaagaggagcctaaccctggaactcttacttcaccggacatcccattggaatccactttgggaaacgctgcctgggaggccttggagacctttttcagcttagtgtttaggtcctggcctctttcatccctgtggatgtgctgattatattctcacatactgggtcctatccctaattcatgaaaaccctcacaataacatctttaaatttttatctctgccagtgaaataatggtctgcactttgggagaccaaggcagggggatcacttgaggccaggacttcgagaccagcctgagtaacatagtgaaaccctgtctctacaaaaagtttgaaaagttagcctagctgggcacggtggctcacgcctgtaatctcagcactttgggaggccgagacaggtggatcacctgaggtcaggagttcgagaccagcctgaccaacatggtgaccaaccagcctgacagctctgtctctactaaaaatacaaaagttagctgggcttggtggcatgtgcctgtagtcccagctactcaggaggctgaggtaggagaattgcttgaactcaggaggtggaggttgcagtgtgccattgtactccagcctgggctacagagtgagactctgtctcaaaaaaaaaaaaaaaaaaagttagccagtagtcccagctactggggagactgaggcaggaggattgcttgagcccaggagttcaaggctgcagtcagctgtgatcatgccactgcactctagcctgtacaacagagtgagaccctatctctaaattaaaaaagaaaaactaaataaaaagaaagaaagaaatactattctgatgttggaatccaggccatagcaggcgtgtaggatataatgtcttacggacatgggaccttctcagcccatgctgagcacttaactattgatactctactaccttggaacattttccaacacagtgtttcttctaatatctcccctttgtgtactttcatctgcttttactctgacctccccgtttgccttcagtttgcctaaaaggttttcgtaactttacatgtcacttctgccaaaactggcttagctcagcataatacgaaccaccctattctcccttcagttactcaagattcaaatgcacacaataggagtcatcttgccttgtaaaccctctcactgtctttccaacagaatggtaatgattattcatatttatgcccatgtccgtattttgtgcatctacatttttgaaacttctcgacccataatgactttcaggtatagtactttttaccacatattgttaactctggtaaagtaattgtaatacaattttaccatgattgtgaccctgattgatttgcttggcccaaatttataatactgtacataagttaagacatatcattttttgttttgggggattttttttttttcttgagacagggtctcactctgtcactaaggctggagggcagtggcatgatctctgctcactgcagcctctgtctcctgggttcaagcgattctcctgccttagcctcctgagtagctgggacaacaggcacacaccaccaagcctagctaatttttgtatttttagtagagccggggctttgccatagctggtctcaaactcctggcctcaagggatccacctgcctcaacctcccaaagtgctgggattacagacgtgagccactgtgcccagccaacatatattattttaaatcttattacaaatcttagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggtgggtgctctgagctctgctggacctgcctgtacagtacaggttttcatgcctgtgattgtaaagaactggaaggaaacccaggttttgggggttgtctacgaagctaagtgatggagagaggcctaacgagagaagttagcaagggattggtgtgaggaaagtctttacccatctactatgactaacaatgtggttttaataccttctaacttagctgttcaaaaccaacttttgtatttctaattgcagtacattaataggtccagtctttggaaacagggtacttcattaaatatagtgttttttcaatgtccatgctctttctctttcctttcttattttttaaaatgtcgatattagaaatttatcagccatagaacttaatagtgaggtctgagatctcagaggagtattgcagactaaattcaactcaaatcatagcacagcaatgacattacaatacttaacatttaaagaccaactattaatcttccaccacaggttgggcatggtgttcatgcctgtaatcctagtgctttgggaggccagtgcgggaggactgcttgagtccaggagtttgagaccacctgggcaacagagcaagaccctgtctctacaaaaaaatataaaaaagtagccaggtgtggtggtatgtacctgtagaggtaggcctagaatttaagcacatctcaaaatcaccaaagaaaaacacatgtttcatgccctgctcccagagtttctggttcagtaggtgtaggctgtgtcttaacaacttgcatttctaaccaaatcccaaatgatgccagttaaggtggtctgagcactgcattttgagaacaactcccctaactcaaacatatagaaaatgcaatctgttttaatagcacttttgtcacaatgaaaaactaattcatcctccttttcaaaacaaccttaaatgttacccttcccccacctttgacactactctgaaggctgtgtccaacctcagcagactgagccatgctacacttagcacaacctctacatttgagtccagcctgccctgccctgggcccatacaaattgtctactttaaacacagttaagagagagagagaatccagttttggagaagatctttaatctatctaccatcccctttttggacccatctttgtttaaagtcttatttataaacatatttctcataattcttaaagtctttctatggtggtagaaaatttttttcttttttcttttttttagagccaggatctcactgtgtcacctagggtagagtgcagtggcacaatcatggctaattgtaacctcaaactcctgggctcaagtgatcctcctacctcagcctcctgagtagctggaccttcagtcaagctgaaggtctatttggttgagaaatataaatatcagattatatgttaaataaaagaatttactgatcacagacaatctgctgggcatggtactgaaccctggcaataaatatctgaagaaaacatagagcctgctctccaagggaatgagagacagatatgaaagttgtcatacagtacacaaaagagatataattcagaaatagcgttgcttaggagttctctccccttacagaggattatcattaaagtttggggcaaattcttggtcaatttgctatgacagagcttcccatatccctacccaatctcaaattagacaactattatctaggctgaaaacaacaaaaaagagacctttatcagtctttgtctgttgtcactgatatacttgtttctcctaggaatgctttggaagggtttgataaagcagatgggactctggattctcaagtgatgagccttcataatttggttcattccttcctgaacgggacaaacgctttgccacattcagccgccaatgatcccatttttgtggtatgttcaaagattcagaatgcatgaaaattttctagataatatgtcagatttattttttcatacaattaatgtttgatggtgttttattctctgtgtgaacaatgtgatgtgtgcaaatgtaaattaatttcaatctataccatagggatggttaggtagcatttgaaggccctaatcagaacccatgcttcagggatggttcacttttgggtgatcttagacaagagtttacaattccactggtgaattcataaattagcataataataaatgatttttcattggctaagtgagtattgttgaggttcagtagtccacacaaaccaccttcaatgtgttacctgcaggaaagagaggttctgttagccagaaaaggggaggagaatggagagggtgtgctggacacttaaacctcctactccaacttgagtgagctttacttgagaaagaagaaaagcagcacctgacatccaagagctggcctggtgaaatcaaccaggccttggtgttccctgttggacataaacaatctcctagaacatcaacagcagacaaggccactctgatcatggtggatcaggacaaaaacaagactactccataactgtgtctaagcacagacaaattatgaacattttccaagccacaagatgcatgacatcccctttcctggctaataggagcaaaaaatgacaaatgccttcaccgatggcattaatacaaaaactcacatttgaggcaatttaatttgttaatctgattcatacctctgacatgtaataatacagacagtaaataggattgctgttgactgtgcaggagcctcacagttatttaaatttcagtgtgatgaactcctttggtatatcagtttgatttctgtctcactttaaaacaaaagaagaaaactgccaggcatggtggctcatgactgtaatctcagcactttgggaggctgaggtgggaggatcacttgtgcctaggagttcaagaccagcctgggcaacattatgagaccttttctctaccaaaaacctttacaaattagctgggcatggtagcatgcacctgtggttccagctacttgggaggctgtggtgggaggatcacttgagcctgggaggtcgaggctgcagtgagccatgatcgtgccactgcatcccagcctgtgcaacagggtgagaccctgtttcaaaaacaaaaacaaactgaacaaaacttgacaataggattctaaattttacaattctgagcttttttagtgtttgtttatttgtttgtttttggagacagagtcttgctccactgcccaggctggagtgcagtggtgctatctgggctcactgcaacctctgcctcctgggttcaagtgattcttctgcctcagcctcccaagtagctgggactacagttgcacgccaccacgcccggttaatttttatatttttactagagacaaggtttcaccatattggccagactggtctcaaacacctgacctcctgatctgcccacctcagcctcccaaagtcctgggattacaggcgtgaaccactgggcccagtctttagtttttaaagtatattcatcccctggtgaacttttctaagacaaacaaaatggggaaatacgagtcagggctacactgttcagctaccctagtcaatgctcttcagtctgtgacctctaggaacacaatgtagttgaatacattggtctgttactccttgcaggcagagaatggaggactgtggaaagtctcagccagtgggtgttggaaaagacagaaagggtttgggcttgtgctaggtgatttggggaggacttttggaagctttgctctgaatcagatgttgtcaggaagcaggggtatgcttcctgattctatgagtgggtatcttgatagagtgattatgtctgtatatggggcagactagactgaggttaaagccataattggtaaaacagcagcagatgctcatattagccgggaaagggggtgtcacgcatcttgcatcttggacaatgttcataatttgtctgtgctcagacacggttatggggttttcttgtttttgtcctgatccgtcatggtcacagagtggccttgtctgctgtcgatgttctacgaaatcgtttatgtctgatagggggacatcaagtcctcgttgatagcgccaggccagctcttgaatgtcaggggctgcttttctaagtacaggtcactcaagttgtcataagagatttagacaacatacacattcatgtctcagcagccaatccccaaaagtgctcctgctttacagatacgcaactcaccctcgtctattttaaccctgtctgtgtgtcttctgagttgtatgtcttgaatagatagttttggagcaattacaagaagaaatttcacctcttctccttttttattttgccagtattttgagtttatattgttatccagttagattgtgtgatatccaaagactctctgtttttctccagaattttcctcaccttaatgttaatcttagcaatgtgtcttagtctgctcaggctgccataatgaaagaccacagattggatggcttaaacaacagaaatttatatcccacagttctagaggccaggaggtctaagaccaaggtgccagctgatttggttcctggtgaagactctcttcctgagccttctagctgcatcctcatatagtggagggagagagagaataaactctctgatgcctccttttatgataacactaatccagggccctatggttctgacctcattaaaccttaattacctctttctaggctctatctccaagtatagtcacattgtgggttagggcttcaacacacagattttggggaaacacagttcagtccagatatagcatttataatgcattgtcaaaccatcagtttatagaagtttgtttttcttttcttttttctttttgagacggagtctctctctgtcatccaggctgaaatgcagtggtgcaattttgacccactgcaacctccgcctcctgcgttcaagtgattctcctgcctcagcctcccgagtagctgggattacaggcacgtgccactgcgcctggctaatgtttgtattttgagtagagacaaggttttgccatgttggccaggctggtcttgaactcatgacctcaagtgatcctcgggcctcggcctctcaaagtgctgagattataggcgtgagccaatgcacccagccagaagtttgtttttctggactttttggaggcttcatgactgattacaagtcaatcagttttacttgatacagaccagggcaatcttgggaatgtaattgaaccacatggagcttctgcttcccactctgcaaagtgtgggtctcttgacctgatctggtggtgaaaatgttgttctcagtgaagtgactcttagtagattaggacaataggaaactggtctagagcccgtcaagtacaatacaaatgttatcataacaataataatgtgttttataatggtcagaattagagaaccatatgttaggtttagattttcaaaccttaattaatatttcttatcttgttctccaaagcagacagtaatgccctaagacattttactaataagcacaaagtcagaagtatttcacaggtgatttattattgttactcaacccagggtacaaaaaaaggagctatgaagagggagagtaaaggtatagctttcaatgattctaagcttgcctgatgggtgtgaagtagctttctggggctcctagatagattaaagcatagtcaggtgagcttcaagaaatcctgagacggaattagttggtagagttgttctttccttctaaaaaatgtttctttcctcatatttgcatagtagcaataaatgaaggggttgtcagaagtctgaattaatggtcccagcctctaacaaggtgggggcttatctgtgacgccgccacagcgatctttgcttttctctagaatgcctgctttgttcaatgattttaacttgatagttcacatcattttttctggctatcgtctcagccatagcttatgccaagcatttctggtgtctgctttctcagccatgtatctgtacatctatttatactatacgtctctaagtatttattaaagcatacattgtcaactgtacaatttatacacacaattcatattcataaggaaaaatgtcataatactccttatccagtactccaatatgttataagtagaacagtggaatcctctgataaattaaggattataccccaactctttctctcctattaaaaatgatgctagtaatttgattttctgcatcccaagtctccaggattgctaaaccgtatctccttcttttgaacaagcctgctaagtggacagaaattggcaacatttttctgtaaatagccaggtagcaaatattctgggctttggaggccagatgttttctgttgtaactactgaactctgcccctgtatcatgaaatcagccatagatcatgcataaacaaatgaatgtggtgttccaataaaacgttatttacaaaaacaggttgtaggctctatttggccctcaggctttaatttatcaacctgtggtgtaaaggattcacttttcttctttgtattagtttgtagtaaggatagtaggaatctctctctctctctctctctctctctctctaagagacagtctctctctgttgcccaggctgaaatgcagtggcataatcatagctcacggcagcctcaaacttctgggctcaagtgatcctcctgcctcagcctcccaagtagctaggactatagccacataccaccatgctcagctttttaaattttttatttttgtagagatgaggtcttactatgttgcctaggctggtctcagaactcctagcctcaagcaatcctcccaccttggcctcccaaagcactgggtgagtcaccatatctggcctgtagtagggatttccctttagtcatatttctccttctgctttagggtggaagctcacattgtgacttgatgggtgagaaatcccgtggttcagagatataagacatttaatcatctttgtgttcgttgtttctaatgtgcttaatgttaaaattttatttttctttagtagtatgtgtaatatacatataaataaacaaaaagccacagcctttctttaaaggcacagaatgaataatgttttgggcctagttccagaactcaccattactttaggctattttcaaagagttttatgctgaagccaattcagccttaaatgatttttcacatattgagatccaggttaaagtatttcagttaacagagttatagcttctggaatttcaaattcatgaggcaattcatgcaaatatattgcacatgacatttattaaaattttttttgtgaaatctctccaagcaatagagctacaaaattgtatgtgatcacaataatgagcaaaagaaggcagaacattaaagtgcaggaaaaactctgaagcaatctctagtaattcctaaggtaattgaggcaaatgcacacatttatcatggaaaataagattaggccagagaaatgctaagtgctgtcttcaatattaaatttagatataatccagaaaagagaaaaaaaaggaaaccaacagactgtaaagttatttaaatgccaagaaagaaactgtgttacatagtggtaatttccttcccaattcctaaagatactattcttaagagtatacttggatgttatccttttagaaagtacatttggtgagttctacgttccttcaattcatcagtggctggggggtccataggttccataattaatactaaacagctcgtgcctgttttctaccttgtacgttgacattctaaatggaatacaacatacagtagtcttattactaatcagtgtataaaataagttcattaatttagaaaatgtgcagcaggagaaaatgaatttctaaaaccacacatagctgatggactaccataaattaaccctgtaagaaagagcccttctgagtctgctgttctaggctacaacaaagttagtgaaatcaaaagctcacaattacaggtataaataattctgagttagagtgagtttagttgaaatttaaaaaaagaaggataggtgtatcagtctgttttcatgctgctgataaagatgtatctgagactgagtaatttatagagaaaaagaggtttaatggacttacagttctatgtggctggggagacctcacgatcatggtggaaggtgaaaagcacatcttacatggtggcagccaagagagaacttgtgcaggaaaactctcatttataaaaccatcagatctcatgagacttattcactatcataagaacagcatgggaaagacccacccccatgattcaattacatcccttccacaacatgtgggaactgtgggagctacaattcaagatgagatttgggtgggaacacagctaaaccatatcaatagggcattgcttttttcttcccaagagtgaaacatttaaagatagatccattttgctttactttaaataagaaaaatcataattagactaatattgtaaaaaaataaaataacattgttgtatgtgaaatttttatttttattggtttatgatttttatattatttataattacagaaatgttggtgaaaatagtttttaaatgcctgtaattccatctcaatttttttgtttatttcttttcatattctcgtatgttttatacagttgcaattatagtcatccctcaatatcttgagggaattagttccaggaccccccaccatgggtaccaaaatctgtgactactcaagtcccttatataaaatggcattatatttgcatataaggtacgcacatccttctgtatactctaaatcatgtctagattacttataattggattcagaggaccatctctataaggcacctattatgtataatatcccattatcacttaatttatttaatttttaggttgttgcatagttttctaaattttttcatcttaaaatcttagtgcacataaaagattcaaaatataaaatgtataaaatgaagtccgtattatcactaccatcttccagcaaacaatacaatttttttctaattttccagatatattttataaatacacaaacaaatatgtttatatatttatctacatggtagcatattatagacccctctgtccctttgcctttcccccactttttttttaacttattccaaatcatttcagttctgaagggcattcttattctttttttatagctgtatagtattcttttgcatggatttatcctgaaatgtattattttaattttaaatttaagattttaaactattttctgttgatggacatttaggtgatttctaatcgtttgctttacaatgctacaacaaacatccttgaacatgtaaggtaagtaaagagaatagaatccctggcttaaagggtaaaaaaatgcatttgaaatttgataaatgttacagaattgcctctagaagtttggacaatattccctcctaatacctgtgtgtcacctatgtgtcagagccacagttcccccatcattccctctcattatgctctttgtccctgtgtcatcacactttttcatctttgtcaacgtgataggtgaaaaggcattttagcaaattttaatttgcatttctcttcttataagtgaagtctaggccagatgcagtggctcacgcctgtaatcccagcactttgggaggctgaggtgggtgggttacctgaggtcaggagttcaagaccagcctggccaacatggtgaaaccttgtctctactaaaaatacaaaaattagccgggtgtggtgttaggcacctgtagtctcagctgcttgggaggctgaggcaggagaatcacttgaacccgggaggtggaggttgcagtgagccaagatcgtgccatcgcactccagcctgggtgacaagagcgaaactctgtctcaaaaaaaaaagtgaagtccagcatcttttcagacattcaaaaagaaaaaatccatttgcacctccttttctgtgatctgtcttcataacttttgtttgtgatcatgacttctggaaaaagaaaaaaaaaaccctaaatattcaaaaaagtcagaattagggaaagtaattcgtcctctgtgtgagtaacaaaatacaacattttcttttaatattttattttcctggaaaacctaataatctggtcatgtaaagatgtattttgtaggttttattagtttatggaaaatgaatgtgatcactgaaaacatactcaacctctagaacagtacctgacacttagtagatgttctgtacatttttgtgaggagaatgtcctattattgtacatctattctgtgatggcccctatgcgagatgtcttgcaaagctcacctcttaaatgaacaaatctgtatatagtaaactactctccttgttttaaacacagggaaaatacagtttagagaggctaagaaatgtgtcaaggtcacaccaatcagtaaatggctgagcagagatttataagaaaagtttcctattcaaaaatctccccgtgttcaatctttcaactacaattttgccttttgtcagtttagacaattcttaactcagtctcttcacaattgcattcactatagctgaggaaattaagtcccgttagatcatattaataggaattaacactaattggtgaagggcagatctgactaattttgcacagcttttgaaatgatagtcattgctttcattgtgagcatgtatttatgctttttaaatgtcacatttacttattcaatactagtttttaaatagcaggtacacagttactacctcctaagtggcataacatcttgatgagttttataagagctgaggaatcagagagggtggctggacccctctctggttccccagggtggcagtgtttctatggactaggctgggggctggcttgttttctttaatttcacaggtgctaaatgtcacctgaatggattctcttcaactctagaatttataaggataaatgcatactatattgagaagaactaaacctatgaattacatccaattcattctgataaaatatgaatataataacaaaccacaacttacatacaaatctaagatggttctagcattgagttgagcaactctctcctagagttttcatgattgtttagtcaagaatggcctgagaggtagcttagtctctgtctagaatctcttctagcatcaccttggttctttctccaatccgtaatgtcaacttatgatgcatgttgaactggtcacttcttttaaagttgacctagcagagtctttctgtagtcctctgcatctgttcagagtttaattcttgaagaagaagctttttttcctcaagggtttagaatcagcatttctaattctctcgatttttttttgtatgtgtgctgttagagcttgtatacaatgtatattgtgtacatttttacacacatatagtatacaaggctattatacaagtctatgtgggagaatgtgttcctgatataactcctccaaaatgcctgagaaatactttctgttttgcctgcccagggtgctataaaagaatggatagggaaatatagggagagaaaattatagcaccatccttgctgcgccctgcctggaagatgctattattgctccaatatctttttttttctcttccgtggttgtgtcctagtccattcaggctgctaaaacaaaaataccagagactgggtggcctaaacaacatttatttctcacagttctggaggctgagaagttgaagatcaaggcattagcagattcagcgtgtggtgaggaacttcttcctggctcataacggccattttcttgcttgtcctcacgtagctgaaagggaggagctctctgggtctctttggtaagggcactaattccattcatgagaaccccatccttatggcttaattatttcccaaaggccccatttcctattaccatcacactgggagttaggatttcaaaatatgaatttgttcggggtagggcacacacattgagtccataggagattgtttctcatcagtcactgaaatattctctctgtgtagtacccacctccttgtggcagagcttagttaattaaataaaggcttgggtgttgtttaactatttcatgcctattacatatggcctatttagggcagtgtgaaaccagcatcccaattacatttgttttcaaatctttggtagaacaagacaagatatttccctaaaatagcaagcctgatgaaatatattttttaggaatgaccattaggaattctctcatttaaaaagtccaaaccaaccttttaatgtataccttctactttaagttttaaattagagttcccatatggacctgtgtgtgcttttatctgtcatgtggcttttaagtgatcacatttgaattgtcacttagttctgactctcagaggaccagagcaatagcatgtcaccacaataggatccagtctgatgacaaaggatgccttctgggcagtaacacatgaactcaagtggtgaaagctacactgtgctggtctttaatgatgcacacacatctttgcagccggcctcatatttccatggttctttctctagatgcagaaacttttcttatttcatctgtgtggtgggaatccaaatttatagtcatttaagctaaggccctttgatagtaactttatcctccaatgatcttgaaaaaataatgcacactttcttgtattttattttctttatgcctgcaggtgcaatatttgttggttgattactttctcctgcatgggttacatgaaaaatctttaccttgaaagcccatgtaatcacatttttttttccattatggcctctactttgaaatttagtgttgttttttttttccttttctgtacctatcctcattttgttggaacaagacagaataggtttatatgccaaaattcggaacctcatttctgaagtactcagtttctaataccaaaacgtagctatgtagccctcgagcagatgaaaggcaccaatgatacaaatttatttatttattattattattttttttttgagatggagtctcactctgtggtccaggctggagtgcagtggtgcgttcttggctcattgcagcctccacctcccgagttcaagtgactctcctgcctcagcctcccgaatagctgggatcacaggtgcacgccaccacacccagctaatgttttgtatttttagtagagatggggtttcaccatattggctaggctggtctcgaactcctgacctcgggtgatcctcccacctcagtctcacaaagtgctgggattacaggtgtgggccaccatgcccagcccaatgatacactttcatttaacttttgcttttgtttcctaccctcaaatgacatttgaccctttacagagatattaacttgtatttaacatttttaacttgtatttaacaaagatacaattagtttttcaagagcaattcaaggtaccttattgaggaataatgcccacaattttaacaaaactacctattccgtagattgtactacttctctttttagcttgtagatatgttattgcttgtagcattttgttcattggatgctttgcattttctcagcatgtaccagtcttttcaaaaaaacttacattctataatttgggtactctgtatatagttcttactagagctttgttgttgttgttgttgttgttgttgagacagtatctcgctctgtcactcaggctggagtgcagtggcacaatcatagctcactgcagccttgacttccagggctcaaatgatcctcgcatctcagcctcaagtagctgggaccacaggcacacactatcacacctagctaatttttaaatttttgtagaaatggggtctcactctgttgctggggctggtctcgaactcctgggctcatgtgatcctcttgcctcagcttcccaaagtgctgggattacaggcatgagccactgtgtgcagccttactagagcatttattgtatgttttatagccctcctgagagctacaatttcaattcctccttattattttcccctattcttttatctctccagattactaattgccttaggatcttgccttctcctttattatttacatttttcccttggtgaattctgatactttctataagttatttgcctcttacagcactgattctgcatcttccttgtgtcctgatagtctcttgtctctttctgtcatcacaatttgaaccctgacttgaactcagacagtatctaaaagttcatgattggtttaggactcataggtcaaagtatcctctttctgcattgttaagattggagaatatgccttcaaaatcaatttttcttattctagttggtcctgaaggttgtactacagtgtggtggtgtaaagcaggggtccccaacccctgggccatgggcccatgctggtctgtggcctcttaggaactgggccacacagcaggtggatggtaagcaattgagcattatcacttgagctccgcctcctgtcagatcagcagcattagattctcataagagtgcaaaccctatcatgaactgcacctgagagggccctaggttgcacactccttatgagaatctaactaatgtctgataatccaaggtggaacaatttcatcctgaaaccatctcccttcccatccaccaccccctggtccgtgaaaattgtcttcctcgaaaaccagtccctggtgccaaaaaggttggggaccggtggtgtagaggaagtagagtatgtggattaggaactctcactttagaaccagacttcctgggttcaaattcttactctaccatatattagctgtgtgaccttaggcaagtcacttaacacttttgtgccttttattccccatctgtaaaacagggtaataatgttatgggttgaattgtcccccacaaaattcatatgtcaaagtcctaatagctaataactcagaatgtcaccttgtttggaaataggatagctgcagatatagtttattaacataaaatgtcatactggagtagagtaggtccctaatctagtgtgagtggtgtccctataaaaagggaaaatttggacataggcacctgcacacagggagaacactgcatgaggatgaagatagagatctacaaggcaaggaatgccaaagattgtcagcaaggcccgagaaggtaggagtgaggtctggaacagattttccctcacagtgcttagaaggaaccagccccactgacatcttggtgttggacttccagctgcctagaagcgagacactgtctccaaccgtaagacaaatgcctgttgtctaagccacccagtctgtagtactttgttacagcagcctgagcaaacaaataatatccaccaaatcaggctgctttgaggattcaatatgtcattttgggtaattgagcaaacactaataaatactcactaatttacttatcaaaaagtgctaggcatgtgccacatgcattcctaaatgcccagctcctcattggctatatgtacagtgtgtgtgatttcagaggtgcttgcaggccccacccacctgcaaaatgcgaattccatcattcttcttccataagtccttgtcccaagttaaaataataatagtactgatggtatagtcatagtgataacaaccattgaataaccatttcctacaagaaaggtgctgtgtactaggtacctaatatatattatcttccctaccttctcagtgccatgttattggtgtccactgttgaggtttacagacctctgtgatcctggatcatcagctccacaggctgtgttttattcatctcaagctgcgtcactatccccgtttcaccacctctgccttctcattctctgtctggatctcttagctaccctcccacccagggggcagcagtgtggaggagaagtctcaggcctgacattccatctgttctccttcctggaacccagagggggccaggaaaagggggtggcatctctagccccccaacactgaggaagaatggggctcttcccatttcaccccgcccccccacagtttctcccctgcctccaggaatgggccacttctgcatggggcagcgggtcccaattcagctcacactgagaatgtaagaactacaaacaaaatttctattaaattttgtgtctcaacagaaaagagaaagcgaccaaggaactcccttccctgcatgtgctggtaaccatgagcctgggaggctctactcaggtttttttcctttgttgtgtttatccatttctgcataacagattacgattacccaaacactcagtggcttgaaggtgaccatttcatttcttaccatttctgtgggtcaggaattttggaagggcttgactaggcagttctagcctagcatctttcagtgcagctgcagtcagatggtgataggtgttggaacagctgtggactggcccgctatctgtttttcttcctgaaatcttgagcctcgccatcatggtcactctatatgagttggtttgggcttcttcacagcatggctgcctcaggacagctggactgcttatttgatggttcagggctcaggcacaagataggaactgcaatacactttatgatttaaccttgaaagtcacaaaatgtcacttctgttgcattttattggttataaaagagtcagaaactcaccaagtttcaagggaaggccagatgaagccaaccttcaatgagggagtggcaagattctagaaaagcatgttagtcaagaaacaaacattgtgtggccttctttggaaaatatatttttgtatatccctagacactgtttatttgcacaaactgtttatgtaaataaagatgcatgacactgtcatcagccaacacatacttagtaaatattgactctgtccaggttgtatgctaagctttgcactgtatgcaaagtgtctgcatgacactgtcatcagcaaacacatagttagtaaacattgactctgtccaggttgtatactaaacctgagacttcaaaggtgaaaagtccttatcttagaccttaaggagttaggatcttgttaggggacatagatacataaataacaagttatagtatcatttgatcagtgctataaatgaggtacaaggtacagtggtgaatggaggaatgaatacactgaataagtatttactgaaataagtacctccctttctccatatgagacaccctggggtgacaagctctggggatccagggggaatgaaaaaaggacactgcccctgagctccttgaacttaccatccaggaaggaacaaggaactccaacaactgccatcaaggtgggactgaactctcaaacttgtatcatgttacaaaatcagggctatcaatgtggaaattttgctgttaatatttcaaaacatatagtaattgctatattttaaaaggactttaatggcttccttgagaaaacataaatgagcactttgtacattacctttttagactttcttttgctggcataacagcaagaattcaagtgagagtttatgaaatgagtagacagaagagtattcctggtgagaaaaatttactgttcctttatattataatattgatacagattgagtatcacttatctgaaatgcttgggaccagaagtgtttgggattttgaattttttcagatttcggaatacttgcattataccagttgagaatcccaaatccaaaaaattcaaaaatgctccaatgagcatttccttcaagtgtcatgttggcactcaagaagtttcaggtttagggggattttaggttttaaattttcagatttcagatactcaacctgtaaacacaactttttctttctctcctgttaaaccaaatcatctcaatactagaacatgtatcttatcatacttgcctttttctgaatttcataattaacacatatatgttgaaggcctcaaatgttcaatctgcaaccaatgttaaatccaacatgaactttcatttgctcacttgacaaaggggtttatagtcctgcttggagagagagattcatacatcgttgaaaacttaactgtttttcttcccgaaatcttgatcctcgccatcatagtcactctatatgagttgatttgggcttcctcatggtggtacacagaagggggtattccacacatgggtatacagaagttcctatgtcaagaagaagttattccactttagagaaagcaacagtcaggttggtgtgatcggaacagactgatttatgttaaatgctgtgtccaactgttttgcaggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccaggtaactaacacaacttccaaatgggtgattcattcatcttctaaagaagctagctttcttgctttctttctttataatgtaaaccaagacctttagccgaagctttcaggtctagttaagtttattgaccatttttctagcatatacgtatttagcaaaatgagcctttaaactaccaattaaacatcagaaagggactaatgagctgactcttgttttagaaaactgaaagttttaaatagatcttattaaatgaactatctgcttttacacctgacttgacaattctctctgagtttattggattaataaaaaacctccctatggttctttgaaatttctaaccaatgaaataaaaatgaactagccacactgtacagggactagctggatttagagattattccttgagggcagggctgggattagggtgaggaaagtacaacatttgccttgagcacaaaattcaagaggaggccagaaaactcagtaatcaaggtaagtaataatataatacaaaattttggaaagtcaaaattaatgcaaaaaattaaccatgaataatacatcatcaaaattttaaataaaggcagacttttgtttgtttttcatacccacatcgtcttataactgaatcagtcatttcccatttagcctataccacctgcgatggataggttcatgaaggctgacattgattggtctaccaacagattgggctacgtgggactctatgtgtatgttgcattagttactgtttttaaagtcatgttttaagattgtagatttcttattaacttttcccacttggttcaacatatgggaggatattttgacaagtatatacagggcacatgtttttctttttggcccaggccccaatatggctccacacaccatttaaagaatgttaggagcctggcaacatactgagacctatctctgctaaaattcaaataatattagctgggcatagtggtgcatgcctgtagtctcagccactcgggaggctgaggtggaagaatcgcttgagcccaggatgtagaggctacagtgagccctgtttgtgccactgcactccagtctgggcaacagagtgagaccctgtttcaaaaaaacccaaaaaaacaaaaacaaaacaatttaaaaaatcttaatcaagaaggtgaaaaatcacacagcctatttacccaaagtctcagcctagaaagcaatcaagatgatttcagagctcagtctctctctctttgacctgagtctttcaagcctggctgtagtgggacgcttgggcagagaattacctcgaattaagttcaaatttatgaaagagcctaggtacagagggccttagatgccaggcagaaaccccaataagataccacctcatacccattgggatgactgctatcaaaaaaaaatagaaaatagtaagtgttgctgagggtgtagagaaattggaatccttgtgcattgctggtgggaatgtaaaatggtgcagccactatggaaaacagtatggggattcctcaaaaaaatggaacaaataattaccatatgacccagcaattatacttctggtatacctaaaagaactgaaagcaaggtccagcagagatatttgcacacccatgttcatagcagcattacttacaatagccaaaaggtagatgcaaaccaagtgtctgttagtggatgaatgaataaacaaaatgtggtacatacatacagtggaatattattcagcctcaaaaaggaaggagattctgatacatgccacaacatggatgaactttgaggacactaagctaagtttaataagccagacataagaacaaatactgcatgactccacttagactatgagatagtcaaattcatagagacccctggttaccaggggttgggaggggagaatagggagttactgtttggtgggcacaatgtatcagttttgcaagatataaaggttctgagaatggatggtggcgatggtcgcacaacaatgtgaatgtacttaatgccactgcactgcctatttaaaaatggtcaaggtggtcaaatttatgttacatatatgttacaacaatttctaaaacataattttttaaaaaactaagaggatttggacaaaagcaaaaggcaaccattttttggtcttgaacaaagaaatggcagaataaaaatatatgtgttttaagaagatgaagttggcaataggtgctgctgggttgaatcaggaggagacagatcaaaaccctcttggaggaatcccatcaggacaggtcaggacctcccatgggattgcagaaaaaggactagaaagagaatcttatattaggtgagtgtaaggtatagaacaaattcagaggagctgaatttaagaacagttggccaaggagaatataatttttaaaataaatgaaaaataggcatatgtatattaaaaatgaaattcggccaggtgcagtagctcacacctgtaatcccagcactttgggaggccgaggcaggtggattccctgcagtcaggagtttcagaccagcctggccaacatggcgaaaccctgtctctactaaaaatacaaaatttatctgagcatggtgatgggtgcctgtaatcccagctactcgggaggctgaggcaggagaatcgcttgaactcaggaggcagaggttgcagtgagccgagatcatgccactgtactccagcctgggcgacagagcgagactttatctaaaaaaaaaaaaaaaaaaaaaaaccaaaaaatgaaatccactaattttgtggaagagagcttataaaatatatgagagtagaagattggatttatcatgtgggagatttacattttattcacaactatttgaatgggtataaatatcatctgcttggttattgagtgtctcctggtgtaatagccagtctgatccctctcacaggtttatcattctataaaaaaggtagagacaatagcagaatttctcttcccaagggctgtatattttgcagctccccagatgccattttagcatgcactttcacaaatgagtttctaactcagaaaagtagttacattcttccttagaaggtttcttcggcataagcatttattgtaacaaatttttaaaatgcaataagctgtatttaagtaatgggatgccagttctgactaccccaagaaaaacaattgtggatatgataaatggtgagaaaggagaagataaattttagtctagcatgagtagttttgctttatcaacaaaaagcacgtgaaaggcaagtgcgcttgctctttttctcttctgaaagtattcagctgatgaaaatcctgattgtagacccttctcttctgctttagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaacaaaaaaaatcccaaaacattgatccaggggagtcatttaaatttgcaggtcagtgcaatgtgagacctggccaagaccatacatcaatctttcttagccccagtgtctttattggtaatgccatggaggtgggagttggtaggtgctagatgagtctccaagatcccttttagctataaacatctctgcttctaggcaccctcctgattatcttccttgggcttctttttcttcttttctctatatttttcctctccagcttagaagatgagaataagccttgttttctttacaggatggaaaatgactaaatgaaggatcaattccactctattgtgtaaactagattttacggattttacttaaaatctgcagttttaaacagtagacctatattacaggattcaatagctggatacacattgattctatagtgataaatagagaagataataaaattatagagtttcctggttagttgatatgctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaaaaggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatga

SEQ ID NO: 12016 - DNA, 35966 bp, Human
  misc_feature (1)...(35966): n = A,T,C or G
gcccaggttcttgacattttgaacaaagaattggacaaaacgtacaaagcaaggaaacaatgaagcaacaaaagcacagatttattgtacatcaaagaacactccttccggtaggaagggcccaagcaagcagcaattacagaattttctggggtttaaataccttctagaggtttcccattggttacctggtgtacaccctatgtaaatgaagtagtggccagcgatcagtctgattggttgcaggaggggaccaatcagaggctgaagtaaagttatgaagttataccccatgcaactaaagacttggcctgccaccagcctgactgattgcccgcggggaccagtcagaggtactttcaattttttatctgccacccagaagagggattagcttctggtccttttgttacttgggctagaaagttggggttttccttttgatttagttctaggaagtcagcctaaatcggccttaggttccctgtctccagaccctattttcctgcctcgtagcttttaggagattaatgcctgcctgcagacaacttcctcatttaactttcacaacacccctgaggcagcaagatcctggcgaggcagagagcctctcaagcttttttggatgaatattttccaagtctgagtttacataggtaaagaaatgtaagcagtttttttttgttttttttttttgttttgttttgttttgttttaacagaagtggctgctggagtggagatgggaatgggtaggactttagccgctccagtagccattaacgccccaccctggttatccttaaaaaattcgattaaaaaaaaagttcttaatatataaacatgacctcagccatcctatatatacatcaacataagaaaaaggtcccgtgctttttatgggaacagcttcaagacaggtatcccagcccccggcccctccccagcccccttgcaatcagatccttgtcttctaaaacctgccacacctaagagcgctgcctgaaggccggtttggcctgttgactcctggttttgactgttggtgatttaagcgattggaactggaagcaccatttgacaacattttgtaaatcattacttctgaggttgttatgacgacggggtgtggcagtccggcttcacctgtggcagcagcttaggtccctgccctcctgcagagcacacttcaccgacagcaggactcaggttttatacaagtctctactcgccattgcttacgtccaagaacccaacctaccaggtttaaacaatttccagtcacatacctgagccaccaccaccttatcctgaagggatttttgggtataatgcaaatcgattgaccgaacatttatttacttattcaagacacaaactaagagatggggtgtaactgattatctaatttgttaatttagtcaataatatgccagcattgtgcaggggaattacagggaataggaaaaagttaaatttgtgtaaatcatcagattgagtcattttcctactttaaaacttccattttcttccgatattaaaataaaaaccagacaacaagcacctgggggggggaaatcccctcttaaaattacaatttctatttttaattttgtcttcagttataaaatttattttaaagttatacaaaaatgaagtggttggattgtggaattacgtcttttaaaatgttatttgtccaatgaacaaaaaccactcgcaccgcaactccttttactatcaaattctgcaccgttgcaaaacttccttcactcaacgcttctttacaaacatcgcgatagcggagcggtctcttgggcgcaccccgtcgcatgttcaaccccacccacttcctgtctgacgatctccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggtaagggccggaaagcggctgccaagccttggcctccgccacgcaggcgacagaggctgggaaaggagctgggcccggaatggcctgcgtctgatgcggccggcctctttttctgggctgcgaggagagcctttcccctcgcaaagtgcactgtgtatctttgcctccttgtttttaggatatcgggcctcagtacccgcccacaggaacatatttgttggggcataaaagccacgcagttagtggataggacaagaattgtattagctgtttgtaatagatcgaaattgaagcgacaagcgggtgcagtttatttgttctcctagatagggttgccatatttagcagaaattaaaaataatatccagttaaaatagaatttaagataacgaataatttttagtgtgtgtccaatgcaatatttgggacatccttacagcaaaacaacaacgaaatcactcattgaaagttcaaatttaactgtgtcctgtattttatctggcaaccctattcgaagagagttcctaaatttcagtcgttcaaataccacattcacaatttttgccctgtgcctgtgctagttgcataataatttcttaaggcttttcttagaagaacctcactttttaaacttaaaaacatgtattaaattaaaaattattttgttaaaagagtgagatccagtatcttgaataaaaagtagtcagaaagcaaaatgaaggcaaagcatttcgatttaatattaataaattctgacttgatacttttatctaccaagtcactgagcccctaaaaggggcttagcaagtgttgagtactgaagacgtagcagcaaactgagaatttctttttttattcattcaacaaatcaccttttgagccacttccatatgccagcactgttcttggcctggagaatacagctgtgaatagaacaaataaaaatctctgctctcatggaactcaagtagggagagatggacaataaacaacataaattaagcaaggtgaacaatatgttagagagtaataagtatgatggagaaaaattagggatgaagaattgagggaagtttttattttattttatttgagatggagttttgctcttgttacccaggctggagtgcaatgacacgatctcgactcactgcaacctctgcctccctggttcaagcgattctcctgcctcagcctcccgaatagctgggattaggggcacccgccaccacacccagttaatttttgttttgttagtagagacagggtttcaccatgttggccaggctggtctcaaactcctaacctcaggtgatccgcctgcctcggcctcccaaagtgctgggattataggcgttagccactgcacctggccgaagttgtcattttaaataaaataagcaaggcctcactgagaaggtgacatctgagcaaaaaactgaagatgagggagcaaatcacgtggatacctgggagaagaatcttctaggcagagtgaagagcaattggaaaggccctgaggtggaaagtgtgttcggggaataggagggaaatcgttgtgactgaagtcgagtgagcaaggatgggagggaaattagggcaaaagcccaaggggtggccagattttataggccttatcatgggtttttaatcttaccgagatgggtagccattggaaggtttgaggagtcaagtgacagttttacttagattataaaaagatcactgtggctgataacattgaaagtgaagagtgttaagtggtattgcaataattatagtattgtgaaaagtgaaagtggtgagacgtgattggattctagttatacgttaacaaaaattgagttacattttaagtaaaatttaacagtggaagtggtgagaaatgattgggttctagttatattttaagatagggccaattggatttggtgacaggttgaatgcagagtgtaaggtaaagagaggggccaatgatgactccaattattttgacttgagtacttgaaagatagactcctgattttcttttatttcctcctttccttcttcctcccctcccctcgcttcccctcctttggtgtggtcttgccctgttgccaggctagaatacagtgatgcaattgcatctcactgcagcctgcctcccaggctcaagccatcctcccaccttagcctcttgagtagctggatccacaggtgtttgccactatgcgtggctaattttgtatattttttgtagagacagggtctcactatattttccaggctggtcttgatctcctgggctcaattgatcctcctgccttggcttcccaaagtgctgggattacagaagtgagccttggttttaagcatgttaggtttttacatgcctattaatatccaagtagaggtgttgaataggtaattggatatgtaagttcagaattagggtctccccggactggagctgtaaatgtaggtggtatttaatgccagagactatgtgttgatggaaaggactgagccctgagcatgcaaatattatgaaactggggagatgggaaggaataagcagagactgagaaggaatgcctactgaggtaggagaaaaaaacaaaagagaatgatatcctggaagccaagtgaagaaggtattcagtgggagggaatgatcagctgtgttatactgtttaagtaaatgaaggtctttggtgaacttgaaaagaacagttttaggagtgttaggagtgaaagcctaattggtataggttcaaggagaatgggaggtgaggagagtgggttaagataactggaagtttttagaaagggaagtcatggggtggtagctgaaattagaagagggtgtgagtgtttaacatttttaattttctttttgtgaaaagaattagagcatgtttttaagttgacagaagtggtctagtggaaaggaggaaaattggtaaatcgggacagaggatagaattgctggagtgatttttaagcaagaaagaatggaatctattgcccagtgggaaataatttagtcttagctaggagcacaattcatccctagtaacaggcgtgatggcaaaatatatgagcaccaacttcagagggtgtggtgggaacttgggaaggtcttttggttgtgtctgttttcagagtgaagtaggaagaaaggtcatcagctaagagtgaatgtagagacagaagacatgaaatactctagtgaataagcaagagaaatgttgaattactgggtaccatttaggacccacttggagttagtggtcatgaatttaaagtgagaccagtcaccatggctgtgtgtttttctccagccaaatccgaaacattgaaaggaatgggaagggagagtcctgctatttgcctgatgatgttattatttaaatatgatgttttgtattgtactttgagaaacacacccctaaaggaagctctgtcctcaaatcccagagagagaacagggtatgtcacaaagtaagtacttaggacaggtcatcagataaggtttgaactccctctattttcctgacttttgcttcttaaccttgtcaaatttctctgcttcttccttgctttcttgtgcaacagaggcttactgagtgaggactaagagtccactctcatgctgagcacagcagtgaatgggatacagctcctgtccttcaaggagctcacaactcacaactaagtaggagaaaacagattcgacataattttcttttttttttttttttttttttttttgagacagagtcttgctctggcacccaggctacagtgcagtggtgtgatcttggctcactgcagcctccgcctcccaggttcacgccattctcctgcctcaggcctccaagtagctgggactacaggcgcccgccaccatgcccagctaatttcttgtattttttagtagagacggggtttcaccatgttagccaggatggtctcaatctcctgacctcgtgatccgccagcttcggcctcccaaagtgctgggattataggcgttagccactgtgcctggccgactcgacataattttcatactgtgtggtgagatttgtgattgggcatggaaagccagaatctctggggtaggaattcccaagaggaagaagagggaaaagtgtttcagccatagaaagcaacatgtgccaaggtggtgaagcctgaagaaacacatgcagttttttgggggtttttttgtttgtttgtttgtttttttgatggagtctcattctgtcacccaggctggagtgcagtggtgtgatctcatctcactgcaacctccgcttcccaggttcaagtgattctcctgtctcagcctcccaagtagctgagactacaggcatgtgccaccacgcctagctaacacatgcagttttaatgaaagagaagtagttggatgtgcctggagttgaagggacctgtgaaagggtggcagaacaagaggttggaagggtgggatttgccatatgtcgaagagccttgtggaccatgctagtttatcctgttggcagtgggaggctgttgaacacttgaagccagtgtgtgccatgaccagattaatttaaaaaaggaaattgtgtaggatgagaaagaaagctccataaaacaggcactttctttgtatattttgtttgctgcagtacccatagtgccttgcatccagtttgttggatgaatgaatagatgaattggaacagagttgagtctgtgcactagttttgtggctattggagtaattggagggaggaaagatgcaggcctgaatagaagaactgaaatgacagagaagtgacggtttcagagagattttggaagcgggattgacaggatgtggtggccacttggaggtgaggtaggaggaggagtagaggagggtgacactgaggttcatgaggatgggaataaaggaagaggcggtctggggaggttagagtgatatgttttgtatgaggtgcctgtgagacatagaggtgttctgagacagattggaatatgtgcctgaggtcaagagagtccggagatgggtgctgagatttcagatgtggaagttgttgactggtgggtagaggggtagttggtgaagccttggaagtaaatgcaattgcccaagaaaagggtgatgcgaagtggaatgggaggacctaatctgactctttttactttcatctcccactactcttcatcaccccacacaccctgatgactctccctagacagaattagtcactgcctcctctgtgggctgacataacattttgtacccacaactgctgcagcacttgagttctgctgagcttgtttgcacattcaccaccttccttgggctctgaccactcagtgtgctgttcatctttgtattgctgacacctaacccccgccttgacccagtgtactcagtactgaccagattcttgaatcctgtgctatgatatccatgtggaagttaggcattggtacccacacagggaatgtattaaactgctttttaaatcaagagtgatcatcttctctaatcacaggtaacatcctcaagcaaatcagaatgagagcacccattcaggaaacctgaacagggaaggtgaacccctgtcctgaccaaaattgggtatgtttagagggcttttcttgtattccttctgctctaagtcctattattctgatcctgaaggtgcagacagcggcatgtaaggaaaattgatcagtgaagtagcaactaatggcatctagcatgacttacgaagccatataagatgtgtgattgaaagtcaaaagcttggtacctagaacccctgaaaatctaaaaaataaaacacctagcctgtcttttaagactgttcatccctacagtgtattatcatcttcttgtgattatcttacgattacaagcgtaaattgaagaaaagattgctgtatgaaatctcactgtcagtgagtcatctcagcatttttaccttattttcaaagacccaaccagaaaagaggaaactcttttgcacttttcaatcaagaaacttaaacataaagcagtagagggcttccctaataacatgtttcctccagcattcaaaattagtgacttcacatcactaatatgtgtcttacttattttgagtataaatgattgggcaaagaatccttgggaaaaaatagcctatttatttcaaatactgtatagtggattctctgtgcctgtgactcacctccttccctccatcactgttctcatactcaggatgcaaaggttcagtctctgtcttcaaaagtgagctcccagtctagctggagggagtgatgagtgaacaaataattacagcgtaatcctttggtaaaccagagcaggcagtaattaactctgcctagagatgaagtggcgctggagagagttcaaggaggcttcacagagaaggtggcagtggaaagctgaatcacctggtaggcaaggcgggaggaggggatgtcagatcagtgagggtcttttgtgctgagcagatgagtttggatcataggaaggtgtgagaaaattttttgccttttttttttcgtaaacagtttttcatgaaaaaaggtcatcaaagtaaaatgtattaagttttttttaagcctgctgactgatttttattaactttgcctagaatgcctttaagcttggagcctgtatgatcctgggtactcagtcttggggttagaatataacttgagggcaagctctcagcctagatcatcatttcagttatagtacttacctctgagtagctactccataaacatttgttgattgaatgagtgagtgaatgaatgcagcatcaaatacagtatctgaaataaagacttcaattttttttggaaggactttttaaaaaagacattagacagttttatatgttctgactttgttggattttggtaaaagatttcagaattggattttttttctcatgtttttcatcttgttcaggagatgaaaatgcctagaggtgataaatataggctcctatgaaatacagctgtattagacgtaaaataatgggatctgttattttgggtattacatcatatgctatcttgctgctagattttagcattacatagctatggtaggcattgtcagtttatagaaaattttgtggggagaaaaaaacatgccttagaaaaagatgagtggtaacaacagaactctttgtcccagcttgtggaatgagaatagtggagctaatgaaaatcaacatgttgaagtaatatactcttaagaaagtaccttccacctttttttaaggttgtggcaatataacaacagagaacactggtggccagggtcctaagggaaggtttgatgctgcttgtaagttctgataccttccaaaattcataatactgagagtatattgaaagacaggccgggcgatgtggctaacccctgtcatcccagcactttgggaggctgaggcgggcagatcacctgaggtcaggagttcaagaccagcctggccaacatggcgaaaccctgtctctactaaaaatacaaaaattagtcaggtgtggtggcacgtgcttatagtcccagttactcgggaggctgagaggctggagaatcagttgaacccgggagttggaagttgcagtgagccgagatcaccccactgcactccagcctgggcaatagagcaagactctgtctcaaaaaaaaaaaaaaaaggaaagaaagataacagcagtggcccggcgcagtggctcacgcctgtaatcccaacactttgggagaccaaggcaggtggatcgcttgaactcaggagtttgagaccaacctgggcaacatggtgaaaccctgtatctgccaaaaatacaaaaattagccgggcgtggtggcacacacctgtagtggtcccagctactcaagaggctgaggcaggagaatcgcttgaacccaggaaacagaggttgcagtgagccgagattgtgccactgcactccagcctgggcaacagctagactctgtctcaaaaataaataaataaacaaacaaacaatatattggacaggtcaaacatactggacagctactcaggaggctgaggtgagaagatcacctgagcccaggaggcagaggttgctgtgagccaagatcacaccactgcactccagcctgggtgacagagagagacccccatctcaaaaggaaagatagcagctaagctgggatctaactaaattgcagtaagtctgagatagtgatatcataagagattggctgaagaagtatggctttctgtagacaggggtgttctggtcactaggaggaggcttctgaagcaatggagagcaaaacaccaccactcttaggaaccccctgtgaacatcttgaaacatttgtcaaaacaaacaaacaaacaacaccccagcaagaagggaaaaaaaaaatctatgatgatcaggtatcacagcactgagaaagttatactgtgtctggctttaataaaaccatgtaactttgaattattttttaaagtaattattccacatctgtgggtggtacctggcacagctcagttccagtggaattagtttaagaaatactgccctgtagtgaattacccaggctctccaaggctgagaaacatggatggcacagctctcaggacatttcaccaccatttactgtcattgtatgctgaagctgccttgtgattactaaactagctttccagaagccttggaatggggcatgggttacagagtaccctgagtattaggtgttattgttccagtcattggaactgtatatttcctgttacatctaatttgttggcattctagaattaatgtgtttaaattgcatgagtcaatttcttggagtcctgactgctcttagatgaactaatagtgtctgacctcagagcccttcctttccatctgcaacagttttttaaggtaattgtttttaacttttaaaaaatataagtaattctaacaattgttcaatcccagccatctaacaaatcagctacgtttatcttttcatttaattaaaatagctttttagctattaaatagcagggaccatattttagacttgttaaacaacctacaatctaaatattgaccatctgggccaaatattttaagcgagggcttactcagggcagacaggtatctgataatatacacattcaaccacttcgcacctgaccagtgtggtaggaattcagagctagagaagtcctgaagaagtggcaccttaggcttgctgggggaaaggatttagacacaggcctggaagagcaggggagggcatttattcattggagtgtgggaagagcagggatcgaacagatgtgaagaagcacacacaagttaggtggaggtggggactgagagatgagcgtgactgtacaaatccacagattcatgctgtttgttcttatcctgcctattcagagaggagttggggtggcatgtagtaaatgtcatctattaaatgtgtgggttcttatgctgagacatcagcaccccaatcagtaaccataagtggaaggatgccccccttctttcccttgagaaagattacttctgatagaggagattgaggtccagatacagtcttaagatttattttttatttttcacaaatgtaggtttcagagggaactgaaattagtaatatattgtgtattttattcattcagctaggtcattaggttgtaatttgttttctaccctggaggagccccatcctctagctggagaaacacaatgacaattgcagtgatggagtctcacccagaataccaaccatgcagaaaggaggactagctaatccagcttagaggtgtcaggatctggaaaggcttcacacaggaggttcatctaaacagaaccttgaggattgagtaagagttggtcaggtgaggagaggaggcgcttcaggaaatgggaaagcatatgcaaagtcatatttgcaagagaacatggcatgattggagtttggtcctgcaggagggtaggctacctaaaggaaagccaaggccagagaggcatacacagggatcagatcttcttgtgtcttgcagaccatgttaaagagtttggagtttgtcatgaagcttgttcaggtcttagctcagatgtcactaacttcccattgcacttagaatagaattcagacctcttaccatggccacaaggccctatgtgatctggccccggactgcccatgtggccacacccatcttgagccactcctccattgcttgcccttgctatagccagttagccgatagagagctgtcaaaagattgtaagcagtgttatttcatattcagtctggccacagtatggagcatggattgaagagagcaaggccagcatcagaaaggcaagagatgataagaggctggtcttgagcatggaggtgggaatggagagaaaaggacaaatatgaaaaatgtagaagcaaatgcagaaggatttggtggccactgaggtttggcagaggagggacttctgtcagtgagtggatggtgtgttcataccctgaggtctgggatacaggaggaagctcaatttggtgggaaagatgattagttcatttaggaaatatgttgactttgaggtgtttgtggaatgtcccaagtggagatgtctggagagttcttgaatagtctctggagctcatggaggtatgggccaaacattggtataaatgggaaaagataacttgaatgttgtggtactaggttgatttcatctccaaaatatttctcgaaacaaccactacttttcactcctctgccatcacctcggggcaagctgctatatcttttaactagtctgcctgcttctgcttcagcccattcttacacagctagtggagtgatcttctaaaaatgagaaggagtcttataattttcctacttaaaaccaatcttcactaacttcccattgcccttagaatagaattcagtcttcttaccataactacaaagccctgtatgacctggccctggactccctgtctggccacacccatgttgagccacttctccatcacttgctcatgctgtagccatactgtatggcttcttctagggcctcaaacttctgtattgttgtgtgtcaagttctttctctctttcaggtctttgcatatgctactccctttgcatgaattgtcatcttttaggtcttacctcagatgtcattttttcaagggagtctcctctgacctcctgggctatattagtgccatcctgcattttttcctagcacctaacacaatatgttagtagttaattgtgcgtttgtatcacccatacaagctctgtgacgacaaaatccattctgtgttttgtttaccattgtacccacagttcctgacagtcctgagctcatagtcagcactccatgaatattttttagatttgttgaatgaatgagattataatcatttttattttttgtcttgaaaaacttagaaattttacactgtcacagtacaaatagaatggtgactcaagtgatagaacttatggagctgatttcatctacttttacattttcaactgttattaaatgctctgcctctggaaggttgagacatggaaattgcaaattaaatcttaaaaggaatttttcctccctattggctgtattcattatggtagttctggttagcatgaattgatctgttatcagtctgacaatggtacggctgctgagtttgaaattcagaaaactaatacttgttcccttgagtttgggcgtttgtggcagagtttagtagcagccttctccttcagccctgatttgggaagcatcccaatacatgctatttgcattgcagctgtgggaaagtccacgtttgtgaagttactcacgaaaacttacccagaatggcacgtagctacagaacctgtagcaacatggcagaatatccaggctgctggcacccaaaaagtaagtttttagttgtggtgggtagttggcaggcatgggtgaataatctaattgtcataatttaatttactctcagtgagtaaagtagcccagtttgagtatcctttttaaaatagcttcattccagaaagcagaccacatacaccagagaggatatgacttgtttgaatatgtgcagttttgatttttgtggtttttatatgtctatctaagtgactgcctctgttgtttgtggtttcccaaagcatgtccaaccatcatggatggctttgaagatgaattttgtcattcctacacttaagtatttatattattacttaagctaaccactaggattaatagctaattatagtgattttaactttttaaataaagtcttagaaattagaagggatattagagaggttccagtcacactttgagtcaatgggagaggttacagctaacatttatgagcatgtactatgtgccaggcactgtactatgccaagcacagtacatttcacttacacctcatggcttaggccctggtgtcaagactatggctttggcagaggccatagagttggtttccagccacatcagtctgagtaaggaaagacttgtttcgacatgacccttagagggagcagaagcaccatgcctcctcaggcaccatgaactgctcctgccgccacctgggatattcactgagtggcacattctggttcttaactctaattactaaacagttctgccttttaatgagccatgttgcacccctgtgactctgactcattggttcaagttctacctcttaagtcttttaacttttcgccgtaacaaccctatatatagttgaaggtaatgattttcctgttctttctccccctcaagtctctctccttttttttttttttttgacagtctcattctgtcacccaggctggggtgcaatggtgtgatctcggcccactgtaacctccaactcctgggttcaagtgattctcatgcctcagcctcctgagtagctgggactatgggtgcatgccaccatgctgggatactttttgtatctttagtagagacagggtttcgccatgttggccaggctggtctcaaactcctgggctcaagtgatccacccaccttggcctccaaagtgctgggattataggcatgagccaccatgcctggtcaagtcttctctctttgaagccaaacacctccagttttcctccaggctattctttactctgaagtaactttacctaagtgatgagtcctagtttgttcactttccactttgaatttactaagagtgctacttggaggtgaacaggacattctggatgtagtctaagtgggacagagtatcatggaacttgttctgggtgccatttttttttattccaacccagaattgtgttaccttttgtggctggcatatcatgcctattgaggatttttgctgcttaagttgtctctttatatgtctgtatgtgtgcctgtgtgtgtatttgtgaaattaactttcctatgcaggaataaattacatatctttttctgagtatgccacaggtcacctgtgtgtatttcaaaatacagtcatgggctgcataatgatgtttctgtcaatgatagaccttgtatacaatggtggccccataagattataacaacatatttttactgtaccttttctatgtttagatacacaaatacttaccattgtgttacagttgcctacagtattcaatacagtagcatgcgatacagctttgtagcctaggagcaatagggtgtgtcatatagcataggtgtgtagcaggctatcccatctaggtttgtgtgagtacattttctgatggtcacacagtgacaaaattgtctaatgacacatttctcagaacatattcctgttgttaagtggtacatgattgcatgtccacaattgtttgatattcctcccttctagaagtagagcgtaattcttgccttgaatgcagctggactttgtgatttgtttctagtaaatagaaagtagcaaaaataagaaatacctttctagggtaggacataagagacactgtagcttccatcttgttctgggggaagccagctgccatgtcaggaagcagccttttcaagggggccacacggaaggaactgaggcctcctgtgaacaggtacgtgagtctttttggaattggatctttcagccacagtccagccttcatacaactgtagcctcagccaacatcttgactgaaacttcatgagaaaccctgaggcccagccacccagctaagctccttcccaaattccttccccatagaaactgagataatgaatgtttttgtttaagccactgaattctggcataatttgttaggcagcaatagataactaatcatcctgtaatcccattattcagaagtaaaatggacatttttctacagagaaaatgtatagatttacatatacttacataaatgtataaaatatatatacatttgctttttgaaacaaaaattttgattgccacctgtatgtcacttaatagacaagatctccctttcacagtgatatcattttaatggttgtagtgtactgcataatatgaatattatcatttagttatccagtcctctattttgaatgtttagttttctaatttcttcctattataagcagtgttgcaatgatgaatatcattgtagctatactgcttgttttttaatataaagccatgttttgtgtatctttttgttctttagtgaattgcctgtccaaaccccttgccttgtttttttctattgagatcttcatctttgtgtaatggcttcataaaaactcattgtatgttaagtatattaactctgtcatatgtttgtttgtcattttcttttctttttttttttgaaacggggtctcgccttgtcgcccaggctggagtccagtggtgtgatcttggctcagtgcaacctctgccttccgagttcaagcagttctccctgcctcagcctcctgagtagctgggattacaggtgcctgccaccacacccagctaattattgaatatttagtagagatggggtttcaccatgttggccaggctggtctggaactcctgacctcaggtaatccacctgaattggcctcccaaagtgctgagattacaggcgtgagccactgcgcccgaccatgtcatttttcttttatcttggtatataatatatttttacaatataatacatttcagtttttatgtagtctaacctgtccttctttttcctcatagttagcacctttgatgttaaaattgtagcccaggagtataaaaataatctatttctttttgttgcttttatggttttatgttttatgtggctttacaagttataagactttagttttttcacaaatggttatctacttatccagtagtattcttgtttattcctgagcagaatatatattttgtttttattgtgactgagatcttttttccacatcatcttctgaaactggttattgctgttttaatggaaaacagttgattgttatatttatcttatatgatttaatttctcatttttttatttgcttgaagttttggaaaataatagttgtctctaaatagtaatcatttgaaagagttttctaatatctgtgccacatttctattttcttgttttctttcattgggtagaacttccagagcaatataaactaatagcagtgagggtagtttccttatcttgttctgtcattaatgaaactgcctctaatatatcagtgttaagtttaatgtttattattcatttcagtagaccgtgtggtacacgtacccttttgttactagaatagtaactgtttttatcatgatcaaatgttgaatttccatcaaaaaccactttagcatctagtgagataaacaaggggtttttctttttaatctcttagtattagtcatagatttaataatggtaccatcctcacatttctagaatgaacttttttttggtcatgatgtactattccattaatttggtaatgtgttgtttggaattttgcatgtatatttatttatacagttggttggtattattatttgtgtgtatggtgatttttgtttgttttgacttgtgggttctttttaggcagggtcttcctctgtcacccaggctggagtgtagtggcatgatcatagctcactgcagccttgaagtcctggactcaggtatcttcccacctcagtctcttggtgagttgggactataggtgcataccactgtccccatctacttaaaaaaaatttttttttttttttgtagagatagggtctcactttgctgcccaggctggtctcgaactcctgggctcaagcgacccttccacctcggactcccaaggtgttgggaccacagatgtgagctgtgatgcctggcccatgtgtagtttgtgacaggttttaccatcaatgttatgaaaataaatggagaaattttgcatcttttctagcatagaaatgatctattccttgaaggtatgatagaaatcatctttaagattatatggattcagtactgtttgaggggaatcattattggacaactgttttctgcctcagttattcaggtttttttttttttttaagatggagttttgctcctgttgcccaggccagagtgcaatggcacgatctcagctcattgtaacctccgcctcccaggttcaagcgattctcctgcctcagcctcccaagtagttgggattacaggcataccaccatgcccggctaattttgtatttttagtagagacaggctttcaccatgttggccagactggtctcgaattcctaacctcaggcgattcacccactttggcctcccaaagtgccgggattacaggcatgagccaccatgtccagcccctagggagaatttcttaagctgatactcttttctttttctttaaagagtctcactctgtcacccaggctggaatgcagtggccctattatagctcactgcagcattgcttctcagccttttggctaagatcaagtgtatagctcactgtagcactgaactcctgggttcaagcaaatcctcccacctcagccaccagagtagctgggactacaggcatgcaccactatgcccaggtaacttttaaatttttttgtggagacagagtctcactatgttgcccaagttagtcttgaactcttggcctcaagcaatcctcctgccttggcctcccaaagtgcttgggttataggtgtgagcccccatacctagcccttaaactgatactctgtaaggatcttctaattcactaattaggtttactgcattatacagtctgctagctaccatcttcattatcttcattgggtgttttacttgggcaattgcatttttcacctctaagaaagttattttcttattgttccttttttatgatagcttattcttgttttatcagcaaggccgtatcttttgttttctcctgtttctgacaacagccctgtctgagcacagagactagtcctctccttttgaattgctaagtaattttgtgtccaattattgttcatctgtttgcttatatttttggaaggatgtttgcatttgttctgtagctgagatgggttctttcagaaattgtgttggtttcttttacatttttggttccagaagagtctctctttgatagcccaaagcccactggtgcaatagaacccaccagtcaacctattgcatctgccagcacagcactccgctccacatacagtgtgtgaattgtgcaacaggcccagggctgctcccaaccatctctagtgacaccacagagactacaggagacacaaatttgtcctcctacttctacctccagctcttagtcaggggccacgtgtgaggctggtatgtgtgggcttgcggggtcagaaggagggaaatcccgaaaatacctctgagttaaatgtttttctggtccactctgctctatatgtgttgtttctgctgaagcctttcaaagggctaagacccttctttggaatctaatagtgctattttgccaaattggacttcttactgttgttgaatcttttttctccttctgtcctgttgtctctacctgaagtacaatcttcttaatctccatttccatctgtgagaattctactcatcagttacttcccagcttaatgccactttctttcagaaactccctgagattccttccaccatcagtaatcgtcccttcatcacatgttctgccttacattccagcttcgtacatcctcatcaccctcttcctttttgcactgtgagctctttgagttcaggaactgtcttgttcacctttagatggagggtgttggaatgatgaggttagaggaagccaggtttgagtcccttcaacatttactcgccatgaaaccttgcacaagtaagttacttaacctctgagtggattttcccctctggaaaatgggcattacaacagtacctacctcatgaagctgttttgaagattaattgaggtaacataccacagtaaaggttgaaataaatgttaattcctttttctatacccttacggtaccctgcccatgtagcgcctcatccacacaggccttcagtgattggtgattgaataaaaaatacagatccaaagtgcttttgtacaaaattcacttttgcattgttgagtcaatggcagatccagaaaagaatctgaggctgggcgtggtggctcacgcctgtaattccagcactttgggaggacaggagttcgagaccagcctggccaacatggtgaaaccctgtctctactaaaaatacaaaaattagcttgtcgtggtggcgggtgcctgtgatcccagccactcaggaggctgaggcaggagaatcacttgaactcggctggggtggggaggagggcggaggttgcagtgagccgggaggttgcagtgagctgagatcgtgccactgcactccagcctgggtggcagagtgagactctgtctcaaaaaaaaaaaaaaaaaagaatccggggctgctgaacatcccacacttgtgcccacttgcacatgccgagtaagtggaacgttttaattatgtttcataaagtctctagaattaagtagggttttgttttaacaaacaaattgtactccttatatgaaagataaaattctatttggtggttgattggttggattttcaaataagcagttgctttctggtttgccttgacattttataaacataactacagatggaagctcaaaagagaggcaacatagtgttatagtggaaagatttgattcagagttaaattttagatggttgttgactgttaactcctccccagacagacttcacaaatccctcaatcagtgatcgtgttaattctatatatggttcttcctctgcttttgttatattgaagtggcatgtcatctccctttagagagtcttatttaataggtaggaaaatctcatccctgattatgaaattttgactaagctggggatctgattctacctttttggtggaaggaaacttttgtaatttcttctttcattgattattaaacctgtttggggaggtaggggtgtgtgtggaggggtgtaccccatggagtaaatatgctttctaggaaattttcttctttttttcatctccctctaggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtaaaatgccaagccctccaccagtcacaagccccatgctcagtgctgcctgtttgatcttgcacagatcctgcactgctatggtcactgatgattataatttgaaaaattatcttcttttttaaagacaacactatacagatttgtccagagttgtacttctaccagattgtcatctatgtcaagaaaggaaattgggtttttcatcaactgaatgctttgaatttcttacattgctactgattaccttatgtttccttattttctggcatggagcaagctggtagccacctaatgtaaccatcacatgctaaaaggcacataatagacacttaagtagcagtgtatattctaagaaatcagatgattcagtggttgattatcccctttaagaaaaaagcagacgaaattaaaatttgtgttcctgaaaatgatataagagatattttcagccttttttttttattcttcaagaaaggatgcttaggcagaaatagcacatctgagaaactggcttctgtctcagatttagccctttttgaccccttcttctgtgagagggctttttgctggccagagtctagtggacatcagtgcctgtgtcagatcagggatgggcatcatcctgaccacctgagggagtgagatgtgaagtcactttgaatgcaagctagcagcaccctgggaagtgagcccatctgctccagaagagctaggccgtgcaggctccggaatgcctggctctgctgcagagaccaggctgtgacttgaggttaagccgcctagagacaaagtcaggatggcttgatctggacactgctggagtttttcttatctgaagcctatgaatgaccagtgtcagtgtgaaatggtgctttcaagcaaaacgatctttcttaaggctctttgaattatcaaaatgggaagtggtacattttcattgtcactgctgaagacactcagttggttactcttttaattccaaattagacaaactagttctatttcttagtgcttccggaaagcctcctagaagaaaaaaaataaggatacatttgtaaatgacaagtgatttttctgactttaccctaaaatcatgtaagatatgtaaaacaaaccctataggctatccgttccttgtttacgtaccccgagagagcctactttttataaaagctaaatatgtgaattacaaatggctgggctataggttttacttctttttcagctgttggatatcccacctgcctgttttcctctcttctctcccaagccatgcctctcggactcagaagttgaattacatataaccacatgggttgtttggaaacatagtcagtctttatttctagccgcttcatgaagtaggtgtgtgagaccctcagaggaaaatagagaagtagaaacactttgttaattagaaatgcattaagaagctgcatggatcttaacctttgcttgtaaaggaagaggtaataattgattacactgtgggcatacaacattccaggtgctatcttcagtgagggcattttcgagacagaaaggaaaactaatcacaagttctaatcccgagggtaatttagactttgttcacttgcacagatttattggatgcctcctgtgttgaagcaccaaggctggccctggggctgcagcagtgaataaggcagacccagtccccgcctaacagggactgaacacatgctcacgtgtgtgatatttgttccaaaggaggaacacaggttatctgggagagttgattatagcgaggaagaaatcttagtcttttctgtttgagttaaaggaaacattagcatatggttttagagcagaggccctgactcctagatccttatgccctgttctgtcctgcagcccctgcattcagtctgcagtacttccctcccactcagcaccacacccttctgcccctcaccccatcaccaccacaagctttgaagaaataaaggaagtgctctttctcaagaaagccaagaacccctttcatagggcttattagcaaatctttaatttctctttataagatccttttttgttttaagacagagtctcgctctgtcgcccaggctggagtgcagtggtgtaatcttggctcactgcaacctccgcctcctgggttcaagcaattcttgtgcctcagtctcctgagtagctgggattacagggacacgccatcatgcctggctaatttttgtgtttttagtagaaacggggtttcaccatgttggccaggctggtctcaaactcctggcctcaggtgatccgtccgcctcagcctccaaaagtgctgggattacaggtgtgagccacagtgcgtggccactttataggatcttaatttcatcttctagttatctgtaaagaactcaaaaacattttgagtttaaaatgttacccttttatttgttctcatcaactagactatggctaaaccattccagactgggaaagtttacttgtggagtttctaagttagcttcttcatagcctaacaaaaagcagttataataataactaagatatctagaagactatgtgccagtcactcttctaagcactttgtgaggattattacaagacatcatcataacaggctgagaggatttaggtgacttgcctgaagttacatagctagtgaatgtttcagccagtatcagaccctgaaatgttattctggaaggtattctctcagtggtgacactcacagccttgcagtctgtactttcctgagccatcatacacaagggttctgaattttattttctccaaagtggccagttgctgagcattgccttggaaactggagtcccttgcttaggatgcaaattgtgttttttattaaaatgcctgaggtttgaaagcaggattgacccctggtttgtctgaagccatggtttatgtttagctctgatttcctgtttaccagatgctcttttggttgtagaaataagcagggggcaaagctggtttgatttttagctttagctttcttttatctgaactagaaactcagcagcagaggaagcaagcaagcaggagctcataatgcattttgcaggagagtctgctttcttagtaatactgaaattagtaggaaatgcattttctgctccatagaggacaccacataaatactatttcttctgcatgtctcagctaaacaaaaggatggctcagtagcctggagacttagaagccctcagtccttgtatgaaatttagtgggtggatttatactggattcacttgtttatttgttttgggccttgctataataataataaggaaatctcaaaagttcaagtttacatatatttgctgtatgttctgactggtttctagcagagaaaattgttagggaccaatgatactatcttctgtctcttttcttccagtgaatcaatccatctggaaaggtgtgatttcagcctccaaagtctagatcctatttcccatcttagtactgagcagggagggagatatgggttaagaattcagatttcttaaggattgatgaggagctagaaaggttaagtggtttgaacagacatggaacaagttggttattgatttttctgcttctctctctctctcgtgcctttcattccatttcccattctcctgccctccccattcccatcccacttccaaccaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtaacactgaacctacaaccttagactttagggccatatgaaacctaagaagtgacattctccaagcccctgattttctggttggagagattagagcgtagacattacctgcagcacagagagcagtgggggacaccctcctgtcccagcgttgagcaccctgttccccactggcttcgtgtagcagagtgctaaagccattgactatgcataaaaggatcgctgttgatgtaggaacaacagagcaaatcgagtgtcatctttatgatgacgcttagggtttgcaggtgggacgctctgacctgtagccacttgcctcagctcctcctttactctgactgggtcatcagagtgtgtagtctcagtggtttccttagtaagatgtgaggaggaagaggagaattttctcacctcatcatgatactgccctaatttatagcccttttttgaactgtgatgccattgggaaggcaggatggactatagcagttccattctgtgactctctggctggtgccatcctacatgaagtaggatgatgtcacggcaggagcaccagagtctctggagatagaagtgagctgtggcttctgctgactggtagtgaccttgggcagcccctggagacctttccactggagagatccttgcctgtaaaatccactggttcaatctagacgatctctaagggctcttctggagtgggattctgagtcaaggtgagttttttttttttagagatgtactgctctcagcttttgagatatacatccaatatatagtcaaatgccagatataccacatactgttagaaggaaggaaagctgtctccaagctagaggctatgctttttagagatggaactgagacttgtgggcagaaaggagccgagaacagactgagcagaaccagaggatgagtgggagagctcccatcacagagcctcacaccagccaacgaggagaggactggaaggaagggtcttgccttaagaaggtggcaaccaggaaaaaaggcccttgaatgtgactggggccagatattggggatctttgtgttgagagtttctggacattttgaggcaaaagctagatcgtacgagggaataagagattctacagaaataaataagggttaaagtttaaaatgaaactgggccggtgcagtggctcatgcctacaatcccagcactttgggaggctggcgtgggaggatcacttgaggccaggagttcaagaccagcataggcgatatagtgcgactccatttctacaaaaaagtttaaaaattagctgagtgtggttatgtgtgcctgtggttttagctattggggaggtgagacaggaggatcacctaagtccaggagctcgaggctacagtgagctgtgatcgtgccactatactccagcccaggtgacagcgtgagaacttgtttctaaaataaaataaaactgaactaaagattcagtgaggccagagggctaataatcttccatggaaagaaccacactaaagttagatgcattgatcgcaagttgacaaggtgggtcatgtttatgtgacttctttcaatagtcttcattgcctgagagccagaatagaagaaggggattatactttaggggtagagattagtgtcagcgattgtggggagaggagtcccctctcaaagaggacagtttgaagtgtcaaagtgtagggttcaagttgggagagaagtcctgagccccaggaaggcttgtggcctgggccaaagaggagtgagagtgctgtgaggttggattgagtaaagatcctggttggaatttgaagaagtgacaggtttcctatgggagtcttgggatggctggactgaaagaagcaggaggttctcaggacgagctgagcattaggagaagtgagaatgctgacttaaccttttccaagagaacagcacattcagctcagtgccatgaagccagcattggggaggagtgagagaggaagtgggctgactcattcctgggagtaaaatggggctacttgggccagctgaagaggctcttgtttctggggagtggaagttggacccagcaaggagaacaagaaagtcttaattgcttttcttctttgtgcactctgaatgaccttataacagaatgcctgaaactggttaatttataaagaggcttattttggctcacagttatggagactgggaagtccaaattgggcagccttaacttccattgaggacctcctgctgcctcatcatatgatgaggtggaagggagcaggcatgtgcaaaaggggcaagataggaggagcagccttgctttataacatcccactctcatggcaactggtccaatcccacgagagtgagaactcattccggcgagaattaacccagtcccaagagagtggcattaatctgtcttaacaacctaatcacctcttaaaggccccacctctcagcactaccacactaaggaccaaatttccaacacatgaattctggggggatacactcaaaccatagcaaatggtgatgatgatgatgatgatcatcatcatcatcgtcgtcgtcgtcgtcgtcgtcgtcacttgggggcagatctgcccttttggagaggctaattgaaatatttcagctggagtagaatgagaagagttgaaggattattacaacttaatggcagaaaagaaaaatagcttattcattttgagattagatggggattttaatgctgttttgatggcattagttccagagatgcaggaatgcccatgtttcttccctgaagtcacacttgacctcttctgtgaaattcagaggtaactgtgcccaagggaagagcagaatagaagttgtcctgtcactatgtaaaaagctgtgcaagtgcccaatcttccagttcagagccctcgtaaatactgagtttcgagcatgtcagatggacttcgtaggtccttctgctcctttctacctattcttccctaacttcttttttttttttttttttttttttgagacagagtcttgctctgttgcccaggctggagtggcacgatctctgctcactgcaagctccgcctcccgggttcacagcattctcctgcctcagcctcccgagtagctgggactacaggcacccgccaccacacccggctaatttttttttgtatttttagtagagacggggtttcaccatgttagccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggaccaggcgggtgcagtggctcatgcctgcaatgccagcactttgggagaccaaggtgggaggactgcttgagcccaggagtttaagacccacctgggcaacatagtgagagccccctgccctctacaaaaaatttaaaaattagccaagcatggtggtgtgtctgtattcccagctactcagcaggctgaggtgggatatcacttgagcctgggagattgaggctgcagtgagtcaggattacaccactgcatttcagcctaggccacaaagcaagaccctgtctcaaataaatgaataaataaatttttttttttagaaaaggcaactcaggccgggcacggtgactcacgcctgtaatcccagcactttgggaggctgagatgggaggattgcttgaggccaggagctcaagacgagcatggtcaacatagggagaccccatctctaaaaattttttttaaaacacaagcaagctaacaattttaaaactcaaaagagaaatagctaggcctcagtgttcctagccagccccatggaatcaagagagtgcagctgatcaatgtacatcaaaaagccaggccctacctgggactggcacagcatggggacagcatgcaggaggtgcatgggacaaatggcacctgggtttgggcttgagaggcatagtgaaaagacccactagcagtcactttccattttctgtttctgactccaagcaagcagagcagcagttcttcttcctgggtgggacaggttaagaagaccagtaaagggtctctccctcgccacttgtagctacactatctttcctgttcacattcaggtgtgtcttcctcatgaggactgagatgaagaggggtcagactaaagcactgtttgcacgggatttttttaaatagaatttgttatagcgatatcagtaaagcaagagttatgccaaatgctcatagtaggagtttacttcgacctctttttttttccccactcaatactgccaccagttaagacttagacttctcagggaaatccatttgctctgttaaggaaattaatagtaaatagaaatatgttagcttattttaatagatcaatgttagtgtcaaggtttgtctgcaagcagtgaatgaataattataaatagctttcctaaaaagaattgttctgcctttgtgtgtgtacttggaaacataaagtcacattttaaaaaaatttattttcacgaaacagacaacattttttttctcagaaaggaaaatgagatgatagctttgctatgcttagaaatcctaaagctacctttctggtgggaatataaattggttaacctctaaggaggcagtctggcagtatataattgcaagtgcatataccttttgatcattaataaaatttgtttctataatttcatttccttagagaaaaggtaagataagagggaaacagcaaagactcccaagtctttgggattattgtgtactacatttggaaattaagttttcatttcttaagtaagttattgaaagagggaagtcctggccgggcacggtggctcacgcctgtaatcccagcattttgagaagccgaagcgggcagatcacgatgccaagagatcgagaccatcctggccgacatggtgaaaccccatctctactaaaaatacaaaaaattagttgggcgtggtggctcccgcctgtagtcccagctacttgagaggctgaggcaagagaatcacttgaacctgggaggcagaggttgcagtgagctgagatcgcgccactgcactccagcctggcaacagagcaagactctgtctcaaaaaaaaagagtgaagtcctaaatcagtgggttaatccatctgttcttccaggacagatgatattgaataatgaaatgtttgtcaagcagagagaggactgaggataattcagtcaaaacaaacatttggagcaaaaattttgaggtgtgaaagagcctggcctgttccccaggaaagaggtcaaatctggctaaagcagtgagtccaggggaagagctaaggcagttgagaagtaggaggggtagctttgtgtgacaggtaaagaagatgtcattttctgagccagtgtgcatcaaacttcactaccagatgaatgcagaatagaattatgtacactctgcaaagcagcgggggaggagagttagtctcaagcctcacttgtttttccacttctttgttttatctttgacctgtgcaaattttacattctattcctgagtgaatgtttggtatgacatgaaagagatatttcaaattacctaacattttataaatgcaatgctattcatacatactgctttgaaccctggggctatggctgtaggcggtaaagagcctgtgaagtattttcagcaaggaaagtcatgtcattatattgccgtactacagacgggtggagtgaaggggaaaaactggaaggagggaacagcttttgccaggagctcaatacaacttacctcagtgacctgtggatgggtagacaatgaggaaatagaagcccacaaggactgcactgctagtaccttatgaaggcaggaatttactcctggactttctgaccttaaggcctgtactctgtccatatgcttccctgcctccaggaggcagaaccagaaggctcttgccataatccaggtaagaagtaaagaggacccgaccagggcagaggtgagaggagaggcaaggagagaacattctagagagatgaaagagaattgagtgacttcccagatatagtagggagaaggaaaaacaaggaaaattccaggtccgtggcttggatgactggatggatgatgttcatcattaaccgacttaggatacttcagaggaagagcaggtttaaggtggagatgggaaaagaatggtgtagatcctctgattgcataagaaaacaagacagcagaagcaaaggcatggcttgtaatgcccaagatagacattatgggtgggcctcagagcccccgaagactgcattgtagcagccaaaacagcaaagagctcatcagggcttggggactgtcttttaggtttgtttgaagagactgtaccagagggccagggaggaggagaaaggaattgagctggcctatctagagcagctgcatggccaacacgaagcctggcttattcacaagacaacgaagtaagtggggagaaaagaatgtatcagagacagagacctggctcccaacagccagttgttaaaaacaagttcagcatgcagccccctgtaggaaggttcagaatatactggaaatggttggaaatgtcaagcattttccaactcagaagtttaatattgctggacaccgtggctcacgcctgtaatcccagcactttgggaggctgaggcagtcacctgaggtcaggattcaagaccagcctggccaacatggtgaaaccctgtctctactaaaaatagaaaaattagccaggtgtggtgtcaggcgcctgtaataccagctactcgggaggctgaggcaggagaatcgcttgaacctgggaggcaaagattgcggtgagccgagatcgcaccactgtactccagcctgggcgacagagtgagatgcccagaagaagtttaatattgaatataatctttacattccaagggcctttttattagattgtatttctccagctttttctttgtttcttaacatttccctagactgaacattgtgattgatggtgatagttggctcagcatgaagggctgaaaatgttagagaaattgtcagtattactaagttggcattcctggtttctgcctgtcctccctttaggcttggtttgttgtccacttaaaatgtttggtgctctgactgtttgttagtatcactctcaagaatgaagagaaacctcaacctttctgtttccggccaactttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttctgaggaagtaaccaaacaagaagacctcatgagagaggtgggaaggactttaactcctgttttctggtggtttcctttgttgtacttttatctttctggcctttgcttcaaagttcaatatcatgggtcttgtgctttgcatctcacattgcatttcacactccaaggcctatggaatcttgtgcagattacaaatatccctattctctaaagtatgctggactaataattgttaaataattgacttgtaacatgtgcttgccagctgactttcttctctaaggcatcctaaaactagggaaatgagactactggattctattcccagctctgccacttgatgctatatgaccctgggctgcccacatttcttctccatgcctattattttcctttcctcacaaaaacctcatgggcttggctgcatatgcattgggggtggaccattgaaaattctgttaaaaatgtgaaattaaacttctgattttctccttcccacaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaattcagttgctcatttatttcagcatgtatctcttggtgcttgctctaaattcacctctagactagtgtattagtccgttttcacactgctataaagatactacctgaggctgggtaatttctaaaggaaagaggtttaatcgattcacagtttcgcatggtgggggaggcctcaggaaacttacaatcatggcagaggggaaacaggcacatctcacatggtggcaggtgaatgagcgagtgcaagaaagagcagggaaacctgccttataaaaccattagatcttttgagagctcactgccatgagaacagcatgggggaaactgtcccggtgatacagtcgcctcccaccaagtctctcccttgacacctggggattacaattcaagatgagatttggctggggacacaaagcctaaccatatcaactagcaattttcaaattgctcccagaactctaacccaagccctacctgccatgcatgaagaagggaaataaagtggctcaagagtgggtgggatcttaaatgtgagccccccagagcaggaaatggagcatgaactccaggaagcttctttatctcttcccatctgccactcttgacataggggacaggtgtggggaacttaaacccttgtcctagagctaaagaacctggccaaaagaaaaaggtagaaaacagcaagaacccaaaagttaagcatctgacatttaagattggccagcccggcactctatctttgtctaaataccttacccaatgacttccagataacgttaatggagtggatctctctgtgcaggaaaaaaaaaaaaaaaattttttgttgtgctctttacccttcaaatagaatttattgttaagggaagaaaaatacatggctctataggattgaagtgctccattgccagaagcctgcaggtccatgattcacaggagcagatctgcactgaacccttgacggttctgcaggtacacaggaagatgaatgatctggggacgtaagagtgccccagaagacagaaatctgtgtttctgtcctttatgctttggggaaatgaatgtgagattggtttctaacaaatacataggccaggcaaggtggcttacacctgtaatgccagcactttgggagaccaaggcaggtggatcacctgaggtcagcagttcaagaccagtctgggcaacatggcaaaaccccatctctaccaaaaatacaaaatttatccgggcgtggtggtgtatgcctgtaatcccagctacttgagaggctgaggcaggaaaatcgcttgaacccaggaggcggaggttgcagtgagctgagatcacatcactgcactctagcctgggcgacaagaacgaaactctgtctcaaaaaaaaaaaaaaaaaaagtaatgttttaatataaaagtatggcaatttccttatcctacttatttaaaacattttaatagctttattgatacataattcacatattatacaattcactcatctaaactgtacgattcaggccacacacagtggctcacacctgtaatcccagagatttgagaggccaaagtaagagaattgcttgaggccaggagtttgagaccagcctaggtaacataatgagaggccagctctccaaaaaagtaaaaattaaaaaaataagccaggtgtggtggagtgagcctgtagtcctagctacttgggaggctgaggtgggaggatcgcttgaacccaggaggctgcagtgagctatgatcctgccactgcacttgtaggtgacagagcgagactctatctcttaaaaataaagtgtacaggccaggcgtggtggctcacgcctgtaatcccagcattttgggaggctgaggcaggtggatcaactgaggtcaggagtttgagaccagcctggccaacatggtgaaaccccgtctccaataaaaatacaaaaaattagccgggtgtggtggtgtgtgcctgtaatcccagc

SEQ ID NO: 12017 - DNA, 85869 bp, Human
ctcccagggatgtcctgaaacacagcagaaagggaaatcttactgacaaacagaactttgagcagaacatctgcttttctattttgcaagaaaaaagagatggcccaatgtaagatctacactgactcatcagtggtggctaatgtgttggccagctgctaccttaaggatttggaaaaaacaagattgaaagactggtgacacagaggtcaaggtgggggaggcatgtgagagagtctcttgaaatgggcacagggtgtgaagatatttgcgtctcatggagtgccctccagagaacaaattgacctgtcccgtagatgtcagccagcctcctgccagcttccttggggcttgctgaatgtacaatgagtgccatggtgctggcatggagatgaagcacaggcttaactctccagacttccttcaccgaggctgatgtggcttaccaatgctgagtgagcaaaatgctgagagtgaagggcagcactgagccccctgtggcaccattccccgtagtccgtgttaaatggcctctcttcacagcatcagttcacagggtccagtaacaccattgactcatcttcctcagcagttggaagagggaggaggagagttagtttcagcctctggagttgggggtgagtgaggatactgatgtatcacaagcaactagtgggcaagggggaaaagatgactgagttcaaaagcaatgcctggattggaaataaaagatggaaaattgcattaattcataatcatgtggtaatgccccatcggactctgcattcttaatcttttacctctactgacagagaggctttgcttttcagctgctgtgaacaagctgaagaggccttatcctcttatctgcaagagtggaagtaatcacagggggccctaaaggcaaatgtttacctgtgtattttatcgtgaaagtgccaagggtccagacctcacctctcttgtcccactttatctccagtacctagaagggaggctggcacattgtaaccactcaaacatctgtggatgactggaataaatgggaggatgtaggaatgaatgaacgaatgaataatcctttagggaacaatagagagctgggggagggagaagccatacctgatcttttattcttctccaaaacccttgaaaagactatgagaggccgcatagagtagccattaagaccttgaactcttaatttaggatctacaacttcctagctgaatggcttggccaagttatttattctctgtgtacagtcttccttcctgtaaaacaaacacagtaaatgcttagagcagcacctgggaaaaagtcaagttccacataagtgttactgtcattatttttgtcatcttgatgagtgtgtaagcctgcaagacaatcgggaaattccctagggagggtgaatccagatactcagcttccaagggccattcaagagggaacaatcaccttttctctttgcctttcatactgctttagacccctcactgcttcctaacataactttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaaggtgagtgccgcgccacgtacgtccccggggcgagctgtggggacctcttcgccaaactccccaaatggcccaaaagctggcgaaaccggaccagggactccccttaggcggaagccccaaggccaccctctgacaggtgaagggacgtcccagagctctcgcttagctttcggaccctggcttctgctaggaccctggcgtcgagctttgaatgtcccggagagccactcacagaacgcacgcccgaacccgggcaggggtagagaaaccaacgctaatgtgctctgaaggcacaagttcaagggcacccgccttagagaactccaactggcgcactccagacgccacccccacccccagcccgcggtctccctcttctaacgcactcccacctgcaaatcctgctgcctctggagcagccccgaccctcctacggaaactggggccacacgcttccctctaattggacttgatctgctcggcttgcagacaccgtggaaggttcttctgggactgctgggtgctgctgcgcttgtcaccatcatcaccgtgcccgtggttctgctgaacaaaggcagtaagtttgaaacatttgaaaaagataggacagttggagctcaggtcaggctccgtcttaccacgctaagggaaacgagggattttgcgtggggttggaccagtgccccgaagtgtagctgagaaggcttcccagttgttgttgctgcttgtagagcagcagctggattcacttcgcggggtcttcagtgtttaggctgaaactcttgcggctttcacgtcttgttatgtataataaatgcatgcttcctgaaattagggagagtcgggatttttaaaatttcaattttaaatttaatttgtaaatttttaaatttacatgtaatttttgagaaaagtttttgggtgtgatcgaaaaaggaaaaaaggcagtgtttaaagagcccaaagacagcagtaaggatatctgaaatggaaaggaaaaatgagaaagcaagccccaaaatacagttttgagaaatgatgttccacagggaacccagactgttttccctcaagggtggtgagaattcagttggagggtggggaggcagggaagtaattgaccaatttagcagtattgcagagctaaataataaagctggtatacacgataatatttaagaagggtctggaatcagtgatgttttggtggattcttttatttaaggactttcatgtctttttagcttgcctaaatgtataaaacactcacataatggaatactcactgtaggatgcaagcaagtgagaactactagtttcagtctcccctggccttactttccttttaaacacttgctttcatttcagcattacacactataaattagtcagccagttaaagcattctctctggaagatttagtcaactgaggaatgtatagtcagtgcttgcatactcaaggagtcttatctagattttaggatgacagttcagaattagattgtagagctatgaaaaccatgcttgctgtgcaattcaaggccagggcaaatgtgccaaaggttaaataactgaatgggttgacctactgctaatgaaatttgaagaaaccagtggttgctactattttataccattaaatgacagtccacttaagcttgactcttgtggactgttaaaatataactattttcataaagcaactctttgtgtaaaccatacatgcaaagccttgtgggagaagaatgtgctagtcatacaattgataaatatagggcttacaggcttacattatgttccaggcaccgcgttagttgctgcaaatacaaagattaaattttgtaaatataaatataaaggccctgacctcaaggactgtataagctagtgggaacatgcaaacaaatatgacttgttttacatatatatgtgtgtatgtgtgtgtgtggatacacacatatataaatagaaataatctgtatgtttctctccaaaacatcactgaggcatcacagcatcgctggaagtttgagtaaaactgtaattatcagaacttccgttaaagcaagttggaaggaatactgtactttgataagccacttgagatggccagtgaaaaggcctagggatctgaggcttgctgcagttaactctgagaattttgttttgctgggtagggtatacaggccaggaagagctgttttgccatttctgctaaatagcacctggtatcttctccaaatgaaatttgaacacatttcaagaatgttctcttgaggaggacttcctgagagactcaacttgtttccatataactactcttatgattcaaaaaaataacttagaggtgcttgagcagactgctctggaggttagaaggaacacttctgggaaagtctccccctcccgggttcaagtgattcccttgcctcagcctcccgagtagctgggactacaggcacacaccaccacgcccggataattttttgtattttagtatagatggggttttaccatgttggccaggatggtctttatctcctgacctcatgatctgcccactttggcctcccaaagtgctggaatgaaaggtgtaagccactgcacccggcggagagacttcttataagaggtttcttttgtgggccaagcttgaatagttaacatcagtttctggagataagatattccagaaaatgcaaatgccctgtgtttcaacacagagacatgagatcacatcctgtgttagggattataaaaggatccagggccccagaggagggtgggaaacaggcaaaagagtttgattctaagctggagatgatgcagtgaatgatgttttgagcatgcctgaactgttggccatgacagtgggaaggtgagttgcaatggagcaacactggagggggaagtgagggaaatggcccaggacacttacagtacaggtcagaatttggaggctccagagctactcagaaatgtgaatgactggacttcggtaaccggttaaacagagagaggtaaaggagagggtggctaaggatacctcttggacaaccaggtggagatgttgtttcatggtggctttatttatttaccactctagtaatttcttgtctgtatttcttaacttgtatgtatgtatgtttaaggaaaaaagggaagtcatcttgttaacacttctgccttatcataggaataaagataaaagctcaggaatgcagcattttcactaaatcagcaatacctttcctgggctgtgccataataaaggtcagcattccttacaaaaaagtcaaagtcatcacccaagaaatgccctccatgttgtcaatcaagctttcaagtaaacaaatagagtgaaggaaaaaggaaggaagtagggagaaaggaaatgtaaagggaaggggaagggaaaggaaaggaagaaggaaggaaggaaaggaatttgatagaaaaacaaagcaaagacctaaattacgtggaaactaaagaattaaacagccaaaaggaaggaggaagccatgagcaaacccaagttcatcccctgagaggttgatttaagaggtcaagcatttccatgtgaaatgcttactttagcaaaactagacacacccagaacaggacgggggctagtgaatggggagccagagagagagagagagaggcttaatactattgtcatatatttaagaataaaaactccttgaagtcatattattcatttcaccaagcacaatcaaaagttcaccctcttctgtgtatataataaatgattgtatgttttaaattttttttcaatcatcctactataggaggatattgcatatgtaagcattcagtttccccaagaatcagtgagaaatacgtaaaaatacttgtatggaattgtagaactcttcatggcttagtggtaataaaattcacatgcagcatttatgattcctttattttttcttttacactatattatatgctgaaatttgaaatatttggttatttgtcaaatagttttattattattgaattttattatggaaaagaagtatatctcttcttttgctcctttcactgctttagtggtaaatttcttctataccttctttcggtggaaaggaaatttgactgctcacccatccatcagtaataagagaaaacccaaatgtgaaggagacaggaataatcagagagaaaagatagcatctatgaggtttgcctgaggaagtccaggatctgttccaggtttaaagcacagaaatgcgcctgaatgaaagctttgtatgtttcaggggacaatttctaaacagtatgctctgtaaaagctggagttgactccagcttgctcagttaactattgtcaacctttgtggaatgctcatgaggtcagcaggttagtctttttcaggccagttattttgggttttgcttccctagccatagcatatgccttaagtttctctatcttagaaatctctgcctctcttctcaaaggggatcacaaagagagagaaaatgaagactactcagttgatggtcagagaaagacaatataaaaagactggagctggatcgtgtctttcaaattttatgacttaagaaattactgaggcccatggagaatgtggctgtaaataacatgcaggagcgccttgcttgaggaagagaaggcatgcaagctacaataatagccaatatgcatttactaagtgctaaatttggggctgagggctttcaatgtatttttcatttaatccttagaacaactctttgaaagagaggtactattaccctctccattcctacagaagatttatagaaactttgagagggtactttagttatctgtaattgcataatgaattacctcagaacttaaaacaataaatatttattatctcatagtttctgtgtataaggaattttggagtggcttagctgggtggttctgcctcagggtctctcatgaggttgcaatcaagatgttatctgaaagcctgactggggctgaaggatccccttccaagctcactcatgtgcctgttagctagaggcctcagttccctagtgtgtgggccccagttccccaccatgtgggaattatattataatttcatgacttctaatctctgtgtcgtaagcattctgaagaagagcctactgtggatgccttcattcctatataaagctgtatacaggcaatgactgacatctcaagcttttgaatggttctgtttagtagtattagtagtaataataggtccagatttacttacttgcactaaattatacttaggataatatggtagctactttcccttagaatgaaggatccaagagaggaactaagcaggaagctgagttgccttttatgacctagcctcagaagtggcaggtataccattccttctgctgtgtactattggtcacacagaccaaccctgatacaatgtgggagggcactacacaagtgtgtaaataccaggaggtggagatcattgggaaccatgatggaggctggctccaatgactatcaaagaagttaaggaacttgctcaaagttccacaaagttgggattcatactcaggcaatgtgactctacagctgatactcagtactgttcaactccatatcattctgtcagcttgtaatcaagtataaaatcaacttggccatattagcataattgttataacttctcatttgcatagcgatattataatttcatggcttctaatctctatgtgttaagtatcctgaggaagagcctactgctgctgccttcattctcatataaagctgtatataggcaatgactgacatctcaagcttttgaatggtttcgatttttagtattagtagtaataatagattcagatttacctactggcactaaattacacttgctttgcttctgatgtaagttacattatttcatttgatcttcacagagaagttcattttagagagatatattaatatcttgactttttacacgtgaaagtttaggggtttgcaagtaagtactggatcttgggaatccaaatcttttgactaccaaccttccctgagcctgctggttcccatgaatggctaatttatagaaatgccttggtgagagtttttctgagttaatgtttaatcattactttatggttggatgctaatcctttcattgctgtaaatcaatatcttgtaaatatttttaactttagtcttcacagctccattatgacctccaaaagagggtgtgtctctcaatttgagagtaacctgaaaccatgaaattagaactaactgttttattatttgccaagcattgtattgttttatattgttcttcaaaattataacttcctaggaagcttttacaaatttaaagataaactatgtgctttctttaactgggggcattaatgtgcacatttcttaattatttggttcagtgaggaagaaagtagacctatgagttcagggtcctagaagaggaggtaatgtaaggcagagccaaagccactagagattttattcatggcactctaggagccatggtggctcaggatgtataattgaggtagagggagtaggagaggtgagtatcaagcaggtcttatcatccaccccttccctgacttcttaaaactggggaccccaaaactgagcttagtggcctctgtggcctaataccatttctgtgaggctggaaccctcttttcttgttttcctcagttgttctaaagcccaccctgctcaaactcatgtccataagtttcatggatgactcttatttctctattatattcttccattatttgattccaggcataaaactctttcagtatgagatttaaaacctcttcagggccaaggtccaacagtggctaaatacaatatttttcaattcaaaaaacatatattgaatgcttactgcatgtcaagtattactgaagatatgggagtggggggatatggctattgaatgcttactgcatgtcaagtgttattgaaggtatgggggatatggcctgctatgattgcgtatttgtcccctccaaacctcatgttgaaatttgatctccagtgttggaggtgaggcctaatggaaggtatctgcataatgggatcagagccctcccacaggggtgagtgagttcttgctctattcgtttccgtaacagctgattattaaaaagagcctagcacctccctctttcttgctttctttctcaccatgtgatctctgcacatgccagcctccccttcaccttctgctataagtagaagcagcctgagaccatcatcagatgtaaatgcccaatattgaactttccagtcaccagaatcatgatccaaataatcttttaaaaagataaattactagcctcagatattcctttatagcaatacaaaatgagctaagatctagccctaagcagtatagataatgtccctgttccactggacctttacagttcatagagcaggcaaattataggcaagtgcagaaataatttcagatggtaataaatgctatgacagaaatcaagtgggatagagaggaccggcagacacagaaaggagtttctctcttattccaagtatgattttgagctcctggaggatttcagcatgaatgtgacatgatcttttcacatttcaaaaatatgcctctgactcttgtgtggatagtagtttggggttggtgtggtttgtccaggtgatcaatgatggtggcttggagaaggatggtagcactggaggtgaaaataagtttaaaaaaaaaaaagaaacgcaggatgtattttggaggtaagacaatgtgcaggcatgtgaagagtgagggaaggagagaaggtaaggatggctccttggacagctggctagatagcttaagtaaagaatttctcttgcctcctggctgtttcctttttatcagagcttgtctgcagaggttcctctggcttaactcccctttcctattggatcagccttcccctttcaaggatgtgctcaggaacacctcctacttcatattcacccagcacagatttgttgacagaaggtaattctccaacttggcaaatatttattgaggattttctatatgccaggtactttgtgggtccctagggatagaaagacaatagatatggcctttgtcctcaaataattgacagcattaaaagacacataaacattaactacaatcaaaagagctaagtgcccttctagtaaatgatcaaagtgctatggaagcactagtgaccaaatgataaatgctgccccaggaagtttctacataaacaaccaagcataaagcattaataattaatgggtcttaatattatccttccaatccttcagcccccaaactggctctgaggcatgcagtgcacctccgtgtccatcctcactgacttacagccccctgatgctgtatgaggattgtatcaggatgttttgggcttcaaggaacccaatacctggccaaaagttatttgaatgatagcgttttattactgtattgtcattagcatcttttataattggaagtgcagaagtaaagtggttcttgggtttgttaatgtaatggcctgaacacatcaagaacatggggcctttccacctttcagctctgccatccttggagttttgtcttttgatctccagtatgtcatctcatggttgagcatggcttctgcagctcaacccagcacttgctcatacagctcattcacagggcagaagaggatgctcttcctcattcatgttctgctgtatcagggaggaaaaccatttccataagtcctctgaccagatgcaaactttcagatcttactggcgacatttgtgtcacttgtccatatccaaaccaatcaccggcaaggagaatgaattgccgtgattgaaccagactactcaagactcacctttctcaggttggaaagtatcttcttttgctagcacatggaaggagaagggcaaatacctaagttgaattgaaaattctgaaagacagaaatcggggagacggcctatgtaggcatatcgtgtatttggttattgctctcttttcattacgttagaaagatttaatttttcaacaaaagaggacagacatcaagccagctctgatctccaaaaatctggagctgtaattctctcctttccttctcctcactttctttcctaactgggtttattgcaaatcagtgtgctttgttgctgcctttctgatctcaaggacattttgacctcagccctttctttcttttggcatccaaagtgatcaagaggagaaaataattgaattgcaatgttaaaatataaatctgagataatagagcaggtaagaaacatctgaggggaattactgacaatttacctctagaaaatccacataaactgtcacatttcatccagttcataatagcagaaagtggtagaaatagtcaacataaaataagatgggcaaaatttttaaaaaatggtaaaacttagatctgctaaagttaacccaggaaagtaggacttaaaataattaatggccataaaaataaaatagtaaataacaaaagcaaacaaaataacctcacaaggtccagaagctataatttaatctaacatgggcaaaaaaaatctaattgatgactcaaatctttgttttaaaatttccagcgaaaaaattactctgcatggtaatgattttcttaaaatgaaaagggtttggctgtactgaaaggagaacccagaacccagcagccagtggacccttattccttcctggcaatctggccctattttccctgtctgctcactcgcttgcttttctggtgaactattccaggtatctcctctccactcaaacttccaacacctcctccatatgctcattcatagctaaggacctggcttcctgttttgataagaaaactgaaaccattagaagagaacttcaattctcaccggctcatcagtgcattcacctgtatcggctcccctcccaagttagaggaatgaatgctcaggctcctacccaagaccaggccctttgtttgtgccctgggtcccatcccttttgcctactgaaagattaggctccagctgtccccttgcatgtggcaacatcattttttccatctctatttgatcatgaacatacagtagtgtctcatattcttaaaaaataagaaggaaactgtctttttccaccctcatccctgccaacctaccactccctttctctgctctctttaccacaaaacttcttaaagagtttctattatcactgtctgttacccctctccctttttttctcttaagcctcctggaataagggttatccccaccacaccactaaaacagctgtattcttgtcaaggtccctaatctctgtgttgcagattgggagttgcttctcactctgtgtctcgtgtgcctgtcaattagtcatccttcttctccacctcccctcggggctctcactctctcctggttgtccttctacctcactgtgcagtctttcccagcctccttaggtattcttcctgatgtcttcaacttctcaccttggactactctggggctccatcctaagaccttttcctttttcaccttagatgacctcatccactcccatggcctcaaataccatttacaacttggcaactttccaattttacctgcaaaccagaccttttcctgagctctaggtgcagtatacaactgcttactggacatctccatttggatgtgatattggcatctcatactgacatcttccaaaactctttgtcttcccttagtacatcttatttcagcaaatggcaattctatttttgtagttactgaggccaatatccatgcaagttctcctcaactcctctctttcatccacaagtcacatccaatgtgtcggcagttttatcatctgtatcttcatattctctcagagtttgaccctacctcaccacctcatctcctactaccctggtcaaagacacaattgcccttcccctaaattattgccaacatctctctttttttttttcttacttccctatggtgtattctcaacacaacagacaaggtgattgtggtaggcagaatgctaaggtgacccccaagaaccctctcctccgctcctgtgtactaatctctgagattgtggatatgatgaattttcttcctgtagttaagtttcgttatgatgcacagttggctttaagaaagggagattacctgcttgggcctgactgaatcacatgaactgtttaaaagcagagtttctctggctagtcacagaacaggcagtcaggaatcccaggcatgagaaggatttaacatgccattgctgacttggaagatggaggggccatatggccaggaatgtgggtcatctctaggaggtgagagcagccctggcttatagtcaacaagtaaatgagaacttcactctcacaacctcaatgaactgaattttgccaacaacctgtgtgagcctgggagcaggtaatttttccccagagcctccagctgacaactcattccagccaaaactttgattttaacctcacaatactttgaacagagaactcagcaaaatgggctggactgctgacttttagaactctaagctgatacatgtgtgctgtgttaagtcactaagtttgtggtgatttgttacatagcaatagaaaaccattaataatatagtgataaaattgttttaatttattatttatttatttattttgagatggagtcttgctctgtcgctcaggctggagtgcagcgatgcagtctcagctcactgcaaccactgcctcccagtttcaagcgattctcccgcctcagcctcccagatagctggcactataggtgtgcaccaccacgcccagctaattttttttttttttttttgtatttttagtagagacagggttttgccatgttggccaggctggtctcatactcctgacctcaggtgatttgcctgtcttggcctcccaaagtgctgggattacaggtgtaagccaccatgcccaggctggcgaccacatttaaacataagtcaaatcatgtccttttctgcttaacatcgttcattggctttccattgtgaaggctccatggcacttgttaccacctagcatatggcattgcttactcattatctgttcctatgtctcccccagttaaaatataagcttcataagggcaggagtttttcatgctttattcactgtgatgtctctagtgcctagaacactgaataacacagtaagtgctaagtaaatatttggtgaattaaagaaattatcttggagctcaggcaagaaaatttttttaatgaacatttattaatattgctgtaattctgaataaaattattatatttataaaccactcagtactaaatcatgtatacctacaatttgtaagtgctagcaactgtttgaaaaaagatagaatacgtttatcctcatggcttattaatagtttggttaagaaaagactgttaaagtaagtacttaaatagatataaaattacttgattaattggcaaaatatgtggtacagaaaataaacattttaataagatgaggagagagaaatgaatgtggactaagtagtaagggatagatcaagagacatgaagaggaatagtgggaaaatgaaggccatgaatgtagactgtttatttgagaagtttgtccagatggcttggggatgcagcaggatcaggtaagtatttctttaagatcagtacacactctgcatccttaaccacagagcagaagtgagcagtggaaagaaactgaagatgcagctgggcacagtggctcacacatgtaatcctagctctttgggatgctgaggcaggaggatcgcttgagcccaggagttcgttcaaggctttagtgagccatgatagtgccattgcactctagcctgggtgacagagtgagaccctgtttcaagtaaaaaagagaaagaggaaggaaggaaggaaggaaggaaggaaggagggagggagggagggagggagggagggaaggaaggaagctaagaaagaaggaggctaggaaggaaggaagctaggaacgaaggaagctagggagggagggagggaggaggaaggaaggaaagaaagagggaaggaaggaaggaaggagctttgtgttttagagggaaaaggtaagattttaaaaaaatcccttgggaacaagaggacaagcatctgagtcatagattggggtgtggaatgatcggggaggaagctcacctctccctcagagttctaaggaaagagttgaacaatggcaggagggacagataccacagaactgatgagcttggtagaaaataagctcctatggtagcttttgctgtaaaggaggaatcattgaatttttttgttggctaattttataattttttcaaaatgtatactgcaggacctgagttgttcagcattgtataatatttaaaatctagagaacatgaaaaaagggaagaaaacaaacctattttaaagcttacgtgactactttttaatgagttcaggaaaaagatgatgaaagttattgggtattcccatggaaaagagaatagagatggtaaaacttcctttctaggaagttaccttctaggaagccacagagttgccatccttcttactgtccagagggaaaattctagagttttctgaatttgcactcttttgactttgaagcagaacaaattaagtttcaactgacccaagtcctaaggatactaccaacctgcttatttaaaatagttgcaaaccatgaatttaaacacttccataaagcctaattcatctccaccaattcacaaaaaaatgccaagaaagcatttaccacatgcaatcactgttccaaagatttagagaggtttagaagagtgattgtaaccacaggctttggcgccatattgcctggtccaaatgtggctttggtgcatactaatcacagaattttagtctagttactggctgtgcctatctgtgcctcagtctccttatttgtaaaatgggaatgagcataagaagaataagtgggttgaaagtctacattgcctagaacaacccagcaaactagaagaacaccataagaatgcgtaattattattctttatatgtttataacattttttgtttgtttgttttaacagctccagacgcaggtagtatagtaatttttgccccatactgctgaatgttttgcctggcaaatactgggaatggggcaattcctgtggcagttttgttttccaataattgttttttcttatatcggggatgacaaatgcttgtcacaaagagtagccttgttgattacacttataaatcttcgggagacttcttcaatgagtcagtgttagagctttcagtttccataaatgcagatttcctttactcagttttcttttaaacatgagctgatctttcttagtttgcactataataccctccactgaagtctcactgcaactgcttttaagtatatgtgaagagaaactagccctttgctaaaatagttgcatgtttcacgggccagtgagtcatttagtcatacacttaagaactttccacctttcaagtgtttatcatcacctcggatttcacggcctaatgccagtcaatttcatggggcatagaagccctgtacgtattagtttgggccattattgtatcagtcttgtttattcccagaaaagtcttatcaagaaaagagggagtgactataatcagaaaaaaaaaaattcatttcagaaagggataaagcagtcctgccaccttgcttagtgctggctccctgtgtgtgtagagcttcctgactctgcatgatagcagagggaaccaggcagtgtaactcggcttagttcggtcagtccttccagccttgcatttctttaccaacatgttcatatttgggttaagatgaaaatagatatctgatacttgaatactgagacatacatattctgcccacttttacttttctgctacatatattggagtcgtatgctgatattgtttcagggtaattggagtttcagtctcaacatttgtctttcaagtccagtcttgtgagcagtttttgtttttgctttaatggtgctcacaattttgaggaatgtccagatgagattgtcaaactgtagtcaggactggccacctgatgttttaaaaggaaagttttatgggaacacagctgtgcccattcactcacagattggctgtagctgcctgcaagttacaatggcagacttgagtagttataacagaaactaaagaccataaggcccacaaagcctaaactattgaccaaccagctatttaagaaaatgtttgccaactccaggtctagatgttgtattcttaccacttaaaaatactttcgttataatgtctaacttgaataacgagattcagaaaaacgattaaatatagagtttattcaagtgcaaagcttgaggatgacctcttggaaaacatactccagacaaatggggttagcattaccaagtgaggaattgaaagtttcactcatataggcagttaacagggttgcaacattttccatacaaggtcagtatgtatattacagtgattttgttggttacagattgctatattccaactaagatttctttaacattccatgagcaggggtgatgatctgaggggttcctacctcgggcaccacagggtcttttctggtcatttacaggaaaaagcagaagttacagctgcatggtatgtgactcaggccacatacctctcaaggctcaaaataacctaaagttccaacagatttaagttctaattatttaatttcatcacaataggtaagatgaatcagttcttatatcagttagggaaatcacactagaggccaggcgtggtggctccagttagggaaatcatactagaggccaggcatggtggctcaggcctgtaatcccagcactttgggaggccgggacaggcagatcatctgaggccaggagttcaagaccagcctggccaacatggtgaaaccccgtccctactaaaaatacaaaaattagctgggtgtggtggcacatgcctgtagttgcagttacttgggaggatgagacagaaaaatcgcttgaacctggaaggcagtggttgcagtgagccaagattgtgccactgcactccagcctgggtgacagagtaagactctgtctcaaaaaaaagaaatcacactagatatttcagcagagagatttaatatgaaaattggttacacagataaaagagcaaaagagaaactctgaggtaactgagaaagtgtaactgcaggaaggaggaacacagaagatctcagatcaaagctctaaggtttataatccccctagctgctactggtacctccgtgaggcatgatgaagcaggttctggatattacaaaggaagctagaggctggagcaggtgctactgctgggtgcatgctgtcagcaagaaggaggaaaggaggagtccctcctcttctctaattgccatccaattttttctctattttctcctattaacagaacctagcaagaatcctgcagatgaggcttcttggaaatatagctgtagagcccttccccagaattactgagcaaggaagggtatgtatatttggaggtgaaagccagtaggtgactggctcaggcttacggaagtgtgctgacctaacagtagctagtggtggtctagaacctgagttgtaatagtctgacaggttcttcttgcccactgcacagataaaaccaattcactgtgacagtgatattgcaatagagaatttcatagtcacaggaacagccaagtgaaaggacaggagacagttctcaaattgactccctcaaagcttggaggttagggtttttaaggatgatttggcaggcagggacctagggaatgggtgctgttgattggttggggatgaaatcataggactgtccaaaatggtctttatgcactgagtcattttatgggtgacggtcacaggactggttgatttagttccttggtatgagtcacaggtccaggtggagtcagcaggtccaactgaatgcaaaagtctgaaaaatatctcaaagaccagtcttaggtcttgacaacttgacaatagtgatgttatctataagaacaattggagaagttacaaatcttctgacctctggaataatggctggttatcatttaactactagcctacatcttggcagaattcaggcccctcctatagtcctcactgtgtggctttttcttcgtcttagaaaggcaatctcagtcctcagagtgggtcagttttgggagggactattaccatccttgctgcaaagttaaactataaactaaattccttccatagtttgcttggcctgcacccagtaatgagcaaaggtaattagtttgtgaggttagaggcaagatggagtcagttagtttagatttctctcactgtcataatttttgcaaaggccgtttcagaggctcctgtgctcactctgtctagtcctatctggctaagctcactcctcttcctacactacagccacttggagttcacatattgtacttggagctgttggtgcttattttcagattgtctgacttttatgttttcattcaacaactatttattgagtgtctactgtataccaggcactgttctaggctgtagtaatataatagtaaacagaatgaaacaaaataaaatcagtgccctcacggagcttacatccaattaagggaggcacacagtgaacaatataaaaaagtaaaatgtataatcagttagatggtatcattgctaagggaaaaatgagtaatgctggaaagagtagtagagaattccatggggaagaaggctgcagtgctagtccagggaaggaatgcagcatttaaataaacacctgaaggaggtgaggaaggaagcactggccatatctgggggaagaacattccaggaagagcatatagcaagtgcaaagtctctgaggcaggcatgagcctggtgtgtctggccactgggtggccagtgtggatggagtggaaaggcaaaagaggaggagaaggaggcataggaggagggggaactaaaccccattaagatgttttatttttttcgaagtgttgctattctaggaaatgtgcattatactatttcaggtggacacattggaaaatgattatgtccctaaccaaagtttggtcacctggcagtcccaacattctacagcctccagctagatggcaatgcatttatcatatgcccctggatgtaccacagtgttctttttttttttttttgagacagagtttcactttgttgcccaggctggagtgcagtggcacagtctcggctcactgcaacctctcatgactcagcttcctgcgtagctgggtttacaggtacaccatgccaggatgacttttttttgtattttagtagagatggggtttcaccatgttgcccaggctggtctcgaactcctgagctcaagcaatccacccatctcggcctcccaaagtgctaggattacaggcatgagtcactgcacccagctgtaccacagtgttctattgttgacaaggtaaatctgctattgtgattatatgctaatgtcccttatgtatagtaatcagagaaacatcagtcttcagacattctctaattccattaggtccaatattttcccttcatactgaaaactgctgacttccaatatggaggctatggatggtgttaggcatgtattaatagaagggagaaagtgatattcactggcacttaggaaatgattagattgcacttatcctaaatatttttctcaatgtaattgtttcatgcttttttattaggatcatttttcattatgaacgtagtgaaacttaactggctgttattttattgcagttaaattcttaatctcaccgttaggtgcttcagaggaaagactcttttatattcttttttgtattctggttgcctaacatatgcttggaacaaaacaataatgtgcagtgtaacatatctacaggtgcttcttaagttctaagtcctgagctaagcatatgacatacattatcttgtttaatcattgaaaatccccatgggctattagtctcatgttatagatttttaaaatgaaactttaaaaggtgtgttagtttgtgctgctgtaacaaaataccacagactaggtaatttataagcaacagaaacttattttctcacaattctggagatgggaggtttaatatcaaggcattggcatttagggtctggtgagggccttcttgctgcattctcacacggcagaagagtagaaagacaaaaaggcttagactagttccctccagcccttttataaggcacctaaccattcatgagtggggagccctcatgacttaatcacttcaaatggttccacctcttaatatcacaacaaagatttagtttcaagacattaattttgggggacactcagaccatagcattcacccttgaatcccaaacttcatgtgcttttcgtacgcaaaatgcattcattccatcctaatagccccccaaatcttaactttttctagcatcaactcagaaggctagaggccagagtctcatctaaattagtttttacctaaattaggtgaaacccaaggtaagtttcaccctgaggcaaattgctctccagctgtgactctgtgaaatcaaataagttgtgtgcttccaaaatacaatggtggggtaggcctaggatagatatttccattccaaatgggagaaatagcaagaaacggttaataagtgccaaataaatctaaagcccaacagggtaaacaacattacatcttgaggtttaaaaataatctttgactccatgtcccatgtttcagacatgctagggtgggggttgggttcccaaggcctcagaggaccacccccacccccccagtaaggctttgctgggcacggcccatggtgcagctctcatgggttgaagtcttgtgcctgtgactctcccggctgacattgcatgctggtgactctacagttgtggggcctcaagggtagccttgccccgcagctccattaagcattgccctagctgggactctgcagtagcttctgtggcagttctcttcatgggccgctagcctttctgaggaatcttttgaaatctaggtggaggtagccatgtccccatgcttgtgcactctatgcttctgcagaattagcaccacatgagtgctgccaaggtttatagcttatacatgctagagtggcagctgagcctgcttgagtcatatatgtggcagctgaagagtgctgcaccagaatgctgacagcagagacaaggaggtgcaggggagtcaatgatgaggtcccatgggtgcccaaggctccttttttgacatagtcctttcccctaggccaagcttgtccaacctgtggcctacggacggcatgtggctggacggctttgaatgcagcccaacacaaatttgtaaactttcttaaaacattatgagttatttttgttttttttttttaaagttattcagctatcgttggtgtattttatgtgtggcccaagacaattcttctcacgtggcccagggaaaccaaaacattggacacccctggcctaggccgtggcactctgggcctgtgatgggagggacagcagcaataatctccaaaatgccttcagggttgttgttccattgtcttgatgaatagcatctggcttcctattctccatactaatctccttattaaacttaaacattgcttggccacaccctgggttttctctctgaacttgccttttagtctttacaacctggggaggatcaggccaggctgagacttttccaaatcttcccttatgattatgaactctgtctataatttgtttttctcttctcacattttcctataggatgtcaggagaaaccattcagcaacctgaatacatttttttcttctgccggatatccttgtttatcctctaattctgccttccagaagggcacagacacaattcagccgagtgccactttctggtatgaaaggccatttctctagttccaatgagatctttatttctatctgagatctcatcaaaagggtcctttactgccatatttctaccagcattctgatcacaatcacttagataatttctgagaagaccgaggttctatccacagctctcttcttcttctgagccctcgccagaattgtgtttaacactctgtggatgtaatctaggctttttctagcctgcacttcaaaactattccagcatcacccattacccagttccaagccacttccacatttttaggtatctgtaacagcaacactccatttctctggtaccaatttctttctaggtccatttgtcttgttataacaaaatacctaagaatgggtaacctttaaagaacagaaatgtatttctcacagttctggaggctgagaagtgccagattaaaatgcaggcaggtcagtgtctggtgaggccccaccccatcgaaggcattgtctctccaggcagcatccccacatggtgaaaggtagagggtcacaaaggcagcagcgagttccctccagcgcccctgtcctccacttttttttttttttttttttttttgagatggagtttcgctcttgttgcccaggctggagtgcaatggtgtgatcgcagctcaccaaaacctctgcctcctgggttcaagcaattttcctgcctcagcctcctgagtagctgggattgcagacatgtgccaccacgcccggctaattttctattgttagtagagacagggtttctccatgttggtcagtctggtctcgaactcccaacctcaggttatctgcccacctcgacctcccaagtgctaggattacgggtgtgagctgctgcacctggcctccctccagcccttttatgaagcactaaccacttcccaaaaaggccccacctcttaacactaccacaatgtatattaaggttcaacatgagttttggatgggacaccatctttcaaatcatagcaaagattcagtaattttcccaaggccccaaggcaagaaatggacctggtttcaaatccaggctctctgattcaaagcaaccagctgctcaatcccttgagtggtgtttgttgaatctatggagatgggtggcagcctgcatgtgctgctggagaatatagccacaggatgaagggacattcagtcagtttcttcttttacctccttgatttttcctccaccacccctgtgtcaaggctgttaatttgctaaagcaaattttggagtaacactcgttttatttctttatacccatcatagatacaagcatcaatatggaatgttagctgattaccatatggaacacaggaactttataaccagataactcttttgcctgtttttaacaactttccacagttatgtgccgtaacgagcacatttcttttgagatgtatttcattagccatttatttaccaaaacagtttatttttgtggagtggaaacattatatgtcaatttagtacagacaaaaaagtttagtatgaatgagtgacaatattcaaaatatcttgtaatcatacagaagcaattgatcaaagcaaggatatcccgtggaactatactactctcttatttggattttatcattctggaattattgtttttcagaaatgattttgacactacagcaaggattcattaagataccttaacactttgataagaatttattattagattgagccattttaaatgccactattctaccttttttaactaataaaaatggtattttcatgcggttcaagctaatagttgctttagctaaagaagaaaagtataaaattataaatctatatttttatttttaaattaaagatttgaaactcaagtttctgtataagctgatgggtaacatatgattaagtgctttacttggctgcacaatgctttgaactgataagtcaaatgaacatgtcccaggccgaactaagaaaaccatgcaagcagccaaagaccttcatctgctgccgcagcagtgccctgtcagtgagcaagtagacaaggaagacgaatcatgagcatgtctcataagagtttgacaaaataggttgtaacttggcagccaactatgaacttgctaaaggtcaaaacctggagttggcactcttgtctcacagaactcgcttatctagatgtttcaaaaccgtcttccaatgtgccctgcttatcaaatggcaaggctaaaaacaaggaacatttgtgttgctctgcttgctccaatttagccgctcttctcttggactggcagctaatatgtggaaactgggttgcagggttattctaacgcagccgagtgaacctcacacagaccagggtaagcctgggccttgcagggatgtcctgggctctagcaagtgtggcatcagagttgatatctgggaaatgagcttatggatccaattcacagggagccatcatgagcagaagggagcctgaatgtggtagagatgatgggttttcaaaaactgtggactaggcctggtgcagcggctcacagatgtgaggattgtggatgtcaataaccatctatatttcaaattacatctatttcaaataaccatctatatttcaaattacactaatttagggtgtgttttaagtactttttaaactaatacctcttgataacagagtataactccttaatagtatttttcaaatagtactcactttttaactatttgatgcatgaaagagtggttggatgaatacaagcaattgagagcattttgtgaacaaatccagttactattctcaatatgagtttcaaatattttctgtagcataaggctttactccttgtttgaaggttggcaaattcaaggactgattttacccgcttgctatatttctactagcaaacacaaatctcctactaacttttagggatgaaatgcaggagtaaattgaccaaaaaaaaatactttagtttttttaaagctctctttaacttattaaatgaacaaggtttaaataaaatcaataaagtaataaagtgaaatgtggcatttttatttcttgaaacaaagttgttttaggcaggtacaaggctattatcagataagatctgaagaaataaaatcttttattaacctacaacttgaacctgtattttctttattatctttacttataatgatgaaagcagaaagctttatcatttttaactgagggaatggcccacctcagaagtcttcttatctgttttttttctttcaacttttattttaagttccagggtacatgtgcaggatgtacaggtttgttatataggtaaacatgtgccatggtggtttgcaacacagatcaacccatcgccttggtattaagcccagagtctgttagctattcttcctgatgctctctctctgcccacccccaaccccacccccaacaggcctcagtgttggttgttcctcgccatatgtccatgtgttctcattgttcacctcctacttataagtgagaatatgtggcatttggttttctgttcctgcattactttgctgaggataatggcttccagcttcattcatgtccctgcaaaggacatgatcttgttccttttcatggctgcatagtattccgtggtgtatgtgtaccacatttgaagaaataaaatcttaagaacattgtttgaaagagcattttctgtaagaaaattacaaggaaggcatttcctgcaagaaaattaacaagggacagggctactggcttcccagtcccccaaattgtaagaactgcagttataggaattttataacggtggctgattttgtgagtgtatgtttgtgtgtatgtggaaaaagtagaggatttgagaaaaaatactttaagctcttttatcagtggacatactctgggattggagaagaggaatcacgttggcttgattatgcttctaggatgatatcctacattaaccaataaaaactctttgagtgtgtgcctactgtggaattgaactgtgttaggtgctaaaggttgacgtaaaaattaaaacgaacaaacagcaaagccttgtcttcaaagactacatggcctaactgaggacaccacatgggtaggcagagcaaaagagttgtcaactattttgtcattaaatgacaagagcgaaatgagtagtgttggggcaaaagtcagagggggcagaactagtcttcatgaaagagatgggaatttgagggtagtgattatgacaaccaggaaagcagggaagacactgcagagaagtggtttagaaaaaggagcagaggtggaaaagcccaagatcttctgggttcagtgggctggtcataagagtgaatgagagggtccctgcaaggagagagtgacataagacagtcttgtgtcggtcgtggagggctgtgagtttcaggctaaggagtgttaatcttgttcctgtaggcaatggggaaatattgaaaacttttggcgaagggatcaccagaatgaaagtagtggtttagaaaaattattctagtggtggtgcagaggagggagagaattgggagaatctaatgtcagggatacccagaaaaaaaatttccaggaataatcaagagggtcaattagatgggcatggtggaaaaacagacagaagtatcaaaaatgattttcagactttgaatttgggtcaccagtggtagaatatagaaacacacaaattctgttaatttcaaagaaaagtgatgatattaatgaagctccctgaattgggtgatcagcatgtcctaagggtctctgagaagcaggagggcctgaaactgggccccaaagcctctgaaaaggatgatctagctccaggccatccactacagtagtcgttgaacacctggccacacataactattgacttaaaatgtacctagtcaaattgagatatgctgtaagtataaactacatatcagatttgagagttagaatgaaaaaaagaacatgaaagttctcataaaatttaaatattggttacatggcaaaatgatattttggatgtattgggctaaataaaatgtgctactaaaattatttttaccttaaaattttgtttcttatatagcttctagaaaatatactcacattctatttctataggacatagctgatctagaccttcaaagtaaagcccactaatatagcataatacagcagagtgaaacacacacactctcacacacttcatagttaaatgcatgtttactccatccattcagtctgaagtcttttaaaatgtgtcttgcattttgtgagtatatttctgaattttttgagcagggtatattgtagagatccatttgtttattttatccaaaacttaggttattccatcttactgaaatgaacatttggctctttctttcaaccagcagatgatgctacagctgacagtcgcaaaacttacactctaactgattacttaaaaaatacttatagactgaagttatactccttaagatggatttcaggtaagaattttttggggtagggcagattttatgcttacattcattctagttaagtcgagatgtgggcttttatggcactgagaagaggtaatccttgtttttaaaaattctatagagagttttttttttctttttctacttgaagtgcaaagggagaaagactgaaaggaacccaagtatttctttgacatgtataataaaaaattaaatgtgaattgaaaccttgacaataatgatgaaaaaatgaatgaatgttagtataatatcattcatgttttctcaacttagaaatgcctatttggtatttgtgagcttaaactgtattctgtaattttcagcttatgaagatgtttaataacaacttgaaattttgatctgggtgttttctctctttagatcatgaatatctctacaaacaagaaaataatatcttggtattcaatgctgaatatggaaacagctcagttttcttggagaacagtacatttgtatgtttaatcacgtaattaattcatgcatagaattctggggatttttttcattacctttggaatcacgagtactgtcatttctcaacctgttggactctttctgcagcatatggcaaagtggatctttctctccttcttgaaatgctccctgccttggctactttttagtctcctttgacgattcctcttcctctgcccatatttttaaatgtaagtgctccttggggctccatcttcatttgcctccctcttcactttgcatgctctcctttggtgaatttcatgcaaccccacagcattactgccctcctctctggcttgactctcgtatacacacacttaacgctaaccttctcccagatttaaactttaatttctagtagcctgctggttcctacatgaggatttcaaactcaaaatcccaagctaaactggttatctttcccccactgtcctagcacactgaaagcatcttattcttttttgtgagttcccagtattggtaaaagttacttaattctcctccaagtcacttatgctagaaacctcagaatcatcattgactcctgtcatcccccatagttggcgacaattctccctctgcatgtcaggtatctctcagtttccatttccactggacagtcctcgcttaaaccctcatttaatcttgtggtaatgagtgctctaacttgtgtccctatctgcattctgtacaccagaccactgcactccccatatctaggctgatatcagccctccgctcttccctctcatttcagccactgtgtcaccagagtatctttgtaaaagatagatatgattctatcacttccacatgcaaaaaaatagatctagttccacatcttatatttaggtcccagctatttttctaatttgttgtcctctcaccttccactctgtctgacaccagcgccccccacaaactatattcaggttacacatgacccttaaagagtctctaaacatccacgtcctttcccatgcctggcattttgcttacgctattcccactgttgagaaagttttcttttcctcatcctcactctcgcaggcatctttcctcttaggattaatccttccctttctggctttctaacattgatcgccacctaccttgcatcacggtcatttgtgtgggtgaatatgccacctctgctagattaggacttcccaaagcacaagccacatgtctagaacagtaccccctatgaagtaagtgcacagtgatggcaatgaaatggaattgttcaatttttctttgttcttcttgtttgacaggatgagtttggacattctatcaatgattattcaatatctcctgatgggcagtttattctcttagaatacaactacgtgaaggtaaaataaatgctttcttactgtaacatttaaataatccaagagtatgctatgttataaccgatttcaagtgtatggatacttaagattaatatctaagtaatgtaataggcactaaaactcattaattcagaatcagagtcattctcattcttaaagacaagttcagtgttttaaaagaaattcatttttagtgctttcaaatactagaaagcacagttaatattatattgttctaatatatactaataacataagtcaataaaaatttgtacttacacacatatttaaaagtaagtttacatgtctgatttgtacacctaatgacagaaccctttatttcctttgtcacagctttatgtatagtaagagcctccatagatatgtgtttttaaaagagttaaagtcgggcatggtggcatgcacctatagtcccagctacttaggagggaaggctgaagcaggaggatcacttgagcccaggagttggaagctacagttacctatactgtgccactgcattatagtctagaggacagagtgagaccccgtcaaaaaaaaaaaaaagaaagaaagaaagaaaaagaaaaggaagagttaaactttccatcctccagaaaagattccgcaagatggcccagaccatctcccaaccttcgggccccaccatatacaaactattctaaggaggagagcctcaccacagatcgtaaagattccatcaagagcactcagctttccccagttacccagctcaactccacatcctcacacattcaggaaaggttacagcttaatcatacatcctcttcatgtttaggatggatatgggtggccataactttaactacagctttttggttactcatggatttgacaagttgttcaagtataggaagttttgagacatgtagtgaagattacaaatttgtaaagataccctgtattgcaagcaaaatacaaagctggggattcccacccctgatcttccttttctaggataaataatattgaggagacaccaacactcacacaccaacactcacacaccaacgctcacacaccaacactcacacaccaacgctcacacaccaacactcacccaccaacactcacacaccaacactcacacaccaacactgctgtactcaggccaagcaaaccattccctactgcatttaccatctcaggatggtgactgttaatcgtaatatttaccctggatttgctgggctgggctcactctcctggacatgaagactctatgttctgttaaaattaactgtaagtgaatcggaatcttgtaccaactttgacacatctgttgccaattaatggattattgtttgtttaattaagtgcttcttatttctatctatagaatacattcacttaatttacttgagaaacttttaaaacttcccagtgtccaggttcaatccccagatcagtaaacagaggtttctggggtaaagccagaatcagtatctttttttctttttttgagacaaggtctcattctgtcacccaggctagagtgcagtggtatgatcatggctcactgcagcctcaacattttgggcttgactaatcctcctacctcagcctcctgagtagctgagactacaggtgtgcaccaccatgccctgctaattttcaattttttcttagaaatagggtctcactgtgttccccaggctggtctcaaactcctgtcctcaaacgattctcccacctcagtttccccaagtgctaggattacaggcatgagccactgtgcctgatgagcctcagtatattttaaactgtcataggtgattgtaatggcaaccagggctgagaacccctgaataacagttgtccatgttaaagactaacatatgaaggtaaggtagaaacagaaaggtaataccagctcaccttactatatagccaggttcaacaaaagccatttgatgtgcacgaatgcgtgtattcccctggtggcccttagttggccagccacggttggagatttgtatttgttgtgtcactggagtttacccgtgtatttaactgcttttgcttttttcactctgtccccttccccctgccatctatgcttcagacagtatcgaaagtactacttttaaattctaaattagtttatgccacacctatgccacctacagtgccttcccatcacactcaaaataaaacaccagctctaaccctggcatcctgaggcctgtgtgattgaacacagtctgcccggctgaacacatctcctacccgcttctcctgcactcggcatgcttggccagagcttctcgtctcatctgcaccttaggatcacttgaggagcttttgaaaaaacacggatatctgtggcctaccctaaagcaactaactcagcatagctgtgggcctcctggagattccatgatgctgagttgagaacctttaattgcacagctctttctttttctcaagcatcaccctcattcccatctaaaggcaaaatcacttgctattgcttcctcatggaagcttctccatcatcatatgcttctctctattaactcaggtccagatttcttgggtcactttgtcaaacattgtcccctgccatgctcttccacccacaccccacaaatcagtctctgtcacgttaacccattttagtttcatcacaacattttgtgatattttgtcattgatttctttgcttattttttgcctgccttatttggtgccagtttccctgtgatttattcactgccacacctctgtgcctaggacagggccacatagcagatgctgaacatcattgttaaatgaatacatgttttattgcaaagtgctaaattataaagctattgaaactaaggatctatatcttctactacttttctttctttttttttttttactttcaagagagtccagtagaattttctgtacagcatatacgttttgactaagtgactcttatgaaatgtatctagaaaaaagaaaagtctaatttgattacatttccttggaggtctaccttttagtgttttttagatcctactatgtgacttctccatgactgagttagtgctatcacttccaagttgtggctacaaataaataaatgagcaagtgagtgagtgagtggataagtacccccacagtctggtatgaatgttctcctagcatctctgctcattgcctagtgctctggaaatagagataatagttgtgtcatcgattctatgttgacaatgttccagaaccctgctaagtgcttctcatgcattctcatgcatctgagattgttgccggcattatcctcatttgtctaaaaagaaaatggaagcttagaaagaaacttgcttcatgttacacagtgaaagcctgaatccaggttagaagactccaaagcctttgctcttaaatgtgatctttcctatctttgcattcggcttctctttgctatgatgctcttttactctttcccagtcaccctctgtcactaacctcagccaaagaatcatcttttccataatcctctctgcctccccaaggcctaatttatgattcctgcctctcccacccacctccattatatctcttggcacatcctattgtgattattttattgtcatttactattgcatatcctccattccactataagctgctccaggggagggactctgtgttatccagtaatgtctgatagatgatagctgccagtgtttataaactaaatagaataatgaatctgtttcaaaagatgaagtgaacataccaaacatcatgggttttcttttacaacccatggtggtttgtcatgctcagtgatctcaatccatcttaatagttttagctggtaccacaccttttggctttagtgaatattttgcttgaggttgcccagaaacaagcatggggtgtgtcaaaataatccaggattcaagaaaggaatgtatgactcccgaaaagtagaatttaataaatatttgttgacatgagagcatagaagggagagaagtgataaatagttaaggttaggaactctgactttgtatctcagctctgctattatatagctaggtgtccttgggatacctatttcatccgtctcatcctcattgatacaattagaattttattgtaatttgttgtatttcttgaacactcactatgtggcttgcactagaatagactccaggcatccaaagataaataagatacaatttcttacctctaggagtatggtaaagaaggcagacgtatagacaagtaacttatttgaaaatacctttaatttttatatgcatctatattcagacataatatttcataaatgcaaatatgtgatcatatacatttttatcttcggtcttatttcttcccttcttcacttggctctctaaagtctaatatgtatctttccatatttttatatttttcttcttgttcatataactgaaaatatatagggatgtttttagttattgcttggtctataaaaataaaatcctatagttttttgtaaattgcatttctcactcaatgataccatgtgaaactcctttcaagtcatctggttagctctgattcatttttttttaattaatatcactttatttttcagaacagctttaggtttatagaaaataagcagagagttcccatatactcccttatcctccctcccccactttcccctattattaatgtcttgcatgagtgtggtccatttgttataacaaatgagccaatattaatatatcattattaatttaagtccatagtttacattaggcttaactctttgtgggttttggcaaatatatggcatgtatctaccattatggtggattctgacaaatctatggctcttgacaaaagtatgatgacatgtttcaccattatagtattatacagatgactttgactgtgctaaaaatccctgtgtttcccccattcatcccttccttcccccagtctccaagcaaccaccaatctctttactctctccatagttttaccttttccagaaactcatattgttggaatcatacaatatgtaaccttaccacattggcttatttcacttagcaatatgtgtttgagattcctccatgtctttttgtggcttaatagctcattcttcttatcattaaataagattccattgtatggatctctactacagtttgtttatccactcacctgttgaatgacatcttagttgcctcccagttttggcagttatgaataaagctgctataaacatttgtgtgtagatttttgtgtgggcataaattctcaactcatttgaataaataacaagaagtttgctggtaaagttattttgccttggagttttctctatgtaaagtttcttatatctggattcaatttgtttattagatataagactattcagaatttttctcacttttaagaaattatttttcaagaaattttttgcttttctctaatttttaaaatgtattggcaaaaaaatgtttataatagcctcttatgatcttttaacatctgtggagtctgttgtgatatcccatttttcctttctgataccagtcatttgtgctgttttactcctaagttttactatgtttgcaattttactagtcttttcgatgacttgagttttggctttgttgattttttctattatgtgttttctactttatcaatgcttttacctttattatttcatttcttctaattactttggatttagtttgacttcctttttaaaaaaaaattttatttccctatgcttctgcagtcactgaaaatttgactttcatttctagctttttgagatggttgttaaaatattgatgatatatgtattttaattttaatatatcttgccagggggcttccaaaaactttataacactttacctttcatcatcagtgtatgaagttaaacatttcttcacatcaccatcagcaatagcatcatatatcgtttaaatcttttgccaataaagtaggtgaaaagtgaaaatttacatttttctaagtaggcaatcttagcacactatggtgagtgctagggataatgtttgtacaaaatgacatttttggtgcactgtggtcctggaggaggtggtgccagagctaggttgtagatgaactccagaggagtttgtatgagatgatctctaggatacttctgaatcccaaaattctcggaggaaattataagatatgataacatgtgagaattatacaatcatatattaccaaacctatcatcttggtctcctatagtgagtggccaaattatcaagtatcacagaagcctgaaatgtctgttttctttcatagcaatggaggcattcctacacagcttcatatgacatttatgatttaaataaaaggtcagtgacttcccaataaaatctattaggctttcctactgtcatatttttaaggaaaccccaatgtgagttattctttttgataatatttcctttcatcttttttccaggcagctgattacagaagagaggattccaaacaacacacagtgggtcacatggtcaccagtgggtcataaattggttagtgagtctctccagttgtcagaaaaatataggctcaaatttttcataggcagaagttactaaccctgatacaaagcagacatcttaggaactcaatacttcactatagaacatagtgttattgcccaggatctaatgtttgtctgcagctgaacttctctcttccagaatgcaactgccttctctctactcactctcccaataaagaaatatacaagcatatatcatcctgtagaagtggtcagccttctcggtcttctcatatactttagcattcaaatagtggtagttatgtacttctcatttttaacacattattaatggttttaggattattttgggattataggctgtacacttgtaatttaagaatgagagggaaggagtaaatgactcttcctgtttgaatggaatatttgactatggtaatccttacatttgcaatagataagtgtttctacaattccgggataaaaatatgacatgtattatagatatcaatgcttgttttttttccttctaggcatatgtttggaacaatgacatttatgttaaaattgaaccaaatttaccaagttacagaatcacatggacggggaaagaagatataatatataatggaataactgactgggtttatgaaggtagaaactttaaagctttttcaaatcagaaaatctataagcttttaaaatagttaaatgtttcttttgcaatgggaaaatttaaatgagattgaaaaaaagtttcattgtttaaaatgtcatcagatttctcttagaactcacagcaccagatgtctccttgaccaagaatttaactattcctagcactcctctgtcctcattgcctgacaatactcctcttgtctctgttatattgatacaaagggcttttctgtgtaggtagaccttttctgcctttactggaacataaaagcctccagattaacatcagatatttctctaattaagcctacctaacccgaaagttactaaggaaagctaaataatcccatcacattgagaagatgataaaataatatatacaggttggagagtacaggggaagaaaatgcctattttatagaggatttgtatttatttgaacttggacaaattatgatttcctgtttttaagaataaaaaagcaattagaaaggcttaggaaaaagtgactaataaaactaaaaaagttaaaaaggaatattctcccttttaggatacagagttgtcgaaactattaggaacacattttagaaacttagaaaatattagaaaaacattttttgtgtctgtatttgccaagataaaaggcattttgaggctgctccaaactgttcacaaggtttcctcatacttattagaaagacttatctgtatttcatcgtattatttttttcttctttgtagtttaaaaaaataatttttcttcatgacttaattttagttcttaccaagtccaagtcaagtttagttgactcattataacaacaacaacaaatcacattaaaagaaagataacttttcatgtcctagaaataagtgcttgactaaaacttacaatgaaatttactagcactagctacttagagattctttaacccttggacagcacaacccagcctccaggatccttgacaagagtggcctctttccaaagctgtgaccctctctcagaaacagctggccctctggaagataagagggcagctaacactttcattctttctaaagtagataattgctggagggagtcttttgcatgttcacgactaggccattcacatgcagaacagcttcacagctccaatttgggcctctctaatagcttcagttcctagaaggaaattactacattgtcaatacagaaaaatatgtcctgcattccaaataaccactaattcaagacaaacatcactacctgctaattacacttacaagtaattctaaaaaacaaaatcttggtctgattatattgattttatgtaattgcagctgtgttatagaccagaatcaatgggtaaaagttgcaaagaatgagaagtcaactcagtatatgaacaagttcttactataatagaaaccatgacttggagtcataagggctgggttctagttcttgtctcaggcaattcactggattgctccatgcctcagtttccttctttgtgcaatgagctatgaatcaccacccagagactaaatatgatatgttttgtaaattctaaattgctacataagagtgtatagatcagtgatatagatatgaggcagtcaaaggaagaataggctgcttaacccggaagtaggttttctattactggaaatactaaaatagaggcaggaaagggcagtatagcactgagatgaaaagcatgagtcaaaggagatttgggttggtttttgattctaccaattcttagccatgtgatcctagacaaatttctgatcctcttcaagcttgtctcactttatcaatacaatgggttattgtgagccttaactgagatgatagatgtcaattgcttatcaatacctggcgcatagttagcactcattgaatgtcagctgctcatcacaataattattattacattttattacagtaattatttttgctattattcttgttgttgaaaaaaagcatttggaagtaacttgaaaggaggtatcaggcatctgaaaactgattagaatgcatgatttcccaaccctaagattctagtttctatgcttttgcttttacatttacacttacatgagacttgtggaatatctaggcgtctccacccagtccacttaattcctccattcccggttggtgaaggagttttcaacatattaagagccagtgattgaatatctcatgtatagaccccataataatcatagggaagagctatctttgccagagattgagaagaagcccgacaatgtactggaaagcaagatctggtcttttatttgcctccctctttgaccctcttctcttacccatcagcatatacaccagagcagtgtgttaatctaagggagttttcagtttctgggctgggcaaggagatgtttctcagtaggggtctcaatggagttccttgccattctaaatctatccttcccacaccttgtttgtgccaagagtagtaaactctgggcaccatattggtttgatagcctggagctacacaccacccaccagtaccctgcgggctcagtacaaactgagcccagttggggagagtatgctggcatgttgactgtttgaaaattagaaaggagaatcagcctcctgtgtgaaatttacttttagtatgttttgaggcataaatttagaggattataagataaagaaaaaaatgtagagcttatattaaatattgcatgctaaaatattctaaaatggtccaacgggttacttatttttacaatccagatatatccttgaagattttatttttattcatttgtattactctgattttggaagcccagcaaatgcaaagtggttcattagttgaactctactgtaattactaaagctaatgagaacaatattttgaatgccaaagccaatttatcagctacttcttgtaacagaacaatttatgtcttttttcagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggtctgtgctcctgtttgtacagtggttccatgatttgatgggaagagaatggtttcatttaatcccttcttgctaatgaaaatattgtcagtctctcttcaacagcttgctgtgattactcttgctgaagtcaacagcatctggcaattttaaagtatttttattatcccaggaaagagtgtgatttaaggttttgtaatttctccaaaaactttgaggaatgacaagcagaaaaaatggggaaaatgctttagaaagagataaggggaatgaaaatgcttgaatggaggaaaagagaggctataattgaattagaagctcgtctcatttgtagaagttggattgtgccctcgacgaagttgcaaagctcagttatatatcagattgtattactggttaacgggatacatgactagttttagtggttctattatagatttggcactaatgtaaatttttcatgtcctacatttggaataatagtgtcacgtcttggttttcaaagctgttctcctcgtcagggttgcgtgtttactaaaattgaggagctttgttaagcagcgtaagccgggtgagatggggtttagaagggaaccaggaattcttcactagtaccgtaataataatggctacagtattgtctgcaggagaatctaatagtaaagtgttttttctgtaagaaatttggaaaaggggatttttatttttaccaactcactcaatttgctttatgaagagctgccattttaggaagacagaggaagttaaaagaaaaaaaaagatcagagactaaatatggagatgtgttttcagtggaatgttattttttgatgagcgaaactggcacatacaaaaaaaactccataaagtgttctcactaaaaatatcatattatttctaactaatctgtcaatcgaagatctatgtgtatatttaaaaaggttttataggtttcagtcataatattgattgtaaagctccaacatagtgaacctgaatttagagtggaaatgatggcttcctaattgacaccgttgactcaggtaaactgatttttctggtggatggtgtctttggcagaacccaaggtgttcttcatactgacaggcatcaaagacttttggtctcagggagacagggtatatttgcaaataataaagttgattttaagaggtttatccttgcttgcacaaagtgataaattataaagatataaacattcattatttaaacagaagtgctttggaccttcaagttttatatagtgtgtatatatatatatatatatatatatatatatacacatattctgtttctgcctgaccatgaaaaggttgcatttcatgactctcccttatgttcattttatgtatattaaattgttggaacatgtctgattgtgataattttatgaccataatgcagacgtttttgtgcagttttaaaatgtgtgcaacgatgttacttttttttttttgtcaataccaattctgtgattattttttcctaggcaggagctgtgaatccaactgtaaagttctttgttgtaaatacagactctctcagctcagtcaccaatgcaacttccatacaaatcactgctcctgcttctatgttgatagggtaagactcttgtcctgaatgcttggcttgtaaacagttttacactttctagggagaacttttcaaaagtgaatggcaaagtggatcacagcctcccactgtgtcatccccgctgacagtcattcattctttccttcagcaactctttgttgagcatcttcacgtcctcaggctgggcacaactctagagatgaggatgacaatggacagagcagccagcccctggtgttatggagcctacattcaaattgggggagacagacaataaccagataaaaaaagagcagtgtaatatgccaggtagcaataaatgtggtgaagaaaacctgagcagagcaaaatggatggggccgatgaggggaggtcagggaatcctcatggataaaatgaactgtggcagtgatgtgaagagcaggagggctccatccacaccaatagcagggggcagaggaagagcaagtgcaaaggccctgcagaggagatgtgcttggggtgttggaggaaatgcaaggaggttggggtgactggagccttttgactgaagaagagagtggaagggacaaggtcaggtcccaaagagccttgtaaggcctagagaaatgcaggaaatctgtggattaagtttagggagctccacggtcattttgtgctccaagacttcacttcctgaaatcatgtcagtggtttgaaattccgccatggagcaccttcagccccttgtttattttcctgtaaaggaaccaacatactgggtacaatttacggctctctgatagctccatatttactcatttctgttatttatttggttttgttgctgtttttttttttgttgttgttgttgttgtttgtttgtttttttgagacagagtcttgctctgtcgcccaggctagagtgcagtgatgccatctcggctcactgcaacctctgcctcccaggttcaagcgattctcctgcctcagcctcctgagtacagctgggattacaggtgcatgcctggctaatttttgtatttttagtagagatgaggtttcaccatgttggtcaggctggtctcgaactcctgactcatgatctgcccgccttggcctcccaaagtgctgggattacaggcgagagccactgagcccggcctgttgctgtttttaaataacaactagcatacattgagtactcaccatgtaccagacacagggattatcacatgctttatcttaggactctttaaagtcagtctgtctttccaacaactgtcatcgtgtgcctgttcacagataagaaaatgaggcctacagattaagaaaatgaccaagtacgaatctgtattcaaacctgactttctggcttgaacgaacaagctattagatactgcttcgtgtctccctctgtgtgattacagctggtgccctcagattcctgaaggcaccatcacagcagtacggaagcatccattttctctggagttgcattaagtacatcaggaaggctgtgggctgtgctccgtggttagtaattcattattttggttagaaatgtctgtagtaacccattcattcagggggaaaatcgattagtaagtttttaaaaatgtttctgggtttgtccaatggagtaaaaatttacccaaaggtttcaaagtctgcctttcgattccatccagccacctttaatcatcatcattgatgggcagcctctgtttctactcccaaatgtccatagaaagcctgtgcccttgtagcgcttatcatcagtagatgatagaaaacattcagataaatgcccccaggagtgataagagagatacgagcaatagaatggaggcattctgaggaggagaacatggggttttcacgaccccaggaacaaaaaataccccctggagaatgtgcagattgagcaggttggcttccagcagggtgcagtgaggaggaaggacactgaggcggaaaaaacagagtatggaaaagtcagtgcttcccaggagaagaccagcagagcctggtgtggccttttggtctgtcaccaatatctgcctgtagggaggatgagccatgagcacctgctctgaaaaagattccatcggaaaggggctttagaacttatcaatggtttataaactttttaaggacctggaaacctttgttcaagtgagatataatatagaagtgtatggccagaaagcaaatgggagattgcttctcagttttggcaggtctagtccttgtcctccctccttcccgcaatagtcctgggagcttagacagaacctggagtggttccaggacacagtcacaacaccgctgtgaggtacaggtgagagaaccgaggctcagagaggtaaagtcatttgctcaaggtcacacagcaagttagtgtggaaggtgggaataggaccaaggcctatgcctgctggaccaaaatatttgaataagttagttaaaaatgtattgagtccttctcatgggctgggactgtgctcagtgctctgctcttgctgtctcatttattccccaaagagacgaagtctttcccacttacagatccgtttccaaggcacagctgtgtgaagtgctgggctcaagaaacaagcaattctcaggacggatttttggccttatgtgaattcgtcaataagttcttgttctcagtagttctttaagtcacacttaagactcactatggagattttgtgtggaatgtatattaccaaagaatattgtttttttggaaatgccacaggaatgtgttttttagggagtttaaaatatagctctggtctctgttaacgctggtaaggttgcggttaaaatatagctctggtctctgttaacactggtaaggttgcggtttttctagaactagactctagatgctctctgggaaaaatgctctagtacatgatgatacaccgttttctggcctcatgcaaagatccagcagggccaagcaaaaccaggtgagttacgcctcttagtaacctgctcagcctgttacctggtgatttactagttcctggagtgggaagcctggccaggatcagtgcctctccttcctctgcccatgttaccctcattagttttcctgttaggccatatcccttcaccacagagcctgcagcaagtgaaatccacaggaggatgaggctggtttgtgactttgttaggaattagcagaaatgggtggaagccctgcttctctgataagtgagaagggcagccaggctgcgtttccaacaactaaggcctgaacttgaaccagggtgagtctccctgctgcctgcattgatttagtgctaaagttgattagatttgttatgatgctattttgtgttcgttgttcataatgagaactggaaagctcaaaaatttgaaggaaaacagcacataatgtaaaatcataaatctcctaacttttatctagagcagtacattcattgttgactgaagtaagacaggttctacgcagtagaggccaatcctgcaatcgtatctccagtgtgtagtagggtgcctgcgacatagcatatgcccaaccaatatttgtagaataaactaatagataagcagaggatggatggatgggtggatggatgaatggatgagtaagttatctagatggctttgtgtgtatagaatagtggttcacgctgccagcactatggatagacttcaaaatgaccttgcatagaaatccctccttttatctcctctctgccaaaaattctgtggcctgaatctaggggattggaaagggcatgttctactgtagtaaccccacccaacatctgttgaatggctctggggctcatcacacccagctcatgacataccccatccctgctctctctgctcctggatgacacaatagatataaagtcttgctgtgtcttctctgaactgttacgacccctggcctataaagctgcaacatcaaagcctcagattgtcacacaggatataaataaactggaagctagtgacatctgcacattaggacctgcatgctacgactgtgcgggtgtacgggtgctgcagccctcagatctgcttcatctcatcccacccattcctctcctgagggatttgtcagcgaacctgggagggttggcatccccatcagagcagagggtggcatggagcctgaggccagcactggcagtatgcccgcttcctcgggtgattcactgaattaatcattccacggttgcagttgctctttgtagcatttttccctccaatatgatttccagttgatgataaataccttattttaagtatccttaatgtaccaaaagaaacatttacacaaattaagggaattaatattacccaacaaacatttattaaatgcttactgtttgcaaggcattatgctgggacaggtggtcactttacaaggggattctctgttgtgtgattttcaacaagtctctctcagtgcattcacatataatttgccttataaaattaatttagtttacacacaagctctctaggaatagatttctttaagtgaggaactttatgctgaaaagaaacaagaaggtgaagctagctagcaacattttccaaatggatgggtggaggtttcatagagggagcgagtatgaactgggaatctgaagccaacagcttgaattgaatcccggctccaacacttcccagttgggcgatagtgggcaagttacttaaatcctctgctgttaagtttctttgtctgcagagcatgatctgcagtactcacctcatagggtggtcatgagcttatgtcaagcacttagaatagttcctggcacatagtagactccacatgggtgtgaacttattattttacatccagaaattactccgtcattttagtattaaaatcaaccatattcccgttggactaatccagctgcagaaggtagaagagcttgctggctcatatgtctaacctgggtaagttgtccaggctctcaggaaggcctggactgcaggggtggtccctcttctaccccaccaaaaccattacataagaaagctactcagtattggcctgtttttgcagaataaaagcagcatgcagtatgcaaagcatagatgataatcctgctggttggatttttctggttttaagtgggacttaaacttttcagtaaaaagtacaattgagccattggctttatttatttattttgagatggggtcttactctgtcacccaggctggagtgcaatggcatgatctcggctcaatgcaacctctgtctgcccggttcaattagttctcctgcctcagcctcccgagtagctgggattacagatgcgccccaccatgcctgactaatttttgtatttttagtagacacagggtatcaccatgctggccaagctggtctcgaactcctggcctcaaatgatccacctgtgttggcctcccaaaatgctgctattacaggcatgagtcactgcacctggcagttttttgttttttttttttttaaatgattctttgacatctcagactggcataatcttggctcaaggctgccactgaagggaagtatgtttataagaaaattcaaaaattcctgtctgcgccacgggtgaactgccttgctgagcatgcacagggtgcagagtacacctggggtcatggagagtaacccaggccatgcagagtccaggaccataaacctttgatctgaaaatgggcagggaagatgactgatgcacgtgagtttcctggctgacttcccaaattccattactcaatgttttcaaatggggaaaggttgcttttatattgctgatttctgaacctgatgtttaatttatgactgttaatagataaagctatttagtactgggtgatccactaattattgtcaaaaagttgttccccccatcacataccccttcgctctaccagagcacttttaaaaagaagaatattgctggagcccaaattcctaatctatgcccatggaattttcagatgttgtatgtatgtcagtggagaggcttttcccacctagagagaggtacatcagtttcatcagattgtccaaatggtttttggcctgaaaaaatagtaaccactgatataggacaggggttaacacactagggtttatgggccaaatgcagtccactgcccatttctgtgtggtccacaagtaagaatggtttttactttttttttttttttgagaccgagtctcactctcacccaggctagagtgcagcggcttgatcttggctcatcacaacctccgtctcccgggttcaagcaattctcctgcctcagcctcctgagtagctgggattacaggtgtgtgccaccacacctggctaatttttgcatttttagtagagtcagggttttgccatgttggtcaggctggtcttgaactcctgacctcaggtgatctgcccaggttttacatttttaagtggttgggaacaaaaatcaaaagagtaataatatttcattatacatgaaagtttaatgaaattcaaattttagcttttcagtggaatattaaatgaactcattcatttaattatggtctctggctacatttgtgctacaaaggcagagtggagtagtgacagagatgtggaccacaatgcttaaaatacttaactctctgacccttaattgaaaaagttttccaacgtctggtctaaaaaactaatttcagaaagcttcatttttctgttgtgcttttcatacttccattctctttgcacagatttattgcctttcttgggtaaagtgtattcacctttccaggttctcatttagctcccctgcattgggcagatgcagaagcgtcagactggatgagatgtctctgtttcccggcatggaaagtggcagttgcactctcagcccctgcagcctggcggtttgtgatgagtgcaatgagacctggcagagtggtgtgggagaaggaggtttccaagaagacatcgtggatgaggggacatttaggccaagacctaaggaagttagagcttggcagccacttcaggctaaagagcaagactgaacaaagagggggcaactggggaaactcatggtgtgttcctgagaataccagccacccagactaggtagtatatagtttcttcagaagcaagtaaaaggactgaagtgaaaagggaccccaatttacagaaatgcagtgctctgcggctgagtgaaggggttcggtcctgtttcagtacctgcgccttacagcagggtagcatggaagcccggtatcaccaggcacattcgcacattaagtgttcccagctgtaaaatggggatgatgaagctgtgaggggcttaaagggctttatccagcacctaatccatcccgagtgcccagtaaatgtctgttgtgtgattaggtgtctgcgaagggagtggagatggaaattgatctatgaattctgaagaaggacaaagctatggtccttcagtatgacaatatgacaggtcccacaggtgaggagagggctttgctttcttctgtgctgcattccacggacatataattagtgcctgtgttgagtcaggcattctgctaggccctggggacaccctgtaaaagagcttgcagtcaagcaaggagaggggcaggtccagcctgtgaaggagagggcaagtggattgtgtgagagcatttgggatggggaggagatacagccaccagaccaggcgggaagagggagatgaacacactcatttggaactctctgacaaaaaagagcaaggctgcaatcagacactcgagagcagggatttgtgaatagtaatccaaaaccacaatcggggaggaggagggagaaaaagcataaactatccattgccaataatgtgagggaggccagcagaaaagtaaacaatgaattccatgcacttcactataaatcagaaggtggttccaaaaattttttaagtatgtgttggggaggatgcactactagagatacctctgtttacataaatttatgtgaaaataccacagggttttttcatttctttgcagagttcatgttttgactcttgagaaatgtctttttagaatatatttctttgattttcaaagtttctggaggtgtgagtcaattttttcccctttgaaaatgaagttgagaaaagggttagctgtagtttcaccctaatagaaagaattttctggagaagcatgtaaaatacaagaaacagtcaaatcttagccagtgtctgtggcctcacttccctcaagacagcagaaaggagatgcgaaaacattacccttgactccctggcattaccaaaggccaagctgaagacttgataaatcctgagctcgtggtttgagtcacgcatgttaagccactgtagaatattgttgctgcttttcctgttggatatattttaattttcattccaaattaaattacactttaagctttaagaaaaggtgaaatattatattaaatggtttcattaaccatttataattctacttcccattaagattgatttcttttcactgagtaaaatgtctatttgtaccaaggtctggcaatagtcatgttcattctctctctctgtccttcctttctttcttccttccagggatcactacttgtgtgatgtgacatgggcaacacaagaaagaatttctttgcagtggctcaggaggattcagaactattcggtcatggatatttgtgactatgatgaatccagtggaagatggaactgcttagtggtgagactgaatggggatgttctgcttctagagcaacatgtgatcagagggtctgtgcagttggggagagtgaaggctgggaatcaggaaatgaagtttgagtttctcttctttctgactctgtctgatcctgaggcaataaaatcttgaataaaactcctagataacctgccatcccgaggtgcttctatttctcctacactgactagtcatactgttttagttatggatactatcacttgggaagtggagagggggtgactgaccacaagatagaatctgatgtaaatattttaaaaaccaaagagggccagcacctgcaagctcaacagagtgtgttttaataaagataatgtagggaatggggaataactggctgagtgtgtgtgaaacaaaacaaatacatgaggccacaaacccattaccatactgtcactgtctttaagcaggaaacagctttagaatggaaataaataactgccagtctgagagggtggcaatcctgaggccaactctgttcatccaaccttgaggtgctgggaggcttctagccaggagaccatgaggtccaactaggatgacggtcaaagttaaagtccctctgggagcctgcagcctgggaggggtggatcctggaagaggtttgctggcatatgccaaggatacctccccaatcccccttatctagtcacagaccctctgcctacacacctaccatccctgctctcatcctggctaggctcagggcagactctcacctcccagacctggagcctcacataacttgattcacttattaatttatgtaacaaacatggaattcctgttatgttccaagctctgtgctaagctatggatttttttaaaaagtgaattagtcagcatgcctgcccccaaaatgtttctgttctagttgggaatattatcaaagtaaataataaaagctgccacttatggtatacaagtcactgtggaagctgaggatcaacgtttgaggagctagcgcaggtcacagggcacagtcagaattcaaactgcaaaacccaagctctttgcttgctgccaatgaaatcctcataatacctcattgtaccctaaaaagggttcaaccaaggtacagagggaatagagtgcaaaagaagatgatcagctctactaagggcaggcagactggggaaggagatgatgtgggagagctatagagtagcctggggtaagttgccgtgtgctgagcagataaggacagaacgccatagaagcagagggctgtgcaaaggcatccagtgtgaatagcttggaacatgcaggaactagggactgggggagaggtgtagtggggagcaatgaggctagagatataggcaaaggctcaggtgccattcctggagtttggacttatctcgtaagaaatggggagttgtttcaaggttttaaagaaaagactatcacaatgggacaggcctatctattgctaactaaggtcagcagagaagagcagcaggatctccaacaaggagattctggcaacagaccctgggcaacctgctgaggacatgaacaaagcccttagctgtagagaaggacagagaagtcaaagaactaggtgacaggggctgaaggaggtgattatgaggagggcaggaatctagaatgacccccaggtctctggcttgggtgaataggtgccactaactagaagaagaatgagggagtagaacaggctggtgggacagaggaaaacaaatgaaattctctttagttttgtgcatgctggatttaaaacaccagtggagcttccagaaggacccaggatataactttaggcaagagagtcaaatgatctaatgtaatgacttgaaaaatactaacataaatagaaatatatgaatggagatagctctcagttattataagtacagctctatttatattaccacaaattatggctatagatttcatctgacttctctttgaaatgctgtcattgtctctttcccttcctaggcacggcaacacattgaaatgagtactactggctgggttggaagagtaagtgttataagttgtggggttttatggatgagtcagctactcagctatttgatatgcagctatttaaaactagggctctaagtgatacgttattaatagcaatattagttaacctatttctcaaaatatgtaaatgctccctataaagatatctttttgtagagaatatataacacacacagttggaaaaagtaaggggacaagtgaaaaatcaaaagcagagcagacaaaacatagcgcactcctggcaagttgtaactcccagcaagttaaagggtaaccatggctgaaagttggccaaggtatccagtgacctcacatttgaagttatgtgctttaaagacagaaaacacaggttctgtccccagcctgcacagttacctaaggagaggtcactataacaagcagaaaaactcagcagcaaccacacagtgcccactatgcacctctctttggaggaaatcatacttgcaggcttatgctttattaggcgtccagatgcagagctttatccaggaaagtgtggtgaccctcagggacttgtcatgcttctcagtcccactgagttatatacacattgcacagaattaccacccagattgctatggccatagaatgtaatgagttgatgaaggaactccagtcatcatgtcaccttgcatggtagatgaggaatgaatctcacttaatttttatgatcacttctattaagccccctttaagagggaaataaagtgacccccaaaatgtaaagattttatacctcttggatcatagaggtgaggtccccagtccaagaagacaaccccttctagctgggctcagagctccggcagcattcacacgtcctttttcttcaggcattgattgggcagaggggagaggtttgccaacatgaaaagtggtttcctccatggcaagagacacgctacacttcctcacgactctttgaaaaaaatatgttttttcctctctgtatttaaccagacagatgccacttttcacacatttctactaggcacaactccatccaggggaaacagggaaatgtattaaaaagataaggctgtgaacacaggtctagagaggggaatgtgtttcaaagctctgtaatgagaacaccaagtgtaccgcacgcctcagcttgctccataaatgaattcgctttgaatcactaaatagaagagggaagcatttttcttccttcccaaaatgggagctgatgagagaggaaacatcgagggcgaagtgaaccaacaattttaaaagaccatctcctacctgctctcaaatgtagctaggaaatcaaaatcgtaaaccaacatattcctttcaggctgggatagactctcttctacttaaactgcattatgttctgagtactatcttttattgaactgtaaaaaaatggaaatttgttctatatttctatacaaatattttttgtaaattgttgatcatatttaacaaaatgaaaaggcttataataataactatatgaatgttttcatatgaaatatacaacagacattccttatagtatgtagtccagaaatggttaaatactaagtctgagtttcaaaaagaaatatgtgtaaaaacaggaaagaaaaatatccccaaattgcaaaccacccccaacctgaaacaatataaaataatatgtctgtttcaagagagcacatttgtgacactgaggaaatttactgctccaaactgaaaggttaatgctattttccaggtgcttgcagccagaagtcatagttatcatccatagagaaaagatgtctccaaatcacaacaacttctatttattgttttctacaagcctctttatatacattctctcatttactgctcacgaaaattacctatgagtatggtgtttttgttcacattttatagaaagataattttctttttgagacactaattttaatttggcatataaatggagcatggatttttgagcgtaggtattggacaggactttctaaaactaaagttggtactgagatgagacactgtgctttaatgttcttttgttctctattattttctagtttaggccttcagaacctcattttacccttgatggtaatagcttctacaagatcatcagcaatgaagaaggttacagacacatttgctatttccaaatagataaaaaagtgagtattcttacatattttatttcatgttgacctcttttttttttttggaaaccaacttgaagtggaaatcatttggtaaggtggatcaatgtgtataaaaatcagattaatttaaactcctcagtggtgtattgtgtcatgtggaacgaggtggggaaacccaacaagaaaatccaaggttatttgaattcctgatataaatgatttaatcctccactttgaacagagagagtctctaatcaatcttttttttttttttgaaaaaaaaaaaaaaaaccatcaggactgcacatttattacaaaaggcacctgggaagtcatcgggatagaagctctaaccagtgattatctgtgagtattgtaacaattgataggatataaacctacttgtcataatcatgccctctttgcccagaagtagggaaaaaatctcctacaaataaagagtagtctttttggaatgtgttcaatactttttttctttttaacatacggaagccttaatgattttcacatatgcttagcagatttgataccatgccaccaggcagctctacctcttgctcttacctgctttacattacaagagctgtatcctcttttacatgaacgttgtggaacgccgaactagcaatgaggggcattttgttaaatttcagctggcactgattttttggaaggcttggaaaggcaattttatctgtccatgtcccggccttactctttgcaaaatggaaagctttgcagaggctaactgccatatatgagttggtagaaaagggggtgttatttttcattagaatctgaggcacttttatgattctttattggtctaatcgcggaggaattttgccgccgcccgaagtagcttttgaagcccctctttagcagtggctctgctgctctcaggaacatggggctcctgccatctagtagcttatgttataagacagaaaatacaacgatcgggatcaatgagtggggtctcaatttcaggctagctgcctagtcctattttttttttgacagaagccttcttttgtgtttttacttgtcactctaattaaggaagaaatctctggttttacatattttagtctgttaagaacaagacctttatgtgtagagatgacggagaaaaatggcttctcgggggtgagggacacggaagcgatggcggagggcggcgggcacccgtgcgcgcgctccgtgcacacttaggcttggggtctgagtgcggtggatcgcctctgacttcttaaaaaacataattaatatatatttcatttttttctcttcctagatactacattagtaatgaatataaaggaatgccaggaggaaggaatctttataagtaagagctctgtcaagttgttgacttgagtcattttagctgacgaacaatttctgaactctatttttattttttgccttgtcctaactaatattaaactggtattgctattgagcactttttattccttcataaatcaatctacatgtccacaagagagaatggctttattcgatgttttgtgatatttccaaacaatggaaggtttgaggttactattaattcatgtatttatttcatgctaaaaaaaaaaaagtcctaaagattgcgttggcatgctgctgtctttgaaactagaatatggctttattcagttccttcctctcacttatcttttcttcaagcacttaatttccaccgttggttttacagaatccaacttagtgactatacaaaagtgacatgcctcagttgtgagctgaatccggaaaggtgtcagtactattctgtgtcattcagtaaagaggcgaagtattatcagctgagatgttccggtaagtctgagctccctgggagggagggcagtcgccgctgttactcacttcgaagcagctccctctattccttttgaatctgaggagctcttgaaatcacctaagtccccttctctccactcacatttaagtagtgagcataaacaatcttttcttccccttatcactgagagacttgcatagcttgccttagaccgaacacactcacacatgcacaaacacacacccttgtgtataacagaagcacttcagcgttaaatacatacatattgtggggttttaaatgattattttatgcactcgtccctttcaatgagaaaatgtatgtggctggtgcgtgtcacccaacatgctcactgctccatcttctgttgctgttgctattattaattacaaatgaagaaacccaggcaaggagtggccaagtgacttatgcaggtggtcacacagcgagttacaggcacaacaggattcaaaacaggcctctgccgcccgagccatcccttttaaacagtgtgccaggttacttctcaaaatgggagaaaggatctggatattctgaaaagaactgtccatagcacaaaaataaataaatgttttcaaaccagttatctgagtcttccctcactagtatattttattattatgcttttctttatggttctttactatgactgactttttttttttagcaattatttcttgggcatgcgctttattctaagcactgtgctaaaagctttatattcatgatcttgtttaatctttaagaaatctctatcaagtagatattattatcctcattttctatgtgaggaaatcaaagcacagttctgttgtcctaagtcacagagctagtgagccaggattcatccccaggtatggaaagtgccttcactctttctaatccagtataaaaattaatattatcatccaaacacataaaattaaagagctcacaaaatagcttttctatacattaccttccactctgcaactaccacagttgggataaacagtgacgatatgggcttgtgagaaaaacacttttgcatgccagaaaggaatcgcttatccaagtcaggcactgtgcagatgtgccgcctggctctgggactccatgggagtgggggcagcggggggagatctgtccctccctagggaggctggctacagggctctgcagcccacctgggcagagcctgaaaaaccctgtgggatcacggatttagagtggggaaggatgtcagctcacattttactttgcagatgagtatattaagttcagagatgataatgtgcccaaggtgcccagcagggcacagattcatttcctacttcattctactgagccctgtgcctttccagtaatacttcttacactgaaattgcaactattttaaagagagggggaggagaaacagctaacatgtattaaacttcttatgcattataatatttatatattctatcaaagttaaatggtaacaaatggtatttttgaaaagtcatctatactatcttttctaaaaaagtattcatccaaaacatttttcccccattgtgttaacaggtcctggtctgcccctctatactctacacagcagcgtgaatgataaaggtattttctcatattttactcttcatttgtttctaagaaagtgtgttgcataagtctaacatgtacttagcattgtgtgattttctttggctttgtgtcttgacaatgagttgaacacaagccttataacctgaagtatgtgtagtccgatcagtgaatttcatgtttgctcattattgcactacataatccacatttttcacattgtaatgaatgactgctgtctcctgtatttctttagggctgagagtcctggaagacaattcagctttggataaaatgctgcagaatgtccagatgccctccaaaaaactggacttcattattttgaatgaaacaagtaagttaaattcctttggaatagtacttttcatggaaacaccaatgcactctaactatagtaattcgatctgaaaatatgtatttcatgttatatataaatctaatttaaaaggttatttctccatgaaatgttttgtcacaagaaatactaattttacatccttttgtcttaaaatataataccattctacataaaacttattctgtcaaaaaggaagggatttggagaacatgctctatcgttagttcacttttatcccattagtgactctattattctactaatattaattgtgtgtttaacttaatgacatcctagcatatttcacctttaacccaaagaggtcaaggatatctgagatagttgtataaaacaattcgtgttggctataaaatattgaaacttcagtctcagaagataaattttgaacttttccaaaccctgctgacctcccatagtgtggtcccggcttgattgtgtaatcatggattatgttcagagaccagtaagaacaatgggtttctttgagtagaaaatcttgttatttattgtttgtttttctttattttttccactaagggctaacagcttataggggagggaggaatctgttatattaggattgattcattttaggcttttaaaaaaatttaggataatagaaaagattcaacacatctaattttaaatatcaggaaaagcacaggaaagtatagcatcctcgtgaaaaacagtttacatcagtgctactcaaactgaatgtgcatgtgagtctcctgggatcttatattaagatgcacattctgacccagcaggtcaaggaaggtccaggtttctggatttgtattaagcttctaggtgatgctagtgctgcttacccttgagccacacgtgaggggcaagagcttagagttttccagagctaacattgacaacctggtacagaaggcactgaatactgagatgtgacattctatttcagtcatgaacactggggagcccctgcaggttttagggtcacggaagccacattagtagacgggtgacttgagacaggatgtaggatggagctgtggggatggggaggtggttatagccattcaaagtacagaaaggagggatgaaaggtaggtcagggaggagggagccgggaaggtgggactctgtgaatagaaagaaccccccaaaccaaagactatacatctccaaaaaagtgggactaaaacaccttcccatcaactaatgccaattcaaacaaagcagagatcaaatgatgggttttgcatattcattaaaaatatcatggtcaactgatagtttggtgttctattgaaattataatagagacttaaattttgctcttacaagcacatttaatcagaaggcataacaatagtcagcaaaatataaattgaagataaatctatctatatattttactcccaaatctttcttttcttttcaagtaaaataatcgtaacaaacataaacaaaaaggaagataaatgttagataaaaatagctctagagataagaatttttttgcctacagtttaaatctactgaatctggaataattttatttaaatgtggaaaaacacttttttatagatctattagtataactcatcttttatttgggaacgaaggaaactgactcattatttagggacaaattttattaaactgatgttaaatcaagcacagagaatgagacagacccgtgggagatcatacagaatgtacgcaacagtttgctccatataaacccgatctcattctgtgaaacacagagctgaaaatgggaactcagctttgcggtctgggatggcaataagaattacaaaaatgttattaaatcagaattctaaaatagagttggggccaactaaaaatcctaaacagcttcaaggaaattcaagaagaggaaaacattttggaggaaaacttagaacataagccataaacaaactagataagtagatcggatgccaaagaacagaatcataaaaacaaaacattagaaattctaagatgcacttttatgttactaggcaccaatgtatttaatagatacattagaaacaactttatgttttaacattaactagtattttaacctgaaagaaaatgttatatcttaaaaatgtgctgaatccaagcagttcattttccttttctactctcatttaacaaattgttaaactctagaaatgacttgctactgacggacatgaggaacaaaatcttgtgctaataatttttcttacctcactaattaatctttctgtttgtttagaattttggtatcagatgatcttgcctcctcattttgataaatccaagaaatatcctctactattagatgtgtaagtattcaagagaagggagcaatttagaagtattgagtcatatatatttttctcagtgcagcttactgaaaaatggagccaaatgcgtcctttccctcttcctggatcactgtttactatttcctcctttcactgtacagccacaaaacccaacctgtgttttctcacatcttcttaatagagaagggagatactccttttctgacataatggtgtatagattttcttttgttttgcttctctgaactccaagggaatttcaaaggaattcttaagtctgcattttcatccttaacctcctggacattttaacaagcaagagatgggcattaacagtcgtgacagttcccttaccccagctcccactggctgcctcatgtttctcttcctttagttcctgaaatattactgccggctattttctattcccctttttggtgaagagaagtgatagaggagagcgttcgctattaaaaacttcaagtctttgagaaagttaggaagtcacaagtctttgaatagtgaatgtgaactcacatgaattccaaatatgacagctttgtaaaatattttttataatcattaggaatacaccctactttaatttttctaaaattgccctagcgtcacccatgatgccataatgtcaggctcttcctgtcctggcttgcatcatttcctatattaaaaacaaaatgaaacaacactagtgcagggacctgccgaatgccaggtgcttggcatcatttgccttattttattcacacaacaaacccatatagtaagttctgttgttccattatacggaaaaagacattgaaggtcagggacataatgtctctgttgttaccagcgagaaaaaaaaagtggggagaggaaggcaggacccagatattagtatcagacacagctttgatccactatattcacagtttcatgaaaaccacacataaaagcacaaagaaaggaaaagatacatattttaaaattccagatgtgttatctgatttcttttcaagtaaaataattgtaacaaatgaagtcaattcattcgtgacactaatttgttttaggcttcggctccaatgctaaaaaagcatccttttgagtgatatttttatcttctttgacttcctagtaagtaacgatttgatctccattagaaaaggttttaaaaaatggtaaatttaatacatatttctgttcagttattttccttttcctctcttttagggtcttttttttttttctattttaaaaaataatcttgtttaatcttggggttagggaacttgatatatatacctaatattaaggcaagctcttaatctaccaaatttaatataattgagaggagcaaggcatttcacatgtgaaaaaatatttgctagctcaagaaatgcatgaatgcattttcctgtttaaagttagaatgttatagtgttttgtttaaaacgaaagttcttttgactgacctccctaagtagaaggaaaacattagcaaaggcatgtaagcagaacttgtcctatcctgtgcagggacagtaagcagatgagtggagagatgggctggggagggaataagttattggagagtatccatgtccaggagttgtgtagatggtgcaaagatgacatatttaaatgaattgagatgagctataaggagctcctcttgattaacaagcagaaatgagagtgctttacagagctttacagagattgtgcacacagctctgtgtagggtagatggtagcctgtgaagattgcagatacaagggagttaaacttgttagtatatagaatgcccaatgacatgcccgttttccaatgcaacctgtttcttcctctgaagttttaaatgttagcattcattcatactgcagtccattccacaatgatttacagtcattgtgagcaagactgtgccgggtgctatgggaaatgcaaagcatatgatgcagaagtcaaagtccttaaagaaggaaataaacttgcagtccaggagtattgtgttaagctgagatggaaagatatccaaagctgcatttattgttgtcatcatcattttttttataccacaactcccccttcttaactattagagaaattatttctttgatttccaagattacattaatacttctaaaatcttggcctatgaagtctgtgtttgataactatcttcaaagacaaaactgacaagtatctttgaaggaaatatacaaccatggtagttgtgttgctaagttttagaggactcattctggacaccccataggctggcacagtttaaggctcatgattgggaaggatgcatacttctccacggagaagagaaatgtaagcattcctcatttgattccagaaaaccatgaaagctaacaatttggtatttttcataggtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccaggtgagtgactaggagatgaagtcaaaggtcatctgattttttttcccctttaaaatttacattttaaagctgtaaagtgtaaataatttaaagtgttctgggatgaatttgtaatcttttatccttacggtaggttttagtgaagatgttatgtttaaataacaatatattacattatagattgatatgaagttcaaaaaaaaagcatttcctaaattcctctctgtatgagactctagaaagggagttggcatatgtcctaccacattctaagaacagaaaatcaaaattcatcagactcggggacaaactgaggaataaatgtaccctagtaaacatctgactaaacaagccaagcccattccttcacagtcaaggatactgtgtacatttccttcagtgtacatttacgtcataggcagtgacaactctgaagtcctaggagtagctcctacagtctggatgagggtgactctgctattttgggaaaattgtggagcacaaccatcatcggtactatgtataagggctctgttacgtatgaaccacatctcattcttgtgctcttcacttatgggactataactagatgtgatctggctcaagagatgttaacaatcaatgatggttactcataagatgcatgttgcatgagaagtgctttacctgcaggcattgtcgctgaagccccgagaggtgggtgttcttaccccatattttaattaaataaatagagactattaggttaggtagcttgccaaagtgaatcaggatttgaatccagtctcattctgactcttatatttaattacattcaactggtatgtgggaaatgtaactttgagtttctgtaaccaacagcatggatgtctggggaagcataatagggagggtggttgaaaataatgttatgaaatcatagactaggaaatgcagaaggatccatgaatgatgaaatagatggagagaggagaagatgacaattgattaaggattcctgaggaaagaaattctcttttactaaagttaatgattagctattttccttaacaattaaaaaatagagatttagaataaacaggggatacatttgtttgagagtgaggctttgatattttaaaaataaacttgtatctatccagatcgctcctctatgagagagggcatagtttccagggtctctcaaatctgaccaacaaaagtcctaaaattacaaaattaaggatctactatatacaaccccagttaaataagtattgagaaatagtgcgtttatacagtggcacacactattgcagcaactaaaaagagctaagcataacaacatggatgaattgcatatactgttgaatgaaagaagctggacacaaaagtgtacatcctgcaagatgcaatttatgtaaagataaaaacaaggcaaaagttcagtgaaatttttatggaattcaataaaagaaaaacatttccttttgtccctttgcaaagagggaaatgccttagaggcttctgataatatgcacaggccatgatttcaaggatacattcactttgtaaaggttgatcaaattatacatgaatgatctgttgcacattgctgtatgtctgcctccttcaattttacaaagtttacgtggaaaagatgagttgaaaactattttaatttttttctagcactgcttaacttagggcaacctaggacatattacatgaaaacacaaagactgtcaaaatcaagataggttaatgcaaaggtctgcaaccacccacaatgctaaaaatttgagttccatttgtcaggtatttttaagtaaaaaaaaatttcttttgatgtcaggctaatattaagaaataggtgcatacaatatttttcttatttctttacctggattccatctctgaacacagttttgtggcaaagaagacttcttaatccatcaaggaaaaatttatttctattgagtgcacggtactgagctaactaatcaacacccagcataagaagggatttatttagagaatggtgtttaagttctcaggtagggggcccggagacatttctaagcccttactcagaagtttttcatgcccttatctttctccattgcaggggcagactctcccaaactgaaaaacatctggagagatttaaattcaattatgtaaagaaaagtgcatctgggctgcaaatttttgtataaaactgtgaaaaaaactgccaggatttgttttctgtgaatcatacacacacacacacacacacacacacacacacacacacaatttttatgaactccaacaaaagtaaaccatgttcatctggatcttaggttaaaatgatagatatttatctcaggtgtttatttgattactggcagcaatttttagtctctaatagaatgaagcagagaacaaatggcagggtttcacatttgtgcctcatctaagttttctatacacaatgcagtactgatctgtggactttttccttgtgttttagacaattttcaaaaatgggatttgtggacaacaaacgaattgcaatttggggctgggtgagtagttgactgatgaatctgtatgcattcgttagtgaatatcactcagagcaggttactttatcttttgtatatacatatttggaggtgaaaatcacatctatcaagtcttaggtctctgggcagtaactctgcagaatctccactgagttaggcttacacctttgtttattatgatgagccagggaggtgaggtagaaagagcaagaaggaaggagtgaaagagggagggaagagggaagggaaggaaggagggagactttttcttatgcatcagtcagtaaagatttcgtgttattgtttttaaatcttctataattggtaccacccagtcactagggtcagcaaattttccgtagttttccccatatacctaccaagaaagggatcagggctctgaaagtgtagtctttaaagatactgtccaattaaggccaatttaagcctcctataccatgctttttatctctaaagaggcacagtatataaagatgtgagaaatgtggaaactgcgactcgcttaccatatgtccttattcttttacctccataaaaataactgtttccattccttagtcatatggagggtacgtaacctcaatggtcctgggatcgggaagtggcgtgttcaagtgtggaatagccgtggcgcctgtatcccggtgggagtactatggtatgtaattgctgccaggtacaaagagatacggagtgttgacctcaaaatgccagtaacaaagccattcctttctgagtttcagtgtttttacagcgaataataggctgattcatcttagaggttctttttggatacctataataagatgatctcatttattctgctattttgcaaggctgggtggtatattttattacacgtttgattttttatcaacaaattctgttttccgaatttcaaaatagccccatgctacatttctacagataaatcattccttatctttactctgatttgattcttgggtttcacatattagcagagtgagagaagtatgtatctctttcccatcaattaaatgtcaaatacaagtagggctttggatgggaagaggagaggaggaacagtggaaacacccattggggggttgttgttttttttcattcttaataggtgaaagctactctagaatatgctctttgtcatcgagagagtattattttataaggcatcatacacctacctctaagactacaattctcaaaggggagggagtaagcgatggaagatgagggaggaggggggattcagaagtggtaaggaggtaattgattttcctgcacctcttctaaccccatctcaagtcttctgtctagtgtaagaaaagaatggctgatgatgaatagcttattaaatattttatatccagaaatatggtagtacccagagaaaaagactctttaaagtctctcccagtcaagataaaccaatgtaaaaatacatttatatctttctgttaagaaaattggagggcacagttataatttgatctacacacaatgaatttgttttcataatatttttctgcttgatattaattgttctgttggatggcttgtttttggagacctctagtggtcaataaaataatggagtaaatctttgtaagtttaaaaatatgaaatgagaagaaaacttcatttaatgtatatagaccaatctaatacatagaagttgtctagagttcttatatacgtgtaaatttaaacaattttattcaaagatgggacaaaaggaatacgtaaatggtgtttcaaggcatatttttttaaaagtttacaattgtattatgcagttatgcataatattttttaaatgttatttttaaaatttcagatcttcttatacatgtaaatctggttagcataaataagaaaggagtattgtgttctatgacaagcagaattaaagtctgcagctacctaggggaaaatgtgtttcgcccttaaaagccatttttcccatctaacgtacaacctaagatattaatatttaaatgctaaagttaaaagagatatgagcattttatgaagttctcatattttaaagtgtcttttaaaatattctatttttatattagtgtcctttaaatatataaaattatgcatagtcagtattcatgttaatcaaaatgataaaatatcactgttagtaattttggaggacaatattttgattttcatagaaatggcataaagtatgcatatggagcaactaacactcattagtgtagtttgtaatctacaataccagtcattcaaaaagtgttagaatgttgaatttagataatatatccatttttaaaattaatgaaatcagttttgaaatacttgtaaaattttagtgaaattcaagccaccaacctagatagcacaatggcaagataaaattcttagactctttaactgtaatctggtcacttaaggaggcagttttcaaagcagttatgtcagatttttaaagttttactgcaatttggcctcaataatttttttactgatattttaggccaaatatatataatgtatcatttaattttttaaaatcaggcaaaatatgtttaactatccaaaataaccaaaccaattatgcaacctgtttttcaaccatatttatagataaaagagcttatgtcatttcagcagacagatattaatgtaatctgtttcacagtgctcaactgttataccacaaaaattgaggcttcaccacaaaatgagagaaaacaaatgttaaacttgcatcatgatggagtagctgagccaatatggggatatacagcaaataaatgataactgaattatttgtttttattatagtgaatcccagtctgatctccaaaataaaatatgatttaaatcagcaactagtaattgaacattgttaggggtctccaaaaggaaatagatgatcataaatcagggcacatacttgtattataaccaaaaaatttcaacacaattgaggcattaagtgacttcctaactaaaattctttgagagggtcatatgataatgttaagatcccttaccccttagcacttcacatttgacttttctgcatgtggattattgattggattttagataatctggtttgatctccctttgccccatcgtaagggaaaattgagaatgggttagggctgagtgtggaaaggtatgagtatgcagggatctgggaattagcatctctggctatattagcaaaccaagtaaaaaattacctcccataaggtgctttagccacccttttccttcttcataaccacatagagatacttctgagagtaactctatattcctatacatgagtgaatacatatggaaacactgaagtggcccattaaaagcaagaaaagttgttattgtatgaattaaacttttttttatttttttttctttcacagactcagtgtacacagaacgttacatgggtctcccaactccagaagacaaccttgaccattacagagtaagagatgaggacctatacctattttataacctatttataagtggtttaagaaccttcttaattgtatctattctagaaaatacatatttttatttccaacaaaattcttgttaaaagaaataacacaggtggtttagagatactccaatagcttcccttactgtattctgcataattacagtctttatcgtatgctatataggtcacaatatgcattcatttagaaatacaaagcaacatcagataattactttaattataaaatttcagttaagaaaacctattagaaattcaacatattcctttagagcccagaagactctctaaacctttagctatatattgaaatttcttacagtattatcataagtaagatatatatacgagactataattttcttactcatagccaattatgtacagttttttttcacaaagatttaagtaaagcaggtgagaggtaggtacagttgggcagtacccttaaaaagccctaaacctaaatcactgaatagcatccaacaggctggttgcctgatggaagaaccagtgggcaggttgctctgcagatgggctatagcatttaaaatatggtgtgggtgcaactatcattgacagcccccatgtgctagtgtggatgccacggcaaagccagagcattgtctctggtgccacattgatgcagctggaagtgctagcataagtactagggacccttctggcactttgatcattccaaaactttgctgattctgtttgtcatgttaggttgaaaaaaatttttttaaaaccctgaaacttacagctgacaaggtaaatcatttatgatgtttacatttttcaaagattgttcacaattcttcacaagacagtgaattaaagagaaagaaaaacaataagaataacttaagaacacaatttcttttcatctgtgtcatgacttcatattaatacattgctctgagcaatatccatatgtttttgtaagatgtcatccctattactatggatgctgaagtcatctgatcaaaatacagtaaaactcaaaagtttctagttttgcaagacaagtatagacaatttagttttaccaattactttcagcttacttaatgagtaaggtgtatgtgtgtgtgtgcgtgtgtgtgtgtgtgtgcagggagctgtgatagcaatatttttgtgttagtggctgtatgacggttttcatgtctgtttctcagtcaagatagaaaagtaacaatctgcaaagtgagatgcacaaatcatctacccctgcaaaacagtcccataattagattgtccccatttctgctaagtgtcccatttaatacttagggctcaattcttcccattctttctcctccacctcccataagctgctttagacactcatttccttcttcataaccacattgctattgtcacataacctatctccttttataacaataacccgatttgtctccccttatcttgtcttctcacactccagtctattgttcacagagctgggagattaactcccacccacaacatgttcatggttccttcttgtgtactcaactaagcccagtcctcactctttacccaggtgttcggcacccttcctgtagtagcctactttgtctggaatgcttgctgttctctgaatgtttctgtggctttcccttttgtgcctttgccctctgctccttccacgtggaatgtcatttcccctccatctccacccattcagaaacttacacagccctctcagtggagtagcatcccctttggaatccccttttgatagtttccttgtatatctctgaatcctcattttattccaccttgaactaataggtatcttgtactgaattttcccctcttcagtactgttagttattcaaggtgtacaagctattcaacattgtattctttgccttcgcctttaggaagtataacctttcctgatttaacttaaaaactttttgaagggaaacattgttatacaagaatttctccatcaccgttttcattttccagttcaaattttcttgttaacgacccaaccagaatacttaaatttgattgtcaaagagttttctcctacaagattctgaaagttcccgaaacattagaggtgcaactgcctaggatcccaatccctcacttgaacatggtgtatgatgaatccaaaacgttcatttaaaaaattatattttaaaaagtggaggctggaagcacaagatcaagcccaaccttgacatctaaggaggttcatggcacctaccctacctcctcaaataacatcagccaatggggtatttcctcttcatccagccctccctatataatgagataggataattagttgtagtctgccatttcaacctgcataaatttccagtctttcctataggctcctcgttcccaccgagttccccctcttctccagctctacccctgactgcggtggccatttccatctccccctttaggtgttcgctgcatgagatagtcatgtaaatagaagtcacttcctcctgccaatggcaacacacgcacactgggtgcacaaagtcactctttcacttcactgcacagatggcacccgaggactgtttaatccttccacgccaggagtcgggttttcttggcacaaaattcattgctggcaatggacacattaaaactgccagtaccagggagctaaaggttcccaatgtgttactaagaggaattatttgggagggcgatagttaaggtgggcaggatacaagtgaggcaaatgcactaactgaattgtctccaccgtggtaagttgcttcctccgaaatgtggagaactgaatctatgtggagaactgaatctaagtgcctatttttggtgcacagcaggctttagaataaagctgccctcctttgttttttaaatgagcctgtgcttttgtctctggcaggaatacattcaaagattctattttcctccaaggccccagctgcccctctggaccccatcttttacttttctttcccaggttgtttttcttttctcctctctctctcctctctctctctctctcttcctctttttccttctctccctttctctcttcctcacatcctttttgaaaagacaaaggagacaattccttagaggatttcaccaccctgtgcatttcagtggatcagaaggaaatatttttaaagcggttcacgtttagtctggatcagtgactcttttcagtacactgaggattaggaatggccaaagtgtgtaacaagtaaggccttgatcttagtccatgttttcagctaaatagccactgatacgtggctatttacagaattacagcctttggaagaaaatgcagtttttaataaaactcaaataagtaaaggatttattattaggtgattgttgatctggatttggaagaatttagagaaatccacatcaccaagagaagcacatgtcgttaaatcaaagtcctactcaccattgaggaaagggaattagaagagccatttgcatacatgaatggaacaggcggggatgccttgtgcagttgttcagcctgtgccctgctgaaagccagaccatactccattttctaaggcctacacctccagggctgtgtcaaaccaaacagagcaccctttcctattctttcaaagctgccatgtggattaggggaccctgagactaaggcctagacccaatgcagtgagtccataagactctttttgaagataatcatccaactactggcaagaggcaagggagaagcacttttaaaggatatccagacctcaaagatgaaaggagatgttcatcccccccacctcaaggagctgataccggaagctctaaatgggcagccaaagtggaggggtgacaaatctgagctaaagggtagtatagctctatggaaacatcttttctgcaatatgtctcagtcccagcagacagaaatggtgacagatttgagcaaaggaatcagatccaaagaggcaaccctcaaaaccaatgtcaatcagcagacagcagctgtagccacaccttgcggagtgggctcctaacagtgaggaatggtctctcatgtggtcagtcacaggtcttttagtcaaacttgtaaaaaatgttaacgtggtagactttcattcacccattcaaggtgcctggcgttttaatcattcggaagtttattctttgtcagttagaaaaaacagtattttggaagagaaataaaagagagtaggtaataaaagatgaatttgaatatgacaaagtatccaatatgtgtgaaaaagacttgtggttttcaaattgtgactatgaagccccaggaattctataccttaggagcatgtagggaggggaaggggagtggccaagaagttagagtttccccttctctgctccctagccagagggggtctagtttcatttatttcattcatgttttcattcatttattaagtgcttctatggcaagtcatcattctaagctctttacatgggttatcaggtttaattctcctccagatcctccaagtactgtgtttctattttacggacacacaaactgaggcacaaaaatgttatgcaacatattgatattgagggttagaaaagggagagagggcacttatctgaatcattagagaaagatttcggaagatggggaggacgagcatgatgctctcaataggttacgtattgggggaaggcagatcagcacagtagacaaatgaatagcaggaagagtggttttctggcgatgtgtgaagcaggtccgatgaactgagggataacagaagaagggctctgagtagagcaggccaaatgctggccaagaagacaggacataagcctggggaggggatagatttatgaatacacacagagagaagtatcagatcaagggcaagagaaataggacccaagtcctgagccttgttgccaagagaagagggcagcctggaacacacagaagggactgatttaacttgtagaggagatttattttgcattttgctcaaaatttgataggcttttggcaagtgtatgaaacagtcatagatttggcagtcttctgctagcagatttgaaatgttcaatccttaagaactgctgcatcgttaggttatgcaaaacagggtgcaattttgtaaatatgccatcttgtactgatttgacatttgttctattatcccagaatatgccaaagggagagagaccttcagatttaagccaaaccttaacttgtttgttgagtgctgataaaatgttgactgctgtgtgatctttaaagaagccagtgttgcttggtgaggcctgaggtggagccccctgtctggggttgatgggagctctctccttggcatcccatgggtacagttgtttgatagatgtacataagtaaaacatctgttttagtgagttgaagtcattcttttcttaaacattttctgtggcccctgttgtgatattaatggtgcttcccaaaatggcatcatttaatattatttatgcagctttggttacaagtaggagaatgcatagagcaagccgctaaacccaaagtcgtatcttactgaagtgctgggttgctgtccgttagacccaatgactgtgtgctctttctataagatcttataaatgggatgagttgtttggttgtgatgtcaagtgccagtagaatatgatagtcagggacatgagcttttggggttaggccaacatgtccgcaatttctgtttcaaccacttaccagcagtatgagtttgaggaggctacttaaccttactgaatctcagtttcctcatctggataatgggataatcagacctacctcacagggttattgaaatcattaaatgaggtgcttgtgcctgccatgaaggaagctttcaaaacatggcagctgccaccattattatctccaggaagcaaattgtccttatggttcctagatggcactaggggtagtttaaaaattgttataccttctgtttctcatagtactctcctcctcttatcagctctctcttttaattcaaaaatacaaagatttatttgttggaaggtaactgaggaaccagcatgatccaacgagcagctacagatggttcttcttggggactgaaggaaaagctcctcagagatgctgtggagtcggcactgccactggaccgatccttcccacttctccttgccaggctgttgctggcagcggggctctccggaagtttctagcctcaggagagtgccaactgcaccaccattgcatccttgcccatttatcactctgagtttcctttttagtagttggtgatagactattcggcttctaacttagtcatccatttccttttttatttctgtttccatggataggcaaagagggattatcctcttttggtaggttaaaatagcacaattaattttttttctaatcattaatcataccttaaattcatgcctgttatttctttttctggctttgtatgttatctttacagcttaaagtgtgccatacactggactgtaaagggtgttaattgagaagccagggtgcacagttgagtagggaatgatcaatggttccagaggcaaggtgacacagctgcctttttctggggaaaaaaatgttctgtgtagcctgagagccttaaagtgggtgtatgtctctcagctgcctctctccctctcacagagaggtccctctggaggcttctcccagtgagcaggggaagtgcgcatttgaaatggcacacttatcttgcagttgcaggggaagcttttgttttatttttctcttgctgcattaaagtatttgtctttctttctttgtagtgtaatattgttaatgtaaaacaatttgcatcatgacacttttatcacagttttcgtctttttctcagtatgttgcatttctcaccatgtctagttcatcacagctacagtgtgtacatcacaacatttatcttaggctcagggttttacttgtttataaaaattgtcttctttcagcctgtattcactccatttaagaaaaaaaaaggcagccagaaactgttttggtccaaactccagtagttatcacattccttgctaactgtcctgcgtatttatatgtctcctaactattactctatgtttcaatgacatttctcagtttcatggctcagggaggttgtaggagcagcttttgcttttcaagctgccaagcaaggcaggcccatgaggcttttggaggtgaggtgaggtggcacagttgtatatttgggtcaggtctgagtgttaaagttgactgtcttccgcgagcaaagagctaaatttaatttggagagcaacaaggagggaggaagtcagtgcaggctgagagcatggctagtggaaaggatcaccaaagaggactcacatgggggcacctcagcctgcgattcaggcaattaatgtttacggtcagtactcaagcctcagcctttcttgtctccagctttgaatgctgcgcaaaactgtcttttagggagatttattttgaccctttcctctctgaaggacagaaaattgctcagagttctattgccccattaggctatacgtcacttgcgtagtcacaaagtatgcctcccaaatcacccagggctgtgcagagcaatctctcttctgattagtgcagtctgagacggcatgggtcttaggaggatctcaaaggatacccattattattatgcacttcaaattccaggacagttaattaacattttatttcacactgtttctttgccagaagatcacatcataagcagcttggaattttagtggagacgcagtgcaatgtaggaagtaaaaagggcttgctgtcagactttgtccagctctgacacttgctgtagttgtgaccgggtgcaggttactcaccttctgagtcttggtgcctccatcttgaaaggagaattgttctagacctattttacgcaaatattgcaaggatttgatatagcagtgcttttataaacccttatttatatgtgatgcttaacacagcgacaggcacagagtaaatgctcaattgaatgttagctattatcatgaatggtatggtgtatggatagaaagtgggcaaaatatatctcaatacatttcagaatgagcatattttattttgcccactccagctgataacacttgattctgcaaaactagtaccaaatatagtggacactgcaagtgcttgatcatttatttcatttactcatttaattgataaatattttgcactctattagatgttaagagtaatgcataatatagacaaatcttttttcttatggatcttatcatttagtggagtacataataagtaaatattgattgactagatgaaaaaaatcaacggagggataaatggtgatgttgggatggatggacagatggatttatatttagatgtatttatctgagacatcttaccagacaaaaaaagtttctcaaaaataaaaggagtctcactcaggtttttattctgagagttcatgagtaaaattttcaatttgggtgagaaatggaatatggtcagaacaagtgggaaccagcctgcacagaagaggaagggcatttgttttaagcctactaggccaggatgaccttgggacattcattcgactgaaacattttgggtggctctgtcctgaaagtcgtagataaaatgtcttttttccagaaacactgttaaagaattctcacatcagcatcagaaatttaaccccctaaaaatgcttttgctatgcctcttagttcctattattgtgatggagtaagaggagttacagtagcccacccttgtttaaggtgaatacattccaagacccccagtggatgcctgaaactgtggatagtaccgaggccttttatacattatggtttttttcctctacatatatacatacctatgataaagtttataaattaggcaccataagagattaacaatagctaataataaaatagaacaattataatgataaactgtaataaaagttaattgagtgtagtctctctctctcaaaatatcttattgtactatactgaaggtaactgaaaccatagaaagcaaaactgccaataagcggggactactctattccaatcttatagaaatcaaagctcaaggagcagcatacctccagttgcatagctcactgatattgaaactggaacttgaatacaaacactgttactttagccccatccccttcctgccagaccaccaaggttcccatcaaaaatataagctgatatgagctacagagatatctgtgaaatataaaccttggctttcataaagttgaatttgattcaccaagatgctgcaggacgagctggctgcttttaaacccatggagatgctgctgcccctttcctgcccaacacataacaggaccatcaaagtagactctagctcaccccctcccaaaggcactacagtattttatggcatttttaccttcatcccaactttggtaaatatcctcaaattcagattagatgaccagctttagatgatttcaaatggctttttcatccaagactcctgaccctcattctaggagccctggctcaggccacatagcagtctcaaaaagctgacttcccaatttttttttttatcctatttcttggctaatttgggtatgacttgatcaaatagtatctcctctaatagacagaatgaggcagacaacagcaacccactgattttctaaggccacttttgatcttttttacccccttcccctcccatatgttacatttgcctaggtttttaacatctgttcccaaagaggtaatatttgcttttcattcagagctcagcaatgtggaccaaagttcacatgacatattgcagagtatgtttagttgcaaatgctatgtacaggctctttgaaatgtagcatgtatggcaccatgtgacacatggttgccatggcaatacactttttggctgaactacagcagaagcccatggaacatacattactaatatgagactctgccctgtgctaatgcataggacacagccaatctgggatctgggactcaaggggttttgcatgcaggctgggtggcaggtgccctcttcctgcatgttcagggaagatgtggcatcctcccttccagtcctgtctcccaggcacagggcatgctgtgcattctgccatgcatggagacagcatttgcttgaatatcggtttgctatattttgtatcaaagggggccccagctgaaaacattttattttgtaaactgaagtgaaaaatcagtttatggcagatccttttttgaataatgacattctttctcccaattccagaattcaacagtcatgagcagagctgaaaattttaaacaagttgagtacctccttattcatggaacagcagatggtgagtttcagttaattagactttttagtatcacagacaggtttgcaatttcactactgacaaaacaaaagcatgaggggcaagactgttacatttacttcaataaaacagtgttgctttccacaagtcacttgtcttgggctaaatgggatgctgagtcctagaacttcaaacagtccctttcttcttgtgcctttcccaccccttggtaccagaaaactggagtggctattagctactttatgtttcctttctctccctgcagataacgttcactttcagcagtcagctcagatctccaaagccctggtcgatgttggagtggatttccaggcaatggtatagaaaaactttgtgcaaggggagggaagttgctggtggggtctagtttcctctttctgggctaattcttttagcagtgccacagacaggacagaataaaaacattaaaaatttttttttcaacgtgaagtcagaagagtggtatccttcagccatgcacagagtaatgctcaataatattagcgagtttggggttaagaagcacaatatcgcatatgctgggagtatcaagacactgctctcctgttcatgtgattgttcagtctctccctattttgattcaaaagtaatcacttgttcagtaaatgtgtggcagagtaattctaaagtgaaaccagcatgataatagctcagctcaaatatgaaaatccatttctgtctggtatgtattactagctattctaacaacagtgggatcttaataatcagcatgcttcagtttttgcaattacaaggtgatcttttgttgaataaccacaggcgataaacaattaggattgttttataaagtcaggaatggctagagctgttgttgtctatgcagaggatatttctacgtattatgtcaaattcattttctgcattagagattttcagatgaaggaaaacgtatttttaatgtgtgcatgtatgtatatgtatttatgtgtcctctaacacacatgatttgctctgtgctcagttcaaatggtgcccaatgcacaggagtgggacagttacttgatactgagaaaaactggctatcttttgggtcagtgttttataagaggttgaagtttatttttctactattcaaagaaaagacaaatgctactttaattaagctttttttaaagttaacttatgtctccataatttatgtttgcccggtaatgacttcccaattatttaacaaggtatgaatcaataaatttttgtcccagatcattaattccttttacataaatgtcaaatacacagatttcttaaaataccagtttaaaatctaagtgtttacaaataatacatctgatttttgacttcacttctattaaacatatatatgtaatattgaaatagagtttttccagtttctaggtgctatatattaggcaatattgctttaaaaaaaatcatttagtttaatacagtttatcttactagagtacagagaaatttaacacttgataacagtttaattaaaacaagtgggcttaatgggataatcattccttcccatgcatgctgtgtaagcgccctttgagtcaaatttggaaatggattgggtgttttaattaaaatgtacgtatctttaaagcactattcaataaagccaaattcacagtgagttctctcagcacctgcaaaagaggatcagagacttctgcaggacagaacaacgtgccctggaaaagctctgggggaaaattagaccccctctttgaccccgtttcagtttataaactgcctcaggaattaaaacactctgttttataccatgtatgctcgtgagagctcatttgaatttacgtatttttttttttaagaagagtactgacttcctaattctaacttcttttctttctctctctagtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaatgacttgtgtcttgaataagacctaaaccgcactggcatatggacacatttatctagaaaggctcttgtttattttgttagtaatcccagactaccttgtaaacatggaaagagttcagctttggtaaaaaaattagatatataaaaatgtgttaagctaaacagttcataggtttttgcctaataatgtgcaatttctcttatcataaatacatacagcttttgagaaatcaacttaaactaattttagttacttatatcatacacaatttataattttattccagggaactatgatgaggcttatataagaacgaataagatcagaaatatcattctggcagttcttatggctcagtagaagtagtcaattatttaagtggttgactatttgtggttgacattactataaaaatgaaagtggccaggcatggtggctcacgcctgtaatctcagccctttgggaggctgaggcaggcagatcacgaggtcaggagatcgagatcatcctggctaacacagtgaaaccccatctctactaaaaatacaaaaaattagctaggcatcgtggcgggcgcctgtagtcccacctactggggacactgaggcaggagaatggtgtgaacccgggaggcggaagttgcagtgagccgagatcacaccactgtactccagcctgggctacagaatgagactccgtctcaaaaaaaaaaaaaaaaagaaaaaaagaaagcataaattttttttttttccgagacagagtcttgctctgttgcccaggctggagtgcagtggcatgatctcggctcctgggttcaaacgattcttctgtctcagcctcccaagtagctgggattacaggtgcgtgccaccatgcctggctaatttttgtatttttagtagagatgggtttttgtcctgttggctaggctggtcacgaactcttaacctcaggtgatccgcccgccttggccttccaaagtgctaggattacaggcgtgagccaccacatctgaccgaaagcaataattttaaatgctgaatttggcctagcaaagcaatatccagataacagaaaacatcatttttttcaattatttgcaaaacagcctcatttttaaaaatttgactttatgagtttaaacttagcttcagaccatttgctagacaaagttttcccagacagggtgagctacagcataaaaacctaaaaatggaagaaatggaaaaaaaaatctaccaattgaacatgagactggtgagtcatgcataggaatggacagaggattgtgaaatccatcttcaactacagcttcagagcatgccattgagtcacttcaccttaattaaatctcaactcccactcctccattggaaccacaaactgaccttccaatctgtaggactcttcttgtcaaaattctgtttcttaatacagttcaatcattgtgagtagctggatcaatctttgcagaattgtatatcaagaagcggtagtaatatatgttcacatcctggacagcattaatagtcataaaagcaaattaaatagaaattctccttttatcttaattgaagccagacattgtacaatgtcagatattgtacaacatcatatatcatacaagtcagatattataatcgtaatatctaagtcagatactatttaatatttatacaatatcaaaatgatatggattaatatttctttagtttctaagcatgtgcagtattttctctggagtgaggtaatcccagcacatatttttcaagcattgaaggctgcaaaaagtaataatgtgagtaaagtcgaagtagttttcatttgaccctcataggacaagttttcctttccaatgagagttttaaattagcttatggaaaaaagaagaaaatggacaaataagttagagataaacttaatctgagaataagtttaaaacatacaggaaccagtcataccactaagatgtgcagacttgtcttgacatt

SEQ ID NO: 12018 - DNA, 44947 bp, Human
  misc_feature (1)...(44947): n = A,T,C or G
caattggttcctatgtcgcttattttgaagaggagatcaggccatatttctagccttttgctgaagctagcaacttaagtttttaaaatttcacctcaaaagaaaagatatatatacacactattttctagctgaaggttttcaataatagtaatgatcatcatgatgaccacagttattaatgatgtattatatgtatcaaaattgctaaaataatagatttctaatgttcttgctacaaaaaaaatgataagttggtgggatgatgaatatgttaattggctgggctgaatttttctgcatagtatacatagatcaaaacatcacgctggagcccataaatatatacaattattatttgtcaattaaaaataaataataaaaatacttcataaaaaaatcacataataattttaaaatggaactgaaaaaaaacagtaattctgggtcctttagacactttgtaaacactagtcctagatcctatgtaaatactagtcctagatcctatgtaaatactagtcctaggaagtattttctttctttctttctttctttttttcttttttttgagacagagtcttgctctgttacccaggttgggtgcagtggtgcgatcttggctcactgcaacctccacctcccaggttcaagtgattctcctgcctcagcctcctgagtagatgggattacaggcgcacaccaccacgcccagctaatttttgtatttttttggtagagacgggggttttaccatgttggtcaggcttgtctcgaactcctgaccttgtgatccgcctgcctcggcctcccaaagtgtgggattatataggcgtgagccaccacgcccgaccctaggaagtattttctaagttccagtgccatcagagcttataaaatttttagaggcaaatcagtgaacttaagcaacccactcccaaccagtctttgtctctctccatatacaccctgttcccagagatggagggaggaaagaagaaagctgcttttatcctttgctgtggcctgggactgctggggctttaaatctttgtatgtttgtgtaggagggtgaggatggggactttctgactgctattcatccacctattcattcaatttactcattcaacatatatttattaagtaacctactgtgtgctgggcacttggtaaagggatataatcttatctatcctgccagtggcttctcccaggtctctgagggtgtttggagctcataccctcttctctttaacaagcgtgacagttaaaagagtaagggctggtatggacaaaagcaggaaggtgcctggggtagtagtcattgaggtgagtcatggaggagctgtattttcctgaattattcaagatccattttgtttccccaatttgttgaggctttttctacacgtgagatctaagagggtgtgaggatgagacttaggggtgactggcagactgtcctgagcccaaaactgtaccttgagtaccagtgatgattccagaccacagtgtttcaaccctcaacacagaagcagaatcctggactggctaccgaggggcccctgccagctgctggctccaaagttggttttgtctgtgggctagatcggtgtaagttggggtccaggctgctcgctcagcagcctgattgatctccagggctcttttgtctcctcctccccagtggaagcctctccccctcttcccctctccccctctccccctctctccctcttccccctctccttgtctccttctctccccctctgcttctcaggctcttccgctttcctcctctgcttctaatgaattgacatctccaagagccgccacatctctggtagttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggtaggccacagaaaaattatttccaagccttggccttgttcagctggctgaggggaaatgactgagggaggggaagctccagaggtactgtgtggcgggcgaggggtggggggagagagggaaaatgagtgtgtgtgtgcgtgtgtgtgtgtgtgtgtgtgtgtgtgtacgcgtgcctgcctgcggtctgcttgcatgtgcctttagtggaaaacttgcatttaaaaatgcccacaataaagtagtcaccatttagattcataaagaaaaaaaaaaagatgcccaagaatagaaactcaagccgatttgagcaactaaggtctaaaaatgaataagaaggaggtacacagtttgcttctttgagaaaagaggggcatttatttattttaggttctcaatagcatgctttttgtccaagggtatacttcttggcaggagggaagcaaaggtgtgtggaaagccttggctaacaagggaggagagaggaaacatgggaccttggagcaggttccctgaacaaatgagtattctggccagcagacaggacacaggagttctttgctgaagtaaaccaggctctgacctaagagcctggagctgaagggctcatctcatctctgtatttacttcctggctctgttgtttttcctgtgacatttttcccccttatcttctcccctggtttcctttctacaccctgtaatcaggaggcatctttccactcttgaaagcatagcttggagtggtttcaaatagggcttgcttctcttggagtccaacaccctatcaccttctgctctcaccacctttcccagcatcggaccaagtgccccagcctagtaagtgggcctgagactatatgggtagttaatgtttatccttcctttggtaggcaggtcgagccaggcctcacaggtgttgggtctaagcaggtggcaaggctgggctggggtggggtggagtggggtagaggagaacgtcagcagcagctgctgcctgcttccgttgaaagcatggtgcatgctgtctggaaaagaacatactttttaaaaatgttttctttttgattgtcaaaagaacaaaagccttaaaaaagctctatgtctagttcatcttaattcctgacttttccaaagaatccttgtttctagatgaaaggccctcaggtaaatcaccttttaaaaggcctgtgggaaccacaagcctcaggtgattttccttctaaggtttgcgtggggagatgatcccagagaatctcagggccttctaaggaaacctccgtgaaaaggcagtgttggaagtggcagtgttgtgtcctgtttctgaaagaagaccaagcccctctgtctctgggttggcaggcctctgtcctgtagtcttgctttctgtaaaccattgctgggggatgaaggcacatggaaagaactcctcttcctgtgagatttgtacttctaggcattcagcctcagctaagtagctctgtgctccaggtcagattacccttcaagtccaccataaaggaggggagcatagcttgaagcaatgaatttagcaaaggccctgagccagatgcggagagcacatctgcgattcagcccttctaactatggatgctcagaagtttctgatgttggatctgccaccatgccagctaggatggggtctcactaatgaaggccaagaagatagtcttctaaacttctcagggatacacactcagaggaaacccattcagtggaaattatactatgaaatgacattcctcccttatgaaggattctaaacatgcatcagcaacaaaaatagcaagtgagataaatccttctaggatagcatttaccaaaccaatgttctatagagccccatcctgagagaatgttaatagattctgttttaaaataagtgttgggggtgtgtgtgtgtgtgcatgcatgtgtgtgtattctgcagttcaatacttttttggaaatgcttcttaaccgaattctcattttggagagtcacagtgtatgtaacgcatattaaagactctgagaagtactgctgtaaatgaatgtttaattttgtttaacccagtacatcccagactggtttgaccagggaacacttttctgtatggaaaacactttttgcctcttgcagatacagtttggggaactgctgctaaaaaaaaataataaaataaaaaataaaaaaataaaaaactggaagaaatcgtcacatggataacacttgtaaaataatctagtccaacaatgcatttctaaacatgaaaaacccaagaggttaatcatattgttttccttcccatagctgatgagaatctgggattatctcctgattccccagcccactgtacccaactgctgcttctctagcaggtcccctcctgtgaaactagttccaggaaaatgaagcagatttaaggaataatccttaaattttgagtgcaatatttacatttaatacatttcttctagtattttgctatatgcaaaaattgtcaactttcttttcagcatgggctttgttgcattcttttaaacaatgtgttatgaaatatctttgttcattcaaaaggtataaaaataatatggtgaaaatcaggttattcactgcccagcttaataaagaaacattaccagtagagttgaaaccttctgtctattctccatgattaaagttctctctttccttccaaagtaaccactatcctggatttggtgtttattattcccatgcattgatttatatacttttactacacatgtatatatttttaaacaacatatactactgctttatatgttttaaaagtttgtatcagtggtgtatcatacgtattcttctgcaacgtgatttctcttttcttttttctccccgccaagagacgagatcttgcactgttatccaggctgaagtgaagtggtgtgatcatagctcactgcagtctcgagctcctgggctggagcaatcctccagcctcaccaccccccaggtggcaccaccatgcccagctaattttttttccttcatagagacagggtcctgctatgttgtccaggctgatctcaaactcctggcctcatgtagtcctcctgcctcagcctcccaaagtgttgggattacagccatgagccactgcacctgccttgaaacttattttttctattcaatgttatatttgtgaaaagcatccatgttgtaacacgggtctctagtttactcatttttttcactattgtatactcctgtaatgactataccacactttatctattctgctgttgatggacatttaggctatttctagttttgagcaatcacagaggtactgtgatcattcttgtgtagctattcttaggtgacaatttctactgggtaaatatctgggtggaattgtccccttacagggtatgtgcattgtcacctttgggagatattgtcaaatcactgtgcaaaatagtttactaacttacactcccaccatcagtgtataaaggtttcaggtttattgcattaattggctcttagagttttctcccatggggatgcatctctgattttttaattggataataaattttatttctcaaaattgcttgacagctaaacttctcaggaatacgtttccttgttttcatttgtaaatgaggggattggcctagatgatctcaaaggtcctttctagcttgaaaatctgagtttctatgatttattcattaaatcaggtacatctgaagcagaaccttggttttttgggtgcattgcaggaattattttaggaactataacaaagtttgttaccagtgaaatgtgtatcttctctcttactgccatgctgtcaggtagaaagccagtggtatgagagaaaaggcagttacacagtgttaccttggattggggagaggattctgtagcccatgggaagggggtcgccttcccattgccctgttctttacagaacctctacatcttagaagtcttccctatctcttgaattttttctcccaagaataataaatgtttgctgggttttttttgttttttttttttttttttttttttttttttgaaatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaaaaaaaaacaaaaaaaacccaaaaaacccggatgtccaggcttcctttctgcacatgcacacagtagattttttaaaaatgtttttacaaaattggagttccactaaacatgctattctgacatttgttttctttggcctaaaatatataactttgaaatctgtccaaatcagtgcatatagatctacctctttctttttaacagctacataatattcgccgtgtgagtggctatcgtaatagataacatttgaatatctactaaatgccagaaactatgaattaactcctctcaacaaagctaagaggtaggtctttttgttatccctgtttcacagatgtggggactggagcacagtaaggttggggagcttgtccatatatgtgccgataagtggccaaggtgcaagccagagcatcctggttcagagcctatgtcccagacaataatgctgtgatatgtctcagacatagtctactcaccagtcccccgctggtggacatttgagtgaatgcagatttttgctattgcaaacaatactgcagcaaacatctttgtccacttctggaggtctttttgtaacataggctcttagatttctctggtttctaggtggaaagagcttatttattgaaaaaaaaatttattgagctctaggcattggggaggctctgagcttaaaataggagacttgaccagaatttcacttctcagatgtcctataaaggtcacttaagtgcttttcatgatttgccagcctggtgctgccccattagactcactgcatcttatctgtttttaattgcttgtgtctttgcctgggtagtggcataactgagtcaatgcttgggctcgcacctggtggtctatagccaaaaattgtctccattgtatccattgtatggatacactttccaggtatcagtgattacaatgcctcagagcctgggttctagaatttacagaggcagaatagcataatgataaataacttgtattctgagacacaactgcctgggtacaaatcccagctcttcacgatgtattcacaatatgactctgaacaagttacttaccatctctgtgcccccattttctcatccacacaatgaggatagcaatagtaactactttatagggttgttgtaaggattaaatgagttaatgtatgtagactgcttagttaatatatataaaacacagaatacagttattatttatttgactatggaaaagctggcacaccaatctttccataaaatagttgttgacctccttgtattttggtggggagcggagagggggcgaagaattagctgttattaaataggtaatgtgttcacatgggtcaaaattcaaaaagtacaaaatgatatttagtaaaaaattttatctcctattggcaacatggggcttatgtggtgtggggaataattctgtttctcaacctgagaagtgattatatgaatttactttataataatttaatatactttacatatatgctttatgtacttttataggtatatttctcattttgaaaagggcagaaatagtagaaatcccaaagacatggggagaatttttactgctcagttcccttctccaatggtaacaggctcttttgtatacttccaaagatatttttttgcatctataagcacatatttttagtatacaaatgtagactaaccaccaccttgatttttctcttgttttctttttacttaaggtatatcataagagatcattttgtattggcatataaagagttcttaattattttttaagtagctgtatagaattccattgtatggatacaccattatttaattagtcccctagtgatagacgtttaagtttttgcaattttttttgccatttcaagccttgtttcaaatgctgacattgtacttattattgtacttgtttcaaatgctaacattgtacattattccacacaaatttaagtagcatatgttcctatacatctccagtttatgggtgcctagcactgtgttaaaaatatgtgggatataaataaatatcaggtgtgggttttgtcccccatgagccaacaatcttgctttcatgctgaaatcctaatatctcccctgtgtttttaaagctttttatctctgctcaagagaaacaatgccttcccactgaatcctcctcaaacagcctgtgtatggcttttagaaccaggaagagtatttgtagtagcaaaaagccacagtttggtatccagcagggtccctaggggagggcagggaaggcttattgccacccaaaaagcatcctccacacctgcatatgtcaaaatcttctctttcaccttagctcgaaagcttcttttccataaatacatcccaaatccctccaactagaagtgaacacttcctcctctgtgacctcttataccataatttctgtgtcttgctgtctcagtccattttctgttgcttataacagaatacctgaaactgagtaatttataagaaaaggaatttatttcttacagttatggaagctgagaagtccaagtttgaggggctgcatctggtgagagtcttcttgctgtcataaactctctgaagcatcccaagatggcacggagtatcacatggctagagggcttagtgtgctagttcagatatctcttcctctttttataaagccatgaattctcctcccgtgataacttattaattcattaatccatgagtggattaatccattcatgagggcaaagccctcatcacctcttaaaggctccagctctcaatactgtcacattggggacagatattcaaaccacagcacccacgtatggtatgaataattttccccgctaaaattatccttttttttgtttgtttatatgtcttgtttcctacatttgaccagttggggaccaagtctgattcatcttcaatctctcatagcctttgcaaattaaaaagaggaataggaaaaaaatcagtatgtgcagatggtgatttgagataggatggagctagatagaggcagaagaatctttgtgtataacaaagagtactcgcccaggaatcaggaggccctggttcacttgtgtctcagcatcttcatctgtaaagtgggatcttaattctgactgggacaactttactaggttgtactgaggatcatgaaagacagcacagccgactacaaaggcatgctatatgaatacagagaatgatagtgtttggtgcttagcaacccttaaacattaacacttgatacattagcaaactaaggcctagagaggcaatatgacttgaggtcacagtcaggggcaaagtctaaaaagagcagaggatagtcattttaggaccagaagaaatctattccttttctgcctgtgttaggattagaaggtctgaattctctgactccttggtttatcttagttttgttttgtgaagccttaacctagcatcaggtcagtagaggaataagaaagaatcttataatctggagagaaatgaatctcaaaagagaagaaaagagatagttgatgaaagaagagatacaaacgaccactaaaagtgtggaggaaaagctaaatatctttagcaattaaggaaacgcaaagtaatcctcaaaatgccattttcacttacaaagttggcaaataaagtaagaatacatactgtggacaagtgtgctgggaaactggcactctcatacattgctagtagtagtgtaaaatgatataactttttctagggcaatttagacatatgtatcataaacgctttgatccaggaattctcccttataggcaattatcctatggaaagaatcacaaatatgcacaaggttgttcactgcactttgatttataaaaaagaagaactataaacatatgtctaattgttaaactatggtgtatccattcagtgggatactatacaatgacgatagctaacacttattgagttgtgtattgttgccagacactgtgctaagttatttaaattattaactttaatcattagaataattctgtgaggatgctatcattatttatccccattttgcagatgaggacactgaggctcagagaggttaacttgtcctggaccacactgctaataggttgaatagtgtggatttgactctaggtctgtctgatgccagtgcccatggcctcagtcacagtgctgtacttcctatgcagctgttaaaaatcatgttttaggctgggcgtggtggctcacacctgtaatataaacactttgcgaggctgaggcaggctgatcacttgagctcaggagtttgagaccagcctggcaacatgacaaaaccccgtctctaccaaaaatacaaaaaattatccaggcattgtggtgcacacctgtagtcccagctacctgggggtactgaggcaggaagatctcttgagcctgggaggttgcagtgagccaagatcacgccagtgcactccagcctgggtgacaaagtgagagaccctgtctcaaaaaaaaaaatcatgttttaagggaatagttaatgacattctaaaatgaccatgatataatggcaagtgaaaaaagcaggctacgaaatgatagcatgtgatggcgattttattttaaaagtgtatgtatatatttttcagagaaaaactaaagttcatagctgttagtaatgattatctctgggtggtaatattacagattatttttattttcatccttattattttttgtatttcccagtttttctatcaagaacatgtattacttctataatcagcaaaaataaaaatgttaacataaaaagaggtctgaaagcaagcctcttgtagcctttatgcttataacacatccatagcagtacttcattttttaatctaagtgactaatgcttttgtggtgtctgatcacagaggagccatattttcagtcattctttggggatgagtagctacatagctgtataatctatagggactttgactacaacaaagtaccctttagaccacaacctcttgtgcccttgtgatttgtaataatctccattctttggactatggtctcctgaggaggaggggtgggtacttaatgcaaggagtccacatatctttaaatgcataaatgtttttctcactcggtaagttctaaaagtacagctactattgtgggtgagagtgggtgaagtgagattttttttttttagtcttaagaagggcctcttatatctaaaacattgtgaaccactggaatagagtctaaaaatggtggttatttaattatctgcatcatgaataaaagatgctcagttccggccctttgaatcagggtttgtgtgtctttgccccacactaaaagagatcaccttattatttgcaagcatcatctttgccacccattctcatcacatttgtttacattctctaaaccatcaattggtttgtacatctaaactttgtccccatatttctcctttactaagcttagctctttacatctaaagctgaatatgtctcaagcatagcttattatgcaacactgcccctattccctacacagcaaatttactctttctcctgtcttccttctcttgctgttggcaacattatccactcagctcccaaattagaaacctttgactccttctcctcccttactgttcacatccaattgatcatcaagcccagtgtattttacctctccaatgtacctcagagtcatgctgtctgcttcatcctcacggcaactgcctgcctattctaacagcttctcaacaggttcttccttttggagaatcactctataaggaaggcagggggctctttctaaaatgcaaatctcggccaggcacagtggctcatgcctgtaatcccagcactttgggaggccgaggcgggtggatcacctgaggtcaggagttcaagaccagcctggccaacatgacgaaaccccatctctactaaaaatacgaaaaattagtggggcatggtggcaggcacctgtaatcccagctactcaggaggctgaggcaggagaatcgcttgaacctgggaggcagaggttgcagtgagctgagatcgcgccactgcactccggcctgggcaacaagagcgagactcccgtctaaaataaataaataaataaataaaataaaatgcaaatctcattatgtcactccctgcttaaaatcttcagtgcctccccattgtctacaagataaagcctacaatcctctgcttgtcattcaaggcatggcccaatgtggccacagcctcacctcctgctacacacaacaaggcacctaccttgtactctggtcacacggaacacaccatatatttaattttcatgtttgtattttttttaaccttcactgcctaatgacaaatctgtttctctttcatgactcacctcaagcacatttcctctagggagacttttcttgacatgaccagatagaactcacgattccctcatctgtctcttcacttcatcccataaacaattccattatgacctcaaataacactttatggccattattttctccacatttgttctctctgtatgtgatactcctcaggggaagcccccatgtctttttcatctctgtgcctcttaaactctaaccataccgatcccattgtcctctgaacatgctaggcctttttatgacatccacctttgcacaggtggatctgtctgctgggaatgccattctccctttctcctctgcacaagcaaatatctacttatcttttgagactcatctcaagtgtgctctttctgaaatacgtgcatattctcagagttagctgttccccactctgtgctcccttagccttttggtaaactcttgattttagcatttgctatgtaagcattttattataattatcagcatacatgactgcctcccctacccatcttgcccacctccacccttaggctttgagatctcagcagttatctttatgtctctagcacaaagcactataggtaaacaataaatgcttccttggtcaataattaaataaagtattttatggtacatggtggcctgggtaggtcagtaagttttgaatacttatttgtatatctggtcaaggcacctctgggtagatgcttgattcataggcttttctaggtcttgactcgaaatctctctgtattgcttttccaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggtaagagtctgatagtgaaagaaagacctgtggagaaagtggacacaggatctgtgtgtccttggggtacccacgcttcctaaggctcaggggcactctctgtatacatgcaaccccttggatagcatggggaatatattgggcccatcctttattactcattatgtcttttattggggggcataaggaaaggaagggtgttgggctgggcagctcagagggcccactgcagctgagcggggctggttccatgttaaccttctaagagttacaggtccaggaatgtcctagaagagtatgatccttcagggcatggtctaggactaggcaggtccttcctttggcttggcttctctgtggcatgccttccattttccacaggtgtctctctcctgccatcggcttttcctctcaagttcctagcctttttcatagctcctggctcatccccacttagaattccatgagctccatatctgcctgtcctctctgctcctgtagtagtgcgatggtggtggtgtatgtgtccgcctgtgtatgttggtaggcaggtagaggatgtgtgtgagacagtagagagggcagccccctttcccgacaatgagggaggtctagggaaagttgactggagaagggagacgcataagcatactttggttgccctacaatgctttggggtccagagactatgggggtgtgagaaagtgctatgtctcctggagcctcacagatgggctgcagtgctgagtcactgctgggaggcaggcagcggccgaatatacaggaaggaggaagggaggaagaaaggaagtggggatggagaatgtggatgctggggagcctgttttgggggcagtaatgaaggaaagtcaaggtccagagagacattagagtcaggtccccctgagctattttccccacatccagctagaaagaaattactgcctcgaacatattctcaaagcgagagtcaacatagactcccccattaacctaccccttccccggagtgggactttcacagggtcgagggattaagaaaactgagcccttccaaaggcttaccctgttcattgtctaccccctccaaacaccaccatgtaggcagggaaacctgagggcttcattttgtgattgccaatagcatgggcaacttctctcttctgccacgatccagtttctcttcctttcctgcaacctttttctcaaagattcaggggatggatagagagccttgaggggagtggggtgcaagaagcaaatatcctggctacaaaagccagaagtagaaggtaattgatagggaaggagaaagaaatgtgcctattgtgtgcctggctctgctaggtgtgacttgagagtataccgggaagtaggagagggagagcagggtgatggagaatagtatggcagctgggtggggatttgggaaaccaagaagtctgcagggaatgcaaagctaacatgggtagagcccagctcatcgtgggtgctcccctcagagccaggacagcttggttgtggctgggtcacaaggggctttttctaactctggacattcccagtgcagaggacccagcatgagtgaagatatggcccagagctagaacgactccctgctcttggcctgccatcccctgccatcccccagccaccctgggtggctccaccccagaaccccagaaagagtcaggcagctgttccaactattcctgtaggtggacctcagcatggaaacaatgtggaactgttggaaagcccagaagactctgtgggagataaataaggatgggaacagaaccctttttggtaaaaacgatgtgttttccctcagtgctgagggatgggggaccagcttgggaatgttaacctttccccagacaagtctgctggaaaaggagaagagtggccacttccaggaggggccctacccctcaggccagtggcttacaggaaagggccttcccctgcccccacccagggtagcacaggcaggacacaggagcctccctggcaatggctgcctacatggaactgctgggtcccagtgacccctttccctcccctgtgaaaattcaacgggatgcccactaactatccatttccctttggcctcagggtacagcgagaggtctgagggctatggctctccctccactcctctctgcctctcaaaggcagggcagagcacccctccattttcacagtagactctgacgaatctcctggcctctgcactcacccaaggataatcacatttagagggattctgctgcgcctgcttgccgatgctgccatcccatggctctgtccccagatgtgccacaaaccttcctcactgtctctgaggaggcttacttagttgaagacaaggcttattttccaagcccatcctcttatgtcttagggaaattgcttaccagaagcttgtcaccaaagtggtctgatcttatcctccacctcaggggaggggtgggcctagaggcagagtgagccctttgtgtcttccatggaaagggaaaataaatcaacagaagctgccctctgcatgcccctcctcagcaccatggaatgcccagtcccactcccgccatccttgccagcctgagagggccatcctggccctggtgtggcaggcccagttgggagtgaaccggaattctccagagacaaagctctgattcaccagccaggccctgacatagccgccccctccagattcctggggggtcagtaaacaaacagggtgacccctgcctcctggcctggctcagcccctcctgcctccctgagagggcttgctcagagcctgtcaggattctgcctgtttgtggctcaccagacactaggtctggattcctggtgagggatgatcatggagctgccggatcctgctatggactccccaggcagcacaggtaggatcagctcctggggctgcaggctggctgagtgctgagcttttcccatagcttgactgcttcctcacttccctttctcggtgtggctgtgagctatggttttaatgggatgattggtttcctaaattgcctggagagtcttgtgtgggaaagaagtatggttgggggcaaggggagactacaagagtcttggccactgactagcagggccattttctttgcaaatgaaggcaagcatgtagacaagcaggtaggcaggtgtgggtctccctagtctggggtagagcagcccaggctgatttcctcctccaattccccttccctctgcctgctcctgccccctggctgggcagttctgacactgttctataggtagctaccttccttagggctatccgggataaccaccattcccccaaaccccacaattacccccatagggccttaccagtgcccaggagagcaagcaatagactgtgtgcctgagggctcaagactagactttggcaggctccatggcttgtcctcttggccatcaactctggtcagagtcctctgctcatctttatgagcagttctcttgaagactgtgtccaggcttcctgactgtggtggacacatcaaagccaagtttcatatgggaagtaagacgtggaccactgatagttctctcttgccagtctactccctctataaatctttatggagaaactcctcagcttgcttttctagaaggttgggtaaactgtaggaccctgaagtatgagccaacagcttacctgcaatggtatggttgcccataatttgggcaattctgtgcagcttcttacctaatgcaggtacttccaagaccccatctgggcagtggtcctgaggagtgggggcccagcttgggaatgttaacctttccctaggtccaaaatttataatcatgagtaacaataatagtaggcagcagttctatgtaactgacctgtaccaagagaagacttggcaatgaacaggaccacagggtctttcttcatctcagtccctgaacacacagagaatagcatttctgaaccctggcagcaacccttctctccccttgttcacacttgtctcacccttggcttggtgcagaccagggtgtggcacaatccaaggatcacaggatgtttgtgtttctgtccaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccggtaagaaacaggtgccttagggaattggcttagatggtgttgggctccttttgctgctgcaccctgtccttctcctctcagcctgtgcatccccctttccttagcccacccacttctccctttcctacactggcactggggaaacagccttgctttagaagtcaggagacttggatctgagcctcagttttaagtagttgtgtcaccctgaatactttgtttgagttctcgaaatgttagcttccatttgttttttataaggacaaaaaatgagtggaggaataatacctgttctaactacctcacagtgtggtcataggaattcaaatcagatgtggaaatgctttctaaacttaaaaatgccgaggtataaatgaaggggatgattgctcccttctcctcttcctctcatagctgtcctatatcttggtaggtctcatctgttcacttccccatccttttacgttctatccataagttttcagcccacctatttctccccaaactaagggtagctctgtaagagcctgaagtcaatttttttctcagttgatcggctttccctagctgtctgtgcatgcctgccactttttttctccaccctctatcatcaaagtccaagcttctggcttctgatgggctttgttaggggtgaggcattgtggataagttgaaagaatgcaggctttggagtcaggtaaacctgagttcaaatcatcgctctatcaatgacttaactgtgtgacctttgggaacctacttaccctttctgggcaataggaatgcctacttaataaggtttttgtaagaattagttgaagcaataatttaggtaaagatcttggcctaggtggtggtgaggggggggcaatgaataaagatagttattattgtcagccaaggggaatggcttgatggctgcacatatccttggccagcctccagcttcctaccatggttcatttggagggcagcggggtaggagggcagacagagataattatacagtacagatttttctgtttccatatctcagacctctagccaatgttcctttgggtcccaaggactgttatattcgtatgcatccttgcacatgtgcatgcctatactcaaccacccaacttgccctttccacttactgaatcctctcctgctcagagggcagttcggaacagcctctatggttgagcagtttggcatgacttgaattctaccagggcaagaggggaaccagacagctgtcacctctaatgcccttgttcagtttcctacccttcccagcctgatgtttggcatgcaactgaagtaactgagatccacaaagtgacattttaagccattgaagtttgggatgcctccacacccatggttctacctactggttttagtactgtgctctatgtggaggtgccttgggaccctctttgggtgggtaagagggaggactccaggcctcctcccacttgaaccagaaaagctcctcctgaatttgttttctatattaaagttccatataacttagtttggaaaaaaaaatgttttgccacttaaaaagaagactgaacatcactggttttactcattgtgtgcagcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggtaggttagaatcagagaagccgtggtgtgtagcctctcagctggggaggaatcccttcttcagtaccctgacagacacccagctctgctgagacacctaaatgaataggaggctgtatgcagtcctattagtctgtggctagcatgccacagcctaagtcaaatattttctttctacccctcccatcaaattctagcctcccttaaaatactgccatgatttttaatgggaacatggggaaatgaacataacataatgctaagtgaaaaaacacaggatacaaaactaagtgcaagtggatctcaattgtataaaaatgtatatagatgagtgtgatgtttacatacatataacagcataggaaggaactatatcaaaatgttaacaatggttaactctaggtaataaaattggagttcttaattttcttcatatctttctgaaatttctaatatttctgtgatatatattactgctgtagttaaaatacttcttaaaatgactacagaatgaaatataatacagcaataaaataaactataaccacgtgccacagcatgggtgaatcttacagacagacaatatgttgagtgaaaaaaagccggatacaaaaagagtatatactgtatgattccacttatacaaagtttaaaaataggcaaaactaatcagtgattttacaagtaaaaattgtggtcacctttgtgggaggggagggaggggtggggcatgaaggtgagatagtgactaggagggcccacctgggatgctgatagagttctgtttcttgatctcagtactggttacatcaagatgtacagttttagtttgtgtatcccgtatatatttcaaccaaaaatttaattataattttaatataaatcctgcctatcttggttttgatttccataagacccttacaggaagctttctgagtcttctggagaaccaagatccccacatttttctctatcctgtggcatagacagacaaatttcatactaaacagaccttccagtgtcagagttatttttctgtctatcaggaggattgcacgcctttttgtctaggtagttcaaagatacctgataatgccaaagaatcaagacacactgagaagaagaaaggttgtcaattgcaggatggaatgtaaagtgattgaaaaactttcctttcctgttgaccatattgctaaactttataggcctttatggaagaagtcaagtctcggggcccctacatctattctgtgctggagtcagctcaggccttcctgtcccagcacccatttgaggagttagaggagcctcattctgagagcaaaggtaggtggtcttctgtttttcccacttcttcttgagccatgtactgctgaatgctgaacaaacaccctcctgccttccccaaactcattttcttacctgttatctaggaggatagtttcccccaggagtccatccaaagttggggggaagcaagattcctactgcaggaaaaaaagcaaagagaatatagcctggagcaggggtcaacagttgtgtgacccaaagctgtatgtggctctttggagcagcatgtgtggccatttaatgagatgtggaaaagaaaaacaaaaaaccactcaaatgaattgaactgactcaatgaataaaagtaccagtatgtcctttaaaaacatagtgctggctgggcacagtggctcatgtctgtaattccagcactttgggaggctgaggcaagaagatcacttgtgcccagaaattcaagactagcctgggcaacatagtgagacccccatctctacaatttttttttgtgggggacggagtctcgctctgtcgcccaggctgaagtgcagtggtgtgatcttggcccactgcaagctccgcctcctgggttcatgccattctcctgcctcagcctcccgagtagctgggactataggcacctgccaccacgcctggctaattttttgtatttttaatagagacggggtttcactgtgttagccaggatggtctcaatctcctgacctcgtgatccacccacctcggcctcccaaagtgctgggattacaggcgtgagccaccacgcctggcccaaaatttttttttaaattagctaggttttgtggtgtgtgcctgtagtcccagctacttgagaggctgaaatgggaggatcacttgagcccagaagttcgaggctgcagtgagctatgattgctccactgcattccagcctgggcaacagagcaagaccctgactctaaaaataaataatatacaataaaataacaaactaaaataatcataatttaaaaatactgctttattccaacatcgagggacatgcaaaccagcaaataataaacctttataaaatctaaaaagttaggtgatgattgcctttgaaaggcaaattgactatgactctttggaatttttttgtgtttagtctttgtttttgagacagcctctcacttcataacccaggctggagtgcagtggtgtgatcacagcttattgcagccttgacctcccaggcccaagctatcctccagcctcagcctcagcctcagcctcagcatcctgagtagctgggactacaggcgcatgctaccacacccagctaatttttgtgttttttgaagagaccaggtctcgccatgttggccaggctggtcttgaactcttgggctcaagtgatcggcctgcttggcctcctgaagtgttgggattacaggtgtaagccactgcccccagccgactgtgactctttgatactgactccaataacttctagccccttcccttgatagagagggccactctggtctataaggcagtgggatgggactcatggtgactagatctgagtggtggtccagcaagccctcttctccaaaaagaatcctcaaccctctgagatggattgtgaatagcctgaaaggacccttcatgaattgagccctttgtcaatgccatatgcccatctcagtttatttctggcccttcaatgggagggctagtacttaatttgatgcccgatgggcctcagataggacaagctctagaaagagcagcacaattctagttagcctggggctatggggctctggatcttctgaggagagatctgagggaggaagaagaaatctacagattaggagcctaggtggaaaagccagacacattataccaacttctcctgggctgagccttcataaaatgcctccctttggctggaagtgggcaacagaaactaatgcaaaatcacattccagggtcgtatgaatagggctctagatgacttgcctcactataccttttataatgtcttactttttcatttcctactgttttaaaatatgaggaaatcctcatgatatagtaagtggaaaaacacaatatggtctcttgactgtggtggcggatatataaaccaacgcatgtgataaaatcacatagaactaaacacacgtgtacacacacacacatacacacacgaatacaagtaaaactggggaaacttggacaaaattggcagattatgtcaatgtcaatatcctgattgtgatattatactgtagttttgcaagatgttgtcatttggggaaactgggtaaagggtacatgaaatctctgtgttattacttataactgcctatgactctacaatgatttaaaaataaacagtttttttttaaaaaaaacgtgactgtattaaagggctcaaccatggaaaaatatgtatttgtgtgtgtatgaatatatacacaaacatgcccacatgtgcacacacacatacacacacattttataaagggctgtttctgtctctttctttgagctgaccctgcctggttggcctaacctggcttcctgcctcctcttgcagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaaggtatgcaagccccctcccctgactacagtctaccctgagacctgacactctccccagacactgacaatgtttctgctgctgagactccattgttggcctggactacaactgagttgctgtcagtttatgtgctagatttggggctggtttggctggagtctcttctgttttcctactttcttctcttttcctggtgttttctgaggatgagaggaagaggataaggacagtggccgcccacaccttagtctggttgccctaataggcaagcactaggctgtgttattgaaacaaaacctctgggtgaagagggaagagtagaggtgaatgactaatgtttcttctttcccactctgtctgctgtggcacttgggtcctggttctccagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggtagaagagcagcctggagtgaaccatggggaggtgcctccatataactaggcttgggggaaacttcttcaggggtatggaaataggatctgcatgggaaaagaggagtggagaatgtggagctagggaatgggcttttcaacctctaagctgcagggaatgattaaaatgaataagaggggtctttctggatttgggcactcagggtagacaggggcaggggaagagtgactgtggcctggaattagggatgctctgctgtgacctttgggagttctgggggatggctaggagttgggtgacggtgggagaggctggaaccagagaaaagccagtccctgaggaagctcataaagattcccagaggcacctggggatcccactctaaatagctggaatgaatctactgacctcaccctgttctttccataggcgtcagttagtgagaggcttaagcagctccaggatgcccaccgggactttgggcctgggtcacagcactttctctcctgtacgtgaaccaaactggactccacttagcagaacctcagccatcttcctggagagtctattgttatcccctggggccctggtgggagcccagtataccttgacatccgagaagcagtaaggataaaacagtgtggtatagtggttaaaagaacagtctctcggctgggcgtggtggctcacacctgtaatcccaacactttgggaggctgaggtgggcggatcacctgaggtcaggagttcgagaccagcctggccaacatgcaaaactccgtctctactaaaaatacaaaaattagctgggcatggtggcgggtgcctgtaatcccagctactcggaaggctgaggcaggagaattgcttgaacccaggaggtggaggttgcagcctgggcgataaggatgaaactccgtctcaaaaaaaaaaaaaaaaaaacacaatctctcaaatcggagagatctgggtctgaggcacagcacctcaacctaataactgtgcaggctcaaaaaaaaaaatagcttactctttctgaacctcaattttcccatctgtaaaaggaaggaaaaatattacctagctcatcaggttatgggaattaaatgactttattttttcaacaatatttattgagggccttctgtgggccagatactgctctaggcactggggctgcatcagtaaacaaaacacacagaaatccttagacagcttatattctagctggggaaaccagaccacaaacaaataagtaaaatatatataaggttacttggtgacaagggctatggacaaaaagcagggaaggcgtggatagggagtgctggacttaagcatggaggtgttgcaattttgaacagggtggttagcagaggcctcactgagaaggtggcaattgagcagaggtctaaagtagatgaagagatgaaccgtgtggatgatagctgagggaagagcataccaggcagagggaacagcatattccatacctttaaggtaaggatgtgtccaagaaacagtaaggagagcaaagtgtgggggagtaggggaggctggagcatgtaaggccttgtaggcaatgggaggaacttcagattttattctcagtacagtggagaaccatcggcagggtttgagccaagggatggcatgatctgccttatgtttcaacagagtcagggtgttgagaagagactactggggagcaagagtgggaacagggaggcctatttggaggtacattgcaataatccaggtgagggattatggtggcccagactagggggctggtagcagtggagatggtgagaatatacagacagaaaaatgagatatgcacacaaagcaatgagcataatatctggcacatagtaggagctcagtaaatgttaactgtggttaaaattgttgctattataatcattggcatacagctatacctgcaggcggaggactcttgtaccgaggaaaactgcagtgagcaagctggccatgtaaactgagccattcgtggaaggtccaaaagatagacacaggcagagagaggcatgagtttccagagttcctcatgagagagagagaaatgggcagtaccattacccacagtcccacaggactgagaagcttgaccttctaggggaagagctttgagccctaaggggaaagtggagtctacttcatatccgcaagagtaatccagctgcctgcagctgatgggtagaaatggcagtctgctcagggagaagattgtcagggtggccaaggccaagtattcctgttcatgcccttgccacatctctggtatgttaggatatcggtgacaacctcttctccttgccttgccctaacatcagggagagaagcgtgttcattagaactctttgtcccaccctcagaggctgttaagagctggcaatgaaattcagacatccccttttgggcttgacaacctctttgggagaatagagcaagggagtagctgggggccttaagagcattagtggccagctttttttctctttctcttctcctttaccagcctctgtccaggttccctgggaaagagcaatttcacccaataaagttccctactacatcaagtgagtgaccatctgaatcagaagcgggtcagtcacctgcccaccccctccctctcctgcctttttgctacctgtccttgtcactctgtctgttgggattcctccatccagttcggtttttctcctactcatctcaagatctcaagattctacttgggtaaaggtgaacccttgggctttggcatcttgggtttaccctcgaaccctgcagcttcttgcatccaacctgtcacttgagtggtgtgcacatctgagtgtgggggtgggtgggtggtatagatgctggtactattgatgctattgtttgtagccaccaggctcagaccacatgctgggaccatcccaagatgacagagttataccaaaccctaggtaagaatgtgggcttcctgtatagggtgggcatatacacagctgcctttgtcctataatgtccatctacagatgaatggataaagaaaatgtggtatatccatgtaatggaatattcagcctttagaaagaaggaaatactgccatttgaaacaatgtggatgaacctggaggacattgtgctaagtgaaataataagccagaaacaaaaggcaaatactacatgatctcatgtatgtaaggaatctaaaatagacagactcatagaagcagagagtagaatggtggctgccagtggctgaggggaggggaaaatggggagatactggtcaagagtacaaagaagtttcaattatacaagatggataagtcctagagagatctacggtgcagcatattacctatagtgaacaatactggattgtatcgttaaaaatttgctaaaaaggtagatcttatgttaagtgttcttacagaaaaaaacaataaagagggtagttggaactttttggaagtgatggatgtactaatggcatagattggggtgatggattcatagatgcatacttgtctccaaactcatcaacttgtagacattgaatctgtaaagctttttatatgtcagctataactcaataaagtggttttaaaaagaatagaagagaatcgcagtcaataagcaggtgggagagggaatgagtgcctcatcgtttctccaacagcctgccttcctttatcctcgcacctttctcaactggaggctctacattcccctctggaccattttatcaccggattagtgcattattcttacagatgtgaagtctgatttgctttaaaagactgtccaggctgtgatgagcgtaactcttgtgtgccttatctttgcctactgtgagagactcatcattatgtttgttgcacattttatccatgctgatgcatgtgactacagttcattcttttttaccactatagaatgttccattgtatatagcacagtttctgctgttgacagacacgtgggtcatttcttgttttaagctaatgaggacagtgctgctgaggagtttcttatatgtgtcttccagtacatgtgtgcaaagatttctctggggcatgtttttcagtctgcaggtcataacatcatttcagtgtgttgtgacaaacatttaaaaagttgaaatagaccaggaaatattaatatgcaacagatccttagcaagagtcatagttgatattaattttgttgttttcactctatgcaatctagtaaggaattgcttcctgaaatgtttgatttagttatttttacatatatacatgtatactataaaatgaatttcatactgtaagtcttgatcaaaaagcatttgcaagtcactgctctgggatatatagctggctgggtggtgggatatgtgactgttccattttactaggtgataccaagttgttttcaaagatgattgtgtcagttcacactttcactggcagttctcattcatccccactcttgttgacacttgctattgtcagacatctattggttgccagtctggtgggtgtaaaatggtatcttgttgcggctttaacttgaatttttctgatctgagtgggtctctctccattctttgcagctgatctgaacaacattaagttctcagcttatcgcactgccatgaaactccgcagagtccagaaagccctgcgctgtacgtctcctgttgtacttccctatgacgttcaccacccctctcctgttcctcatctgtctgctgtttctcattttcctcccaccttggcaaaggttgttgattggcttggtggaaactctccaaagcctgcaatatgctagctgtcaacttctgctcttcccagttcccttccactctcgctaggccccagacgtgtttccaaattaaccccactgttatgctcctccttgacccttttcccatgctcagtatgtataatcaagcaactgctttgtgacaggaagtactgcaacccatgatttgccatcttggggttattggatgtagcagcaaaactgttgaagcaaataccagtggttagggaacagtgtggctgaggatataatatgccttctggcctttctcggagacactgttcattcagacttcctggctcaggcatgtctggctaggctgagccagtatttgggggtaattaagatgtcctcttgatgtatgtcacatttccccaaccatacctgagccttcattgctggtgtctaggttctcagaacaaaacttacagacgaacctatttgcaattgaaactcatgcaaagacagaaacttaaaatgggatttgatcccttgagagttagtataacataggagttgagtttactcatgtcccatcatctttttgaaactgatgtcaaagaacattggatataaaaacatgttgggttaatttgaggaacattttgctgccttctgcctccttggatgagggtcttagtaaaggacaagcttgtatcatatttgcaaatggttgatctggagattgagtcaaatttggtgatgctggtggctttatctccttatttaatccctggggttctacttttggctatattttttttctcttctcttctttccttaccagtggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgataggtaagggctttcagctctggaagcctccaggataaaattcaatgggatatctcaagtgggcctggtgggaaggtgttgctcccatagtagacttggacccagctcagcttggggcatggttggaacagggccctgctgggatcaactttgtgagggaaatgattgccaagatgttaaccctttacatacattcatattctcagtctcttctttttaaacctagtggtcgcagcggaaagatgcgggcattgtcttttaagactggcattgcatgcttgtgtggcacggaagtgaaggaaaaacttcagtgtgagtagaactccaaagtgtggagtggtgttgggtagagggaaaggtgttgcagggaggaggaagggtgtaagataagcagaaagtacatcttgtgactcagcagagggctacttgggctaccttatgatgcttcttggttcacactgttgcaaagaacacatgacagccaaaggacaagatgggcctaaggcctattactattcccagtgtcactccaacgggcttcattccttctgaattgatggaagtacttagtcaggatctatgttggcattttgaggtacccagggccctgatgttctagttgcattcccctgtggcctatcaggcttagccctcttccagtctgaagctcaagccatgtcactagagacttcttatatacacaggcagggcacaataatacccaatatctgggaggcggacactatgttcttctgtagtttttcacatctttggcttatagtacctttgtgttcccctctgtcctccatcttgtgttcagcattttgaacttctcagtagcagcatgattagttgttgagtcctaatatgtgactgctaaatggggtgagtgctaagttaaattagacgtggtccctgcttccaatgatttacagtccagaggaggagatggaagtacacagaaagcattttttagaaagtactgatgagaataatccaaatggccaaaaatatatcctatatcatatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccagaagttcaagtccagcctagacaatatagtgagactccatttctaattttaaaaagtaaggaaatggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcatagtagattccacagagacttagagataatttttagatgatcagatgttttgaattagcttctctttttggattatgcatgccagtgtttccttccatttgtgtggacaattgagagattactgcagtgtcagactacataaacaggagagatggtatggcagcctgactgtgactcatgttcaggtgcccctgagcccgtaccccatcatcctgcttctggaagaatctgttttcccaacagtatcatatctgtgtctggcactgctcttacacacagtgcactcgacctctctctctcttgctttcactctctctcactctttctctctctgtctccccctccccctgatattctctctttgtgttggcctgatttttctctctgaactcagagaatgctctttttagaactcggctactagaaggtcagggatagacctctatgtagtccagtttgaaaagtcattagctcagtctgtgctctttccctattttccttttctgccctttctcctcaccattctccggccattcctgtgtcggggttggccattcttgacggtggggccagcagacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttgtgagtatggaactggggagtgggggagggaagggaggttgcaggaagggtgggaagaagggaaggaggactacgagctaggcttttgatctgaagtacgcagatgcaagggagtttattgggatggaacaacagggcagagggttctctgggctctagaatcatagtcctgttagggagggtgtcagctcaactagcacagggcagaacgtgaacatctctggagaacaggccaacccagcccctgctggttctcctgcccctctgagggctgccattctagggataagacactttgggcctcagtcattcccattggtcttcttgtttccgtagagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtagggaaaacaatacctgctgggatgataataataaatatgtcatgtgacatataactcagatattaaaaaataaagtgtcacctaattattatataattacagctagtctattgtacattattatatactgttataatcctttatattgcagaatgtttaattgtttttaaatgggaagtgaggaaatattttgttttagttgtattataaagtattacagacctacaaaaatgtatagaagaacataggtgtaagagcacctatgtactaaatggtatgccagcaaatggttcacaacctactctctagaaagaaaaaaggaaagctgatctgtagcatttgctaatttctgtgatgtatatactcccactgtgaatgacatcaggctatttacaagaggtctctgagcagagtcagaaacagatcctcagttgcacaccatttatatagtatgtcaaccatgcagatacaatagatgttaagtaacctcaagaacatagagagtagcaaagtaattaggaagtaatgagttttgagtatttattacctttgtttgtaatataatttatttaattgtgagtttatataatttaataatggctagatttaacaactggcttagaaaacccctgaaattttaacagccaactgtcgtgagctggtatgagctggcatcagcacaccacagtatatacctgtgaccaacttaaggaataaaacattactgcaatacatctgaggtctccttgattatattcctctccttccccaacaaaggtaaccactatcctggattggactttcatcataaaacactcaactttttacctttgtaaaacactaacccacaactctccctgtcatcaccctgcttttcgtaagatgagcaaatgaggcacacagctagttagtggtagatctagactagatattggatcatatgactcctctaagtctaggcatttcactgtcctatgctacaaggttgggcagttcagccaggctttggaagtagatctgaagggctattctttgttctgcaataataggtatattattatgaacaacctttggaaataacttttagccaacttagccaaggctggtagaaagaactgccttcatattggaagtgtaatttctccagggtaggtggtggtccctgggagcctggacctgtttgggccatccttgtttagaaggccatttgatatgatgagatatttacccctgcttccctcctgtctcccttaaacaaaggtggtgagacaatgctatttcccacacttcatgggaatctggccttgtgatttcatagagatttatggtctctagaataaagttattcatctattgagaattcagccactgctatgtatacgaggttgggcatgttatggctccatgcctcattcatccccttctactgtgtgtgtatattttaatgttaggggaacagcggggaggtcactgtggcacgttggactctctttcctactacatctcctctcccccaaggtaccggagtctgaagcaattcaacgttgacatctgccagacctgcttcttgacaggcagggccagcaaaggcaataagctgcactaccccatcatggagtattacacaccggtatgaagcctccaggctgggtgggagggttaggcagctctcaggtactaggccttgatccactttgcccagcattggctcattgttttctgctctcccgtggggagcattctccaaggagctctggtgattcactggtttgggaaattcaggcctctctattcttccagcagagcttctccctcaccaggcctggccacagctggcccaggacactctcagccatttaaagggcactcactgttttactgcagagaaaagtctcaggaaaaacaaaacaaagcaaaacaaacaaacaaacaaactaaaacagagagagcaaggcagttccaggtgattcgccttccattgctcacttgagtttttcctggctagcttcctatattgcttctgtactgggtcactcagtctttccctgatgctttgtcattatttctaccccttctagtcagtaccaaagcttatgctcaaattaattattcatcccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttttttttttttttgagacagagtctcactcttacccaggctggagtgcaatggtgcgatcttggctcactgcaacctctgcctctgaggttcaagcgattctcctgcctcagcctcccaagtagctagtgtctcctatttttcaacctgtttccccacaatccatctgtccaagctttcatctcttcaaatcctgttgacacagaaacgtgtggcctggtgggaacagggaccatgccctttacttttcatttattatcattttaaagaaaacattagaaaagtcatacatggaaaactggctggatctggtagactgataatcctctaccacctgctcgtcctctacatccttagaattcatagaaaagctattttaaaaattaacaaacatatgctcattataaaatattggaatcatataaaagcgtttaaagtataaaaaaaaggctgggtgccatggctcacacctgtaatcccaacactttgagaggccgaggtaggaggatttcttgagcccaggagttcaagaccggccttggtaacacagtgagacccctgtctctacaaaattaattattattattattagttttgcttttagaggaactgagacaattaaatttttaagtataaaatgaaagtcctcctgtctcctcaccctggcccccacccctccagttcaacttcccagaggcaaccagtgttgagtttggcatatatcctcccagaccttcttctaggagcagggtatggtgggcatgagcaagagtggattacccagcaggctgtctgctctagcagagcagccacacctgcccagtatatctggaagccattagggtaagttcctctgccctgtctcctcctcagaccacatccagtgagaacatgagggactttgccacaaccttaaagaacaaattccgctccaagcattatttcagcaaacaccctcagcgaggttatctgcctgtgcaatcagtgctggaggctgactacagtgagacgtgagtactggtggctgagcaggggctgtgggcagcctcactgagcccgatcgtatgctgtgaaggggctgagtcccgagtgggctaggagaatgttccaaggtaaatcccactagtgatagggccgttcagcttgggcctgacctgcactctggcctgagaagtagactggaatccagtctttgtattttgttcccatcagctcttgcccatgtccataatgtagggagcaggagagggaggaggaaacaggctgcccagtctttggtcctccgagtctttgctgctttcttctaggccggcttcttccccgatgtggccacacgccgacacacactcccgaattgagcattttgccagcaggtaccaccaggtttgcgggaggtgggtaggagctgttgtaggaagtccgaggggaaaggatcttcagtcggggcaaggagaatggagtcagggccaggggatgtgcacagtggggtgtgcagcagccagcaagacccaacacttaggagtagttggggcagctctcaaagccaatgatcctgctgtgagattaaagtccttgagatggaagcaggccccacatcctgttttctctcctgcctctgctctttattcctaggcttgctgagatggaaagtcaaaattgctccttctttaatgacagcttgtccccagatgacagcatgtgagtttccacagctgcttatttgccagaaatagttctccttgagatctttgtgccactgtttgggaagggtatatcctccagggaatgggggtgtgtggtggttaggatccttagctccctaaggaaggaaggctgctttctgggcacggtgttcagtaagaaaggcagtcttccctctatcaatcaacctaggaaatgagtgatgtactagctctctgccatctttccaagtcccttcctgttgcaagatcccatccttctatacacaactttgaggaacgaagaatatgccctccctcatctgaagttgcagaaaggagccattatcttgtgctcaagatgccaaagccctatctagtgctacactaaccctgggagacatcagggacttggctgaactatagccaagggaactccctggtatgacagcccagagaaggggccttgtgtctctagggaggtccccaccctgctcagaggtcctaggagcttctggctacatggatcaatctgccctgactgggacccagatccctctagaggaagaggaaacaaaggagggtagagtaggggaacagcacagaaagggaaatgatttgctcattgtttcccggggaggggggtgggctgtaagtagaacccagatacctgcatcctgaaaacactctctcaatacccccaaccacagcctctgcctcctttgaacactttcatccctctcaagcctcagtatatgtcctttccctctcgatgtgacttagaagtgaatcctccagcatgcatttcctggggcctgagctgagagctgagttgtttctctgttcaacaactggtcacctactctgctttccccacacccatgcagagacgaggaccagtacctgctgcggcactccagccccatcacagaccgggagccagcctttggacagcaggctccatgcagtgtggccacagaaagcaaaggggagctacagaagatcctggcccacttggaagatgagaaccggtgggtgtgatgatagcagaaatctgtgtgggttcttgaggcagacagattgaatttaagtccaggcacttctacatcctagctgtctgaccttgagcaagttacttatattctgtaatcctctatttccttatctgtaaaacggggatgatgatcatcaaacctgcctcctagggtcacttgtgaagaccaaatgagatcaggcatataatgtgtttggctcagtgcctggcttatagtaagggttcaataaatgctagctattataataattatttgaaaacttttaaattttttttttttttgagacagagtctcactctgttgcccaggctggagtgcagtgtcgtgatctcggctcactgcaacctctggctcctgagttcaaacgattctcatgccttagcgtcccgagtagctgggactacaggcatgcaccaccatgcctggctaattttttttttttttggtatttttagtagagacggggtttcaccatgttggccaggctggtcttgaactcctgacctcaagtgatctgctcaccccggcttcccaaagtgctgggattacaggcatgagccactgtgcctggcctgaatccttttaatgtaacccaaatttttccaagaacacacaagatgcaagcagagagaatgcatagagaaaacaggagagggtatgacatgttcctgccctcagagacctttcaatgttggaagtggaaagaaatgtgtatcacctagtaaaagtattccagaggacaatgacactacatagagcgttggaggtctggaatagggatggtgaagaagaatacagggaagacatgactttccataaagtaaaggtggcagcaggtacctaaggagggtccaagcctcttatggggcatgaagtagaattcgtagtaccccttagagcagtgctttgcaaacagtagtgcataagatagtcacttgggaagcttggtaaaatacaaattctaagtcacaggtctgggtggggcctgagtttctgcgtttctcactagctcccagtggatgcccatactgctgttccacaggccacacttggagtagcaagtctttagaacagtgctactcagagtttggagagcagaccagggccagtttgtgaccagtttgtgaccagtccaaggcaagataaaaaaaaaaaaaaaaaaaaagagagagtaagcttttagaaacttttacagcaatttgacattgctatgatattcaagcaccaaattagtaggctcatctcgttgaatagggtagagaccagtttgagtgttgttgaacttgtgtgatgaattacgtggtgtgagctatgtactagtcatgtgcattgggaccacatactggtccacaacagagtgaaaaaaaaaaaaacctggatttttgccatgaatcatttgagaaacactgcctttgagcagcagtctgcaggccctgggaaacactgggctgagagtgactgttctgttgcaaataaagaaaaaacgaacaaagccaaaagtgatatccccaaaagtaggccacctgtttggaatttgtttttttgatgacccagcatgggtgttcaaagtgggccaaagaggaggattgtggagagaagaggcaagacaggtggtctcttgtttatgttatgttttcccttggaatctaaacatctaaaaatggagtaggtgagtcagtggccctaatgcctcctttatttgcagactgtgtttctgcctgattttaaggtcagaattaatccctaaagcagcacatcaaagccctgagacatttcttacgcaaaatgtcaactttctctgctctgaggtctcaggatggcagagtaaatgacatatgtgctggagaggaagtggatgtggccattcaagcaagagcacagctgggggtggggatgggggtgggggtgaggtagggtggaagagcacagggattgttcacacctaggcctgaggggacatctgaaacctggacagtcagagccctgttagagccataggtcttggtgtctctctccatggcaggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcaggtgaggatggagacaggaaaagagccagggtggcctctgagcccaggggaagggctggggagctgagggctgtggcaaagaagacacaagagagagctccttggcagtggctgtcaggtaacttcctgaagagaactgggcctgcggttggtgggggggcgggggaaagaagagactggtatggtcacatcttcagccaactctcttccacctaccttccatgccaccctgtgtgtcactctccagccactgtggggcctggggcagagagaagacttctgagggcttatttcttcacaacccattggaatcccatactaaaagaacaaacttcaaaaatcatctaaaacattgattttgctagtatggtatttgctagaaagaagtgggttgggacaagtttggcaagagaaagattagtgctatctaaaggtgtttcttgttactttttgcacctttcatctctgagaggcaatgtgtatgctgtggtaaagctctggagtcaggcagctctgggtttgcatgtggctctgccaattgactgtggggtgtttggacagttagttaacctctctaagccccagtttcctcatctgtacaacagagatggtaacagtaccaacttcatagaattgtggtgaacataaaaggagataatgcatttatggaatttagcatgatgccaggaatttagtacacacttcataaatgttacctattattgtcattatatgtaatggaaaataccactcttctgcctcttccccagatcctccaaggaatggcctctatggattcctggaggtttctaacatatgctatgtcatgaaccaaggatcaggtgtgaaactctacatttccagagagaattgtgttctaaatagcttaattatagctgaaatgacagcaagagacctttaggtacaatgccattctttatttaattaattaattaattaattaattttcaagacagagtttggctcttgttgcccaggctggagtgtaatggctcgatctcagctcactgcaacctccgcctcccaggttcaagcgattctcctgcctcagcctcccaagtagctgggattataggcatgggccaccatgcccggctaattttgtatttttagtggagacggggtttctccatgttggttaggctggtcttgaactcctgacctcaggtgatccgcctgcgtcagcctcccaaagtgctgggattacaggcgtgagccaccgcgcccagcctacaatgccattcttataagaactgggagcctttgacacatgttgttaaaggaagaaggtaatgggtaattcaatattctaagaagtttcctaaaagtggaagccactgttttaggtaataccaaaagcttcttaaagtctaagggtaaagggatggtatgaagtctctcaggtcccttctaagctcaggagtctgtcagagtaaggtcaggaaggcaaatccacttaagtcatgccttacctcttgctagccacccaccgaatcagatggcagtggctctgcaggctcgtccctagcttcctctccacagcagtcagaaggcagtcacccccgggagaagggacagactactccagataccgaggctgcaggtgagttcccctggcctttcccagcccctttctccatggctttgtcctgccctcgatttcctgcccaaggctttgcggggctgggactggtttctcctcttggctttgtgcttagggtcagggatgattggtttactgattgattaattcatatgcttattccacaaataaatatacattgagcacaacctatgtattaggcattgtgctgggaagatgcaaatgctgcgggcaggtctgcccttcagctggcagaattctatctgaccccttggcctcataaaggagtctctagttctcttctcaaatctctgttttttaacccagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatc

SEQ ID NO: 12019 - DNA, 52667 bp, Human
actgcagcccaaggaggggtttgcaccttactgcactggatgttatgtgtatatccctgacaattctcacaatattactctccttgcaaagccatgatgggtgtgttattaattttgcttttaattctcctgtgcttaccctgtatctgtaatctctatcaactatgccttccccatgtatctgtaggggtattttcctgcgattgagtatcagattgaagccgaatgtggaggaaaacttaaatattaaatttgaactcaattgaacatggacacaaacaatggccaccaagtcccagaacaggtggtgtgagccccttgaggaattcatcgagcgctgtttcaaataaatctctatttaaattcctatttgttagttattgaaacacaacagacaatcgcaaacacaagttgacctttttgtgttccttgagtccagtcgggaagggcccttgtgactgggtctcatgccaaacaacttgttacgataagagctagggtcccagaccatgaggaaacttcatgagaatcctctgtagtctggtgagtgtagtgtccgactctggagcccaggctgttgcttcccggtgtggtggtgaatcctccacagtctggtgagtgtacctataaatatatcttttccttctccccttcccattgcaatttgcttattatatcatttgcttattatatccgcgttgccatttaattgggataaaggttgtttacccttaaaagtatggtgtgtgtgtcttttcttctccccttgcgcctttctcgcacagaacaataggctcgtccattactttcagtcgttacatttcttggaagtttcgtaatccggtgctgattctagtgtttggatgcccatactaagtttctgcttttcaagatgtcaatttaacatctcacctcgcaatcacgttgttctaattttaacaattatttattgaacccttaagttctagacactgcagaatgctttacctaagattttccaatttcgttctcaaaacttccccgtgcgttggtcgctattaactccatttgacagatctggaaactggggcccagagaggctagtccaggccactcagctagtcactcttggagcggggcctctgatctagctagtggtgtaatagaaattgtaaatcatttcaaagaatatatatatttcccgtaacaccctagagttttctcctagcccaagaattgtcctttttgacctctggtgattgtttctccttgagccagataagctgcaaacctgttggaagcagtgaagggccatagggaagagcagcctttggggagacagccacctgaaattctgctccacaacctccgctccaggagagcgggccgaacgcaccgcggtcgcagctttcctgaggacacgggtccccatgtcactagcgacacctgcgctccgggcccaaagcacaatcacaaagtgcgggacctttgggcggtgctgggcggcctggccccgcagccactgggccggttggtcccgcaggactctgctccgtggagcttttgtccttgggccggggccctgcgacccgcgctacccaggtcgagccccgccaggaggctccctcctcccgccattctccagagagtagggggtcgggaaggagagaacggcggggcggggcctgccacccacagtccccaacccaaggacgtcacggtcccaggtgcgagtgcgagcgggcgggagtccaccccgcgcctccctcctctgctgaactccccacctctgtaaaagcggcccgggccggcccccggctccattttctcgcggcggccacacctggagccgcgcctttgggttgggctgggctgggccgcgccaaccgccacgggaagacagccctcggggcggggagggagagggtggccgggccggggggaggccggggccagggaggagccgagtgcgcgctcggggcaggcggcggcgcggagcggtgcggcggcgggaggcggaggcgagggtgcgatggcgcggagcccgggacgcgcgtacgccctgctgcttctcctggtaagtgccgcaagcgggacaggggagccaccgccggggagggcgtcggtaggcgaggtctagacctcgcgaccagacttgcccgccgcccttgtgcgcgttacctgcccggcgctccttcctgctgcccgaggggggaaaagggccgggcaggctgcggcgagatccgacctggggcttcggaaaatcctcttggctggagccaggagagtaagttgcgacctatcgaagttgtgttttccttcccgcgtcacccaggccccagcgcccttttctgtggtgtgtgggtgtagtgagccctggggcggggaacaccattgctgggggtcggaggctttgttgagagtctctgggacgagaaacgtggaggcaatagggaacaacctcgcgcttcttccacgttccttaaatttccctaggattccccagctcctctagccgccgacacaagccagtgaactggggaaaccaggaacatacttgtattcttagagtgcaaaaagttggctaaaaattttttaaaaaggtgtaatttacaaagcttaattttaagtggatcacccacatatagttttaacttaaagtttatgaagttggtgtttcaaaagttttccaatattaaagataataaacatatgtaatagtttgaagccttattcatttaaaaggttacagaaaatggaagtgtagcgccccctcccccacgccccacccctcactcccggaaacgacgttcagtccctggatttagagttcttttgctcaaattggattttaaactgttggttttctgtttgtttaaggggttgcacgtatgtatctcgcttataggggtttactaaaggggttttaataaagtgacagttatgctgcaaatataggtgtgagttcaccttccagagagttcacaaatatgtgtttacagagattagatgcaaaatcatactcagttttcttacgtaataattaaaaatgcaaatacattcactatattcaaagttctaacttccaaaacatgagcccttctatcctcgagttttggtgggatgtggaagaaaatcgtgtgtgtgtgtgtgtgtgtgtgtgtgtgtctcaaaacggaaaaaggcgtgactgaatccagtctagagatttccatgaactctcaggtggaagagcatgataattagggcgtccaggcctagcacacagttcattttcatgctctatttatccatttcattttccccgtgtccttgaggtaactttcaatgaaaattcattttgttgacaaaacttttctaagacgtgatctgggacgtcgtttttagcctctgggctggcaaaacaactaatcctgtcaccttgatgtttccttgtttaaggagaatcccaagctaatgtaacacctagcttactttgagagttacatattctttccatatatgaaaataaatgacctttaatcttcaaataatgtagcaatcaggccaatttgtacactcacagagtagcaggtaagcaaattaggcatatctttcattttagcaatttgatacttttaccttattgggcagtaataaacatctcctttagaaagcgactatagccaatggaacaggagcaaaattcttggactgttctatgtattttctataaaactttctgcagtataaatttgaatatgtttatttttgtccagagagtagtgggcaatgcagcattttacccccagtgtgtttgcagttgcagttttttggtaaaaaaaaaaaaaaaaaaaaaaatggaaagcaactcatctgacagaagtagttgccaaggaaacaggtcctttattggaaggaatataaattgtagtctgttagatcagagttcagttgcaaataacggaatttactctagctatttaaagcaagaataggtttatttcggggcactaaactgactacctaagtgtaggaaggattgagaagactgccatttgagctgtcagtaatgacttcaaagccacacagcagagccacaccgcttagggagctgctgcctctcctgtgaccaggaactgcactgccactcccacagtctgaaaaactgctgtgatcagggtgctacttttgctaccagctgcagacccatgcatgccacatctgctaggatgcataacaacatggatgcttgtaccttgcctcttggtgttcacaaatctagtagctggacactagagccataataagatgactacaaagaacccagctccatacgtccatatctgcttgccaggaggcacagagctctgtttcacttccttctttcaaatctcatgtaaatactaattgaacccaaaccccattcagaacgaagcctgcagtggagtctgtgacacatggtctttcgctttcctcagcagtgcagggagacacaccagaaggtagctgtgtcacccacatagctatcaaacatttaggccagctgtatcaaaatgggaaaaagaaataattttctgaataaaatcagagaatatttcctcttcaagggttctttgcaatccatcaactcccaaatggttcacagatagaattcaaagagttcctagagatggcaaggaattaattacatatatattttaactaacttcggactgaaatttagtatttctttaaattatgagtgtggggaagacactgcacagtagtgtgagcagtagctgtgactatcacaatagaattcataaatacctttacatcttatggtgatctcaaaataccatttattctgaacatcactaatagactttctactagatcttttacttaatatgttaataaaatacatgatactgctgcatcacaaattggtattttaaaaatgctgataactatttcaatataattgggttcattgataatcccctgtattttattttatacatttgaaatcattaatctgagaaggggttcataggcctcgccagattgccaaggagggctcgtgggtgagagatttcctgatggttgcttcaattttgggttcgactaatgaagcttgtgctttaaaatcaaactacattttaaggattcaatgatagcagatcacactgtgagcagatatatttagtagggtattagtttgctaggactgctgtaacgaagtgctaaaaactgagtggcttaaaacaacaaaaatgtatgatctcacagttccagaggctagaaatccaaaatcaagatatgggcagggccatgctccctctgaaaccagtttccctcctttcctcttccaagtgcatactggtttgttggcaatctttgtcattccttctcttgtaggtgcattcattactccaatcctccatctgcgcatggcattctctcttttgtctctttatatcatcttccctctgtgcatgtctgtgtccttgtccaaatttccccattttataagaacatcggttgtactggattatgccccaaaataatgacctcagcttggttaaatctgcagagaccctatttccaaataagctcacattctgaggtactggtggttagcacttcaatatattatcttttaggggtcataatttgatccataacaagtggattcaagtatctataaattatcaataatatcagagttatgcttagtgttctaatatacaactgaataatatatattaaagaatacattaaagtataaattagatggtgaatattgaagccataagaataatcaattatcatatccaaggattttagaaacatggatttcttactggtttttgtttctaaaagttagtaggtaatgggaaaatggcagctcttaacagaaattttctttaattataacttaaggcaagtactttacaaagagatatgagcattcattggcctacgtactctctgattattagaaatccccgataagctaaattaaagtttccaaggctaatattctgtggtgtgtgagtgtagtgagccctggggcgggctcactacaatataaatatgtatttatagaaacttcccaattgatctaattgtcagacaagtgtaagcgtgagaattactggtctatattttgcaaaaaaatctatatttatgacatagaaaaatttacatgggaaaaattacacattgaatagggataagtgtttttgaaaactgccaaattatatttaaaattagaaactttaggctgggcacagtggctcacgcctgtaatcccagcactttgggaggccaaggtgggcggatcacctgaggtcaggagtttgagaccagcctggccagcatggtgaaaccccatctcgactaaaaatacaaaaaattagctgggtgtggtggcacatgcctgtagtcccagctactcaggaggctgaggcaggagaatcgcttgaacctggaaggcggaggttgcagtgagccgagattgtgccactgcactccagcctgggtgacagagggagactctgtcaaaaaaaagaaggaaggaaggagggaagaaaggaagggagggagggaggaaggaagaaaggaaggaaggaactttaactgaaagcataaaggacttttagatctatttgagcaatttttaatcacagcttttttcccttgtctttcactctgacacagatttcaatagctttgacaacaatttataaacatatagtctacatatgatgagaaactatcttctcagttttgttttttattaagtttttgtcatatgcaaagcttggtgattagagtgaagaagctggaacaacagaattcctaccgtggtcgatagtgagatgagaaatgtccataagaaaagaaaccagacacatgacccctatttagtgaatccctgcttgatgctaggcaatgtgctaaacactggagaactataaaaaagccagacatgttctgccctcatggtgcttacagtctaatgaatggtataacaagtaaatggctaacttccaaatgggtaacgataagaagagtaataatagagaaacgtagtaccatggagcctatagaaggagcaactatctcagcactgggtatcccagctggtatctgagaataattataaattagtgagatgatatgaagagaaatagattctaggtagagagaagagcatctaaaaggcctgaaaatgatagttcatggttctgcagaggaacctaaacattcattgttgcttgaacttagaaagtgaggcagaagaatgtataggaagataggccttcaagccaacagaagcccagaaaagctacttgccaaggaagtgttttcagggaggtattcacatcactaagtaaatgaaaagatgggctttgggtgagatggtcaggaaagagtcaagaaagaagagataggatttgagtgattaagtataattgcgcccagttaaaaagagaggcaacaggcattgaggacttggtaagctgagatcaaagccaggcagaaaagcccagagaccatggggtacctgggagggagaagcagcctgactgccacagggagattggtttgggagccaaaggggtgggaaggcattttggttgtcacagtgcctgaggatgcccctggtatttagttcccaaggtccagggatgctaagactctacattctgcagaaccttcaagaattgggcacgtgtgaagaatttttctatccaaaatgcttatagcacccacattgagaaacagtgataggcaaagtaagaggttctaagtagggatttattttacttgtctggaccctctttttgaaaggcaaatatctcttgggttgattacgccttgatacattcgtccactcaacaaatattgagcacctactctgtgccaagcactgttccaggtctcacctcgaaatcacacctgactgtggattattttcatcagtcaaggagtttccatctggctgactggggaatgttttggatggagatgagaggagatgagaccgttcagatttccctcggtctaaaacacctccatcccaccactctttcaagccccctacaatgcaaacaaaaacattaaacaatgtttgatacccactgcctcaatttaatgatccagtctccttagaccccaaaagtgctaattgagaaactgggcaagggtcctagctcagtcatcatcttcttttaaaaccattaatcatatcatttcttgtttcagttatcgccttcctttgctttctcagtattctggggttcctttcacttacaggaacctgcagtgcttctcacccctttttatctggcctagcacgatgggcagacggcagagggggggacacagtacatatattactaggagacatcaagtaggggtgggagacaatggcagtggccaagagggtgctgcccttaggacagtgtgcatgtggatgttgagaatgtccccagtggccaggcaatccatgctcgtcattgagccgcactgccctgctctctgttatgtagcatctctccgccctactcagatactttccccaggacctaagcttaacatgtctacaatctgtcttctggaaattgcatctttctagccactcagactgaaaacgttggcaccctctgactccttccctattatccccacacagggcattgccaaggatttttgtccccataaagactcctacttctacctgtctatctcattgccattcccctgatactgttcctcattccatctccctgacttagtaatttaatctctgaactgtctcctgccttttatcttgcacagtactgccaaaaaatcttcagaatcactagcgacatagtctccctaatcagaagctggcaacgactctccactccttataagatcagtgaagagcctcagctcaacgctttgtccttattttctacttgccaccatcgtatagttctaggtgccaaactgcactacttctcattttttgtccaaatatctccatgttctggcacatggagtccctcatctgtgcgttttccttcctcctgtatgcacagaaacagattatcttccatttccaaggccaagcccattgctatctccttgctaaacctctcctgatttccccgcaaggaagtaatcttgccttttctgagttccccagaactatttttatagccgtcagttatacaattaaggtttcctacctcatagtagtttgatcctcctattaaactgtaagcttcttcagagcaagatctttgtatcttttatctataaactagctaaatgccttgggcacggacgtattctttaaaaatgtgagttaaagtatctttctgtgtttagaaaagctggaataatgatatggatttcatgtgtttaagagaattatttaatgcccagataggttaagtagtaatttttttttctttttttttttttttttttttttggaagaagggagtctcttttttcaccagaggcgggaagggcaggggtgcagtctcggctctcaaggcagcttccgcctcccaaggttccaacgaatcctcctgtgcctcaaccctcccgagtagctgggactacagggtgcgcgccaccaggcccatctatttgtggttttttgcttaaagacggattttccccttttttggccaaatggtccttggcctcttgaccgggccggcctcagccccccaaagtgctgggataacgggcttaagcccccgcacttggccgagtggtacatctcggttcaacttttatgcatttagcagtcacaaattgggcgtctactatatgaccaacagtcttctaaggacatgtgaactgccccctgcaatcctggagcttacagtggagaaaggagtataaggacaagaacttgacattttttgaatatccgctgtgtgccagtcactggatttaatgaaagttaataatgggtgaaactgaatcaaacccaggttcacctggcaccaaatgcctgtctgtcaacccagaggcatcatcgtgaattccccttacagcagtttgctacagtgagtcatcaataaggtccgaacttctggaactagataattaatttcactgcaaattagaatcattctagaaaggaaaaaaacaagaaatgtaaattaagatttacctcatttcagagatataatcctgcaaaactgtacatataactttctaaagcccttgattttcactcttttcaattttgctgatccacttatttgagaccaatgaaacgcctgcttcccactttagaccttggaattgcctgtcggttaatttctggtagttcctgcagtttgccttactgacaggccagtgccatctaatggtaaaaaaggacagtctgaagctcttggttttcttaaactgcccagtgaaaagaaatcattttcttcattttacttttcagttcaggaatatattgcagcaaaagagtggagacaacctataatttttgtttatcaaattttgtgaagtctgttatacagctttatttatattttgcctaattccaaaagcatttgtggccattacagaaaacacctaccaataaaagagtaaaatattttttacatgtctagtcatttaataaatgctattttgaattgaaattgtattttagttagtttgcttgtttgagcaatccaacgacttcaaggaaaagaaaaagtatcgttttgcttttttgttttttctttttttttaattatactttaagttctggggtacatgtgcagaacgtgcaggtttgttacataggtttacacatgccatggtggtttgctgcacccatcaactcgtcatctgtattaggtatttctcctagtactatccctcccctacccccacagcctcaacaggccgcagtgtgtgacgttcccctccctgtgtccatgtgttctcgttgttcaactcccacttataagtgagaacatgtggtgtttggttttctgttcttgtgttagtttgctgagaatgatggtttccagcttcatccatgtccctgcaaaggacatgagctcatccttttttatggctgcatagtattccatggtgtatatgtaccacattttctttatccagtctatcattgatgggcatttgggttggttccaagtttttgctgttgtgaatagtgcctcaataaacatatgtgtgcatgtgtctttatagtagaatgatttataatcttatgggtatatacccagtaatgggattgctgagtcaaatggtatttttggttctagatccttgatgaatcgccacactgtcttccacaatggttgaaataatttacagtcccaccaacagtgtaaaagcattcctatttctccatatcctctccagcatctgttgtttcctggctttttaatgatcgccattctaactggtgtgagatggtatctcattgtggttttgatttgcattcccctaatgaccagtgatgatgagctttttttcatgtttgttggctgcataaatgtcttcttttgagaagtgtctgttcatatccttcacccaccttttgatagggctgagtgtttttttcttgtaaatttgtttaagttccttgtagattctggatattagccctttgtcagatggatagattgcaaaaattttctcccattctgtaggttgcctgttcactctgatgatggtttcttttgctgtgcagaagctctttagtttaattagatcccatttgtcaattttggcttttgttgccattgctttaggtgttttagtcatgaagtctttgccaatgcctatatcctgaatggtattgcctaggttttcttctaggatttttatggttttaggtcttacatttaagtctttaatccatcatgagttaatttttgtataaagtgtaaggaaggggtccagtttcagttttctgcatgtggctagccagttttcccaacaccataaaatggtattttttgagtgacaaatgcttaggaccagtaaaagttaaactagaagaagaggtataaaccaggggaaaacactacctaaagtgttttcctacagttcaattgtagttgatgaatacttgtaaaatgaaaaatctttttgtgatggggagaattcacagttactgaactgcctgatttattttattttattttattttattttattttattttattttattttatttattcttgagatagagtctcattccgtcacccaggctggagtgcagtggcgccatctcggctcactgcaacctccgcctcctgggttcaagtgattcttgtgcctcagcctccctagtagctgggattacaggcatgcaccaccacacctggctaatttttgtatttttagtagagatggagtttcaccatgttggccaggttagtcttgaactcctgaccacaggtgatctgcctacctctgcctcccaaagtgctgggattacaggtgtgagcttacaggcgtgagccactgagcccggcctgaattgcctgatttagaacacatcttttcacacatctgtctgtaactaggggctcattatccagtttatgaattatccaggctctcctcttcttccctttcctatgctaccatgtgattttacacagtggtttccaaaagtgtggtcccacttttggggccaagcagcatcagcatccccaggaaacttgttagatacaaattcttggaccccatccagacctactgagtcagacactctaaggcgggactcagtaatctgtgttttatcaaggtgattctaatgccactcaagcttgaaaaccactgttaacatcccaattagaaaataaaaataactggagtagaaaagaagattaaatattaaaaagccctatgtcaagggaaaaaataggaactgtccatgaatatacaaaactttacttgaaataagaattcacagcatgaatgaacaagtcaagtgtagcaaagcattgctaaatgcatattttaaaattctatgagttaataaaaagctttcaaagaaactgtcttcctctttgtaactaacttcaatatgactcacctaaaatcatatttgttacattcagattagcccaaacatccgaagaacaggtgaaagattttggtaagtcatgtactttattactgtcagacttaaaatatttattattatctaaagttcaaattcagagttcaaaaattaaaagttcaaaatattgctcttttttttttaaattagcaattgtgaaaaatataattacatatttaaatcagctgttgagtgagactgctataggagtatataaatgtctagatcatctgtaagttggacttttaagttggaattttctaaataagttatgctggttagccgtaaaataaatgttataaaaactgtcttttcttcctcctgtccccaaaataagattaagaagagaaaagtgcagtaggtgaattccaacataaatctgacccacgtcagatttatcagagcagatcaccaaactcactggtccaccctgactgcactgggtcacttgaactcttctgaacatgtacatttctatgactgtagactacagagccttctttgtggctatggacgctactacagaccagaccaccagctctgccaatacaaatagaaaagtcaggatgtgtgaccagaggaaataaacaagtggcatccactccctttattttatctcattttatttctttcagattatttcagccaaagttgaaagctctttaagaatggattggggataaaccagggatcctctgggcagtttttgatttgaccttctatacaataaaagggagaaacaaaagaattataaaacattctgctggttggaaggttgagtaaccaaggaaagaaaataacacagatgttagatgatgggcctgaggtgggcatgaatttaaagaaccactggcaagtgccacgtcctctgtgtttgagttctaaagatagtccgttgagcacactgcttaccttctagtaatttctcgctgaatggacattagaagccattatagtgactgaaagttgaaataatgttttaaactaatttgtatttctctacatccatttttaataaggtatctcttagtctgatctattaaagtttaagggatcacctcaccataaaaccactgaacacttcaagattctctactttaaaggaaagacttctgacagagaacctgtcagccaggaggagctgtcatccagtgactcatgagtccttctggattcttgtttaaactcatcaaggtgacttcagaacagaaagtcttttctaaaagtgctgaccttgaaaacaaagagtacattgattgatggtgtttggtattccctcatgcctctgcaggaaaaaaaaaaaaatcttttgccagataccaggaagtccagtttttataagatgtgcaggatccaatggtagaaaaattttttacatgtttttcaaagcagcaaaactagttaataaaatactttttttagagtttagcaaattagaaaagcttttgcagaattttttggttcatctgaaagcactgctttggatacaggaactagcagcttacttttcctcgtcagtcttaaagtcatgttgcaggtgacatttttctgtcaccaagttcctggtgagaaaaaaagtcacagatttagtgtttggaggaaaccttattggccattttgtccagccacccctcccatgcttgaaacctcttcacagcatccccacaggaggtgactcaaacttacagagtggacaggttttttaaaaagtgccagggagtgggaatggaggactaaggcagagagtttctgcttgttccagtcatgttacttgcagtatactacccactagagatgtacagaatctccacagtcctctgcagcttgtattactgtcctgaccctggttattacagtagcttccaatcagagaaacgcagccatggtgtcttaacctcggcacttggccagttgcagccagataacacttagttgtaagggctatcatgtgcattgtaggatgtttgacagcatctctggtttctacccactagatgccactggcatttatctcccctacctcgagccccaccctggtttgacaaccagaaacgtctccagacattaccaaatatccccagtggcaggaggagcggggcagggcaaaactgcccctagtggagaacgattggtctaaattaagaatgtgttctgtgagatagaggatcttaaggaaccagatccaaattatttagaaagcagtggctgagatcttaactgctcagtcaaataaacagacagttccacaattgacaaaatgttagtgcagttcttttttctttttttgtacaatgaatgaagcaaatatttcagtccataacaccttactaaaagcatgctactgcaatacgtgctataaaaatgcagatagcagaaccctcttacctagattccaagacaaccttgactttaagatgcacatcaattcttctgatgttttagtgtaacatacatccagaaaagtgcacatatcacgagtgcactgaatcttcacaaactgaaaacaccatgtcaccagtaacgaggtgaagaaacagattgccagcatcccagaaggccccttgtgctcccttcagtccctacgatccccctgatagccgctgtcccaattcacagcagattagccttgcctgtgtcacgctggctccctagatgctcagcaatttaataccagccttttgagagaagaaaagaaacattacattaaagatgtacaaaacctctaatatgcatcccagttccttaactaaaaccgactgatgactcccaaatttttatctccgggcataacttcttttctgagctactaactcctatatccaaaaggccattcacacagaacacataaaaacggctcttacctcccatttcacccctccctcaacaccacccctgtctcctgcctcaccttcagcttaccccatccctctccccattctgtctcatctctggaaatggtgccttcactcacccaggtgttccgggtcaaaattctaagggtcatctatatttgccctcattcattccattcacaggtctctgttgcctctgccttcaaaataaacactggagatatctactttctttcatctttactgcaactcccagggtttaagctagtgttatgtattgcacgtgcttctgcaatgatgcaatgactacagtctggtctctatacatttgttcttgccactttatggcctgttctccatacagtagcaccagcgagctttttcaaacataaactggttgtatcatttccaaacataaaagcttccagtggcttcctctcacactcaggataaaacccaaagtcctctccctgactgggtactggcctatccctgtgacatcatcatcactgattcaccaccgcatggcctgggcgttccttttgcagggctctgcctgactggcttcctcataccattcacgtctctgtgcagatgcagccccttctgagagttttcccacacttccaagtcactctctactatcctgaccctgctttaattttttttattgctcttatcaaaacctggtctgtctttgtctccccagtatgtaagcatccaacagggtaagaatattgtgttacttaacatatcctacaagctcaggaaattgagggtatgaattaattcaaacttgcagaaattttaagataaggaccatgcaaaacttagaattgaggaaatgtctcataaattctgtttattgaatgccagtcactgcaatagttacatttcatatatttctttaatttgcacatcagccctgcaaaatggatgtatcctagttaggtggctttcagatgcaagtaacaaaacccaactaaaactaggttaaagaaaagaatgttgaatatcaatcgtaagaaaaagtttagagagagagttggtccaaatttgaacgattctgtaacttaaagcctttatggtttcagtttggcttctctagcatttcattagctttcccctcatggtcacagcatggctgtagctattccaaatgtcacctcctcactcaacagtctccagaggcacttaaataggaaggttatgcatgtgcttctcttctaatcagtgaggagaatcttttgtagggtctcctgatacctcattgaccaaaattctcttacacatttatgcctaaaccagccaatatcaaagtaaatgggcatacataccatgctttgtcatgccagtcattcagctccatgagctaggcagggtctacctgagagtacaaagtagagttttatgaacactgaagatgagagaaaatgccaataagctagacaattgaaaatgtctgccacagtatgtattactctcctgttacagataaggaaattcagactaaagcatcttgtctggcaggatctcctccccgcttccctctgccctgaggatgggttagacttaatgactcactcccaaagaatggaatagggactgggaaaaatagtaactttacaacggagaaactgcaatcagtaccttagccagtggtgtcatgtggctattgcacaccagctagtatggtgtgacagaaagggcacttcagctctgtgatgttctttccaaaaatgcataatactgatctaatcgtgagaaaaacaacagataaacccaaattggaggacactgtgcaggatactcagccagtattcctcaaaaccgtcaaggtcatgagaaacaaagactgggaaagtgtcaaagaccagaggatataaaggagaagtgatcaccaaatgcaatgtggaatcgtagattggatcctggaacagcaaaagaacattagtgggggaaatggtaaaatcagaataaagtatggaatttagttaacagtgcattaactaaatgcaccaatgttaatctcttaattttgacaaatgtacagcagctatttaagatgttaacatatgaggaaattggagaaaggaactgctggtactatctttgcaacatttctgtaaatctaaaactattcctaagtaaaaacatattttaaaagaaatgtgtgctaggtaattgttgaaactggatgttagctatatgggtgtgcatgttactattcactctgcttttatacatgtttgcaatttaaagtgattttaatgttaaaaatacatacattaatgaaatatattttatgagtttctgccttcgagatactagcagtcaagagtaacaaaaattcttgtgctgactactgaaacaacaatggataaggcagacttcattgactgttgtttgtacctaaacaaacaaatgatatttcatgtcacattctacaatcttgctcctcaaaatttggtctgagaacccacaacattgctatcatctgaaaccttgttagaaatgcaaagtgtaaggctgacctctagacctactgaattggaatcttccttttaacaaggtccccagtgaacaaaatacacattaaagtttaagaagcactgttggtaaccatgtgattttctgcatttctgagcaaatcacatctagaaagtaaattccaataaaaatcagtgaagatgctcatatgatgaatttacgtttgactagaggactgtaaattacttccgttttcttatatcctagtaaaacacatgacacttggtcagaataataatatttacttaaaataacatgtaaattataccctcttgctagggccggtaagattgtagggaagaataaaagtagcaaatattcagtgcagccaactacttaatatggcctgtatcaaagagaagagtctgatggttagaaggatgggcaagaaatatattaaatttttttgtttgtttgtttgagacagagtctcactctgtcgcccagactagagtgcagtggcgcgatctcggccgactgcaaactctgcctcccgggttcacgccattctcctgcctcagcctctcgagtagctgggactacaggcacccaccaccacgggcagctaatatttttttgtatttttagtagagacagggttttaccgtgttagccaggatggtctcgatcatcagacctcatgatccgcctgcctcggcctccctaagtgctgggattacaggtgtgagccactgtacccggcctaaatatactaaattttaaggctgttccctgatgatgtggacactgggacctctctgatccaggcactgatctttctcttcaaaaattcccacccaaggaacatgcagagagaagtgatctatctcagcattgctttcccttgcttttcataccatgccacctttgaaaatacataaatttggggagcaccactttggttagagacatctctggccattgctagctgggcaagttaatagtagacagaatgaagaagagatcatagatctgatcataaaatagagaattagccatgattgttcatctgccccagagaagcccacactagaagctgaacatctgctctccttgagtttctctttggaatggagagccaagaacatgaactgacaatggaaaggaaagaaagaggctgaaagattcacttgtggaatggaccctacaggaagctttcaaatgaatgcaaaggatgtgaaagagactttgaaattttagggaatgccttgtttcccatgatgtaccaactagggctttgtggatccatgtgaccatgcagatgggaaaaggcaaacaactgagaaaagctacaccaaagacagagtccagtgaattaatgcataaatggaaggtggagtagtgggagcaatacatatagacaataatttcaatttggaattataagtaagagagggatatagagcaatagattgttaacagaaacaagagagggatctggttttttttttaagataaggaaaacctaaatatatttggtttgccaatcagaaggaaataaatgtattgattagccaatggagaaggaagataaaaggttagtggaaggattaaggttcttgaagataaatgtgggagaacaaatagagttgcaaataaagcacacaaacgatggtttgccttggaaaggagtcaggacacctcttctgtggggaaagaagggaaggagaggatgactgaagatagtctcagtcaaataatacatggggtcatctcataagagtgaataggtacagaggtgtgactagagtcatctcctaaagtttggaatgcctattttagaaatgcaataagggtaaggcaatgacaaagtgacgatataatttatagtgtgagcacacttttgaggatgaaagggttgttaacagatggaatgcctcacagcaggtgtcaacctagactcttctgagcaaatgcagacatatggtcacactagaaaggaaccgccaccccatggaaagagcagctatttgagagcatgaatgtgtaagggatctattcagccactgtggcctcctctagcgatattgccagtacatggtcagaactaaagagaataataggtttctagagttgagaggaaaagtgaggcaggaatagcagtcatgaaaatgaagcctccctggtggtcactgacaacatcttcagagtggcaggcagcagtctgctagctgctccggtagaactgtgtgcagcggtggaaatgttttctgtctgccctgtccaaatgggtagcccttagcacatgtggctgtggagcaactggattattcatttcaaataattgcggttaaaatccaaatagccacaagtagctaccatattagaaagtgctggttcagattgagccaagagaagaaggaagccagcagggagattaatgaactataaggaaatcctgccatttgcagcaaaacaacatggctggaagtggaggtcattatgttaactgaataagccaggcacagaaatacaaatacaacatcttctcacttatatgtgggagctaaaagttttgatctcatgggcatcgagaatagaatgatagaatccagaaactgggaaaggtagtggggaggtgggggaagaaaagaattgattaatgggtacaaatatatggtttgatagaagaaataagaccactagttagaaataagtacactagttcgatagatcagcagggtgactatagtttacaataacctattatacatatcaaagcagctagaagagaattatttaaatgtttctagcataatgaaaagacaagtatttaaggtaattgacatcccaagtatactaattatctttacaaattatatgaatgtattaaattatcacatgtattccaaaactatgcacatctttaatgcatcaatttttaaaattattattttacagtgcaaaatattcagaaagcaagatgggagttttttgggcaaatttaagagtaagcataactgtatttagaacagtactaggtcatgatgaagtcccaagtgtgacagtgcctatgaagaaccaaagaaaagagttggtgggactgaggatgctgaggaaccgagaagtcagaacatgggctgtccgtgtgtgtgtggtgtgtgtttttttgtgtgtgtataatgcacacacatccatagggatggtgggagttagctgggtgtggggtacattacatactggtggcctcgaggaaaagtaagcaggtcctggagaacacaagataaaaaccataggatgcggagtaaaggatgagagaatgtctaagatttcacaaggcagattattttgtttgttttttaagatactgttttctggaggagtcagtatggatccaggagaatatagatttctcctcgggcacttcccattagggaaggcaatgggaaaaattagtttcctcttgacaaagaatagtagtagtggttaaactttttttatgtctataatattcaatgcagtaggttattcatgaacaatgttttcacactgaattgagcagtaaattggctaaatatcaaataattttattttacagatctgctttaacgttggaagtggacttcacttacaggtgaggaaacaaagggattatttctgccttctgactcaggagggttaattccatggcaaacaggttgactgggctttactagattgaagacacatgttgtattagacccagccattcccattcaaacaagtgcagaggagcttatccaggggtattcagtgcagcagtttttgacaatgtaaatatccaccaataggtgaatgttaaaaccatttatggtacatgaaagaatgtccatgacgaggtgctgaatgaaaatcggggcaaaataagatatatagtgtaagtccatttttatagcaaaaagacctttatgcatctgtgtatatatgtgcaactgtatagttatgaaaaatcataaaagatattaatcaagctgttaatgaatactttgtgaggtataaatgaaaaagtaatttcaattttttgtcatagaaaattttgttcaagtaaaaaaaaaaatcaatgacctagtgataaccagagtacatattttgaagtaaaatacctattacatagagcaacaaaatgagtaaaatgataaaccaaacctagtataaggattatttctgatcttaagatcccaggtcagctgtattgaaatttcccttggataaaatatatattcacctgtaaaacccaactggaaatttatagaatggttttctgcctaaggttctgaaaatgaaatgggaaatttaattctttacccaatcctgaaaacaataaattcattaactggcagtttccctggttttagtcaagtttatatcaatagattactaagatttagccttaaaaaacatttagtaatttatttttaaaccacaaaccaccacagaaaaatgaaacttcattttcagttaataagaaaaaacgtttttgacatgatctgttattttttactttgccaatttgtaaggctactaaatgattctttaaacttttcaaactctcactctgggaaatcatttcttacagttaaaaacaaaattctactgtctgggcacagtggctcacacttgtaatcccagcactttgggagactgaggcgggcggattgcttgaggcttgagtctaggagttcaaggccagcttaggcaacatggtgaaaccccatagctactaaaaatacaaaaattagccagatgtggtggtgcatgcctgtaatcccagcttcttaggaggctgaggcaggaagatggcttgatccggggaagtcaaggctacagtgagccaagatcatgccactgcactccagcctgggtgacaaagcaagaccctgtctcaaaagaaaaaataaaccagaaaaaaccctacacttttactagcttggagacaatctcttgaggccctatgcagtttgctagaatatatatattcccttttagacaatgaagcctcataggaaatacgaagcataccttaaaatttgcactatttaaaagtttattatgttataggacagcatactaatgttctatatttatgacacataataaattttggcaatattctattgttataggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaaggtacctcctaaagaggaacatgaaatacatgcatatgactaaaatgtggtgtgagaggacttttatgtctactttaagatttaaggaaaatgtatgatgtgcttacagaatttttaaatattcaagatatatctgaaaattagcagagcttactttttagcataaagtatcaactttaagattctctttcccattccggaagatgcagcatcattggcaaaaatatagataactttgagttttgatttaactaagagtaaagggatttggcactggtaacacaaaatgttcagtgctcaaaagaggatgtcataaaatgtcattttcaagatgaactggtgtctattactaggtagggggaccatcttcatctgcctgagacagtcgtggtttatgcctgctctcctggcttaataattaatatctgtgttttcactctcaaggggtccaatttttttgataaattatgtgatagtgttgctactctatatttcaaagttggcatgcacaaacataaacccttcatttttttccccccaaagcttttcttcataagttctacccattttggtaattgatgctataattctctccagtttttcaagccaaaaatgtaccacacactatcagttctattccaaaaatatattccaaatctgctgcttctcttcaactccactgccattcccctagtccaagtcatgtcatctctggcctgtattaccaaagaacttcagaaggaaattgtccataaaaatatttacctgtaaattatagagaatcacttcttaggcttttggctaagatcaaatctagtaaattacagagagttcaacctgaaacattcctgttatttttatgttagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctggtaagaagaataattttagatttattagtttgtagtttttctgtcataataagtgtcatttgttttattttttcatagtatggtaatttagttttcttagcttaaatctaatcttatttatgtcatgatttcagctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacgtaagagtctttttttttttttttaataaataaatacctaagattactttatccccactgtaaataaacactaaatttcatatcttaatgaaagttgagtattacctacagaacaaatgataagaaagcagttcagaactgctttccttataggtttaaaggactttacatgccattgcttttaccctcagaacagatagggtagattaatgtgatggataaggtctctgtagcaactactcaactctgctatctgcaggaaagcaccatagacaatatgtaaacaaatgagcctagctgtggtccaataaaacttcatttacaaaaacaggtggctggttagctttggccctacagctttggctatagtttgctgacctgtaagttgtattatttttactgtaatatttattcacaacattgttcaacacagtgctcttcatgaggacccgaatgagagatttctttttgaccatgatgtaaggaatagttacgcttctcctgatttgtttgtatcttaatagatatcaggatcatgtacctgctcatgttactttctttgtattggctactaatactattataaacaaatctgtgcccttatacagcaatttttcaggactctaccctcagccttgccttcatcttgtttttactattgttatatcccattcacgcttatgtcctcatccagttaaatgttatattgtggtcaactgtatgtgattttgataagcacctgaaatcttttttggaacaagctaaaattataaataaaataacaggtaaatatgcttaaagttgaatttcatcttagacatctttatttctaatgccagatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggtaagttaatatgttatgttgcccatctttaaactctctatcctttccagtttctcctctctttttcttttctaattttcttattttgttctgtattccttatccataggataactcttggaattactctcttttagggatgtgctgtccaatatgggccatgtgactattgagcacttaaaatgtgactggcccaaattgtaatgtgctgtatgcacgttgaatgtgtaatatatgcaccagatttgaaaaacttaatatgaaaaatgcaaaatatgaccttaatgttttttgtgatcattgcatgttaaaataatattttagatatcatagattaaataaaatatacttgtttaaaattgttatcatgtgtttctttttaaaatgtggctactagaagatttaaaattacataaaaacagcaccattctagggcctctcctatcagggttctgtttactagaggttcctaaaacatttctcagtttgcagttctctaatgaaacattaggaggctcctccacggctagtacgtaggaggcagtgaggaaagggatgaaaataggaatcctagttagagaataaaagtatctgtaaaggagagaattactctaaatcccaaattgaaggaaagtttgagtaggtttactaggaaggcatttctctcgaacatttcactttattatttctaactgaaagggaaatttttaaataaaaaggggagatagaagattttttaaatgctgtatacataaaggttttaacagcgtacaagagtaaaatgtggttgatcataaagtacactctttgtcatcagatataaatcatcatccaagtgcactacgttcagtatttcttagagaaatgattggccgggcgtggtggctcatgcctgtaatgccagcactttgggaggctgaggcgggcagatcacaaggtcaggagatcgagaccatcctggctaacacggtgaaaccccatctctactaaatatacaaaaaattagctgggtgtggtggcgggcacctgtagtcccagctactcgggaggctgaggcaggagaatggtgtgaacccaggggacagagcttgcagtgagctgagatcgcgccactgcactccagcctgggcaacagagcaagactccatatccaaaaaaaagaaaagaaacatgatttaattctgcccaaattggaaggactgtgcctaacaggcttaagggaatgtttataaaattaaagaatatgattacacctaaaattctactctataccttttcacataaaactagaatggaaaagtgttactttgcattagtagtgtgattttaaacaagctgctatttctaaaggacggaaagtttagccaataataatggctgttaacttactgggcatttaccttctgccaggtactgttctaagcctttttatggattaacctatttaatccacatagaaaccctgtgaggcagattcacttattatcctcatcttacacataaagaacccgaaggtcaaagcgaataagtgcatgtccaacacagtcagtaagtgacgatgccagaattggaacccaggcagatggctccagggtcctggtgtcctgctgtgcactgagtggttctgccctatgcaggaccccaagcactggcactacctgccctcctaaattccagccacgctgaacagaaccatagtaaggggacctcatggaagagaagaagtgacatctgagaagccgttctctaggacacatactataagaatcaaatctctggggaattctggacaaagttcacccagttttgccttcactaaccaagtttatttaggaccagcttctcctcactgagaatgaagtgcaggacagaaagaaccaattcctacagttccacctcactttcagtagagaataagctacattttcaatagtggctcctttgtgcagactatctcctgataatatcaccaatgacttattgaagaatttgactatctacaactcccgaggcttttctgttcttctgcaaaagctctgactgcaagtaaatagtatcttcacacaaataatagcagatcataaaacagatttgtaaataaaatatactgtggtacgtgataaactggactaaaaccagaaagccagatgtaagagtgactcttttcacccagctggacatttttcattgctctgcaggaacacagcagctacactttgacagtagaagcaagagatggcaatggagaagttacagacaaacctgtaaaacaagctcaagttcagattcgtattttggatgtcaatgacaatatacctgtagtagaaaataaagtggtaactattattcttctaataactgtacctatttatttatatttcagtcctaattaaaaatatatcacttatatttgtatttcattgaaataaaaatcatgtgttcatgttttgcagcttgaagggatggttgaagaaaatcaagtcaacgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggtaagtactaagtattcaaaactggcgtgggccaagttggtgctggaaaggaatctaatatattttgagccctgaacacttaaaagtgctttacatattcaattaactagcactacagttgtttgagaaaggagccatccctatttgcccaagttctgtggttaggaagtggtcacactatggttcaaattcatatcaggggactctaatcctagccagacagcatggtaccaccatcattactgcttagctcatttccaggctttcttgcagctcatacctggcgatcacattctcacatcacaatctcttgcctctactgagtatcccctcaattactacctctgattttatctacttaagagtaaagccagccccacactttgagaagccaaggcaggcagatagcttgagctcaggagttcgagaccagcctggacaacatggcaaatccccgcttctacgaaaaaaaatacaaaaattagctgggcatggcggcacatgcctgtagtcccagctactaaagaggcttaggtgagaggatagcttgaacccaagaggcggaggctgcagtgagccgtggtcacactgctgcactccagcctgggcaacagagtgagaccctgactcaaaaaaaaaaaaaccccgaaacaaaaccagtaaacccaggcctcactaataacatctaaaaataaaagctgtgataacttgatagttaagtgtgcctaagaatcacctcataaaactgcatgccaaaaatgtaggttcctggtctcatcaacaaaaagtttcattgggcaggtttcaggaacttgtctttttagcaaaaatccacttgtgattctaatattagtatgaggctcacatttggaaatacagtatactaagttcttgtgcttaattgagtcaatggagggaaaattgaactaaatagggatattaagcatttatgtcgaattacaggatgggccgggtgtggtggctcaggcctgtaatcccatcccagcactttgggaggccgaggagggcggatcacgaggtcaggagttcgagaccagcctggccaacatggtgaaaccccatctctactactaaaaatacaaaaattagccaagcgtggtggtgcatgcctgtaattccagcttctcaggaggctgaggcaggagaatcacttgaacctgggaggcggaggttgcagtgagccaagatcgtgccattgccctcaagcctgggcaatagagtgagattccgtctcaagaaatataggtaaggaataatatcagtgtattttaagtagcttatattagaattgccttaccagattttaaaataaaatgcaaagctacagttccaaaatactatttcattaaattacacataggcaaaaattgattccagaagtttcgaaattcttatgaaaacttaatatataacagactgggtaaaactctgacagtggaaagaggaataatggtgatataaatgtataacagaatagggaagaattaacttgaggtttcatgataattgagcaccacttattgacagctactatatgcatttaagctacctttttaaaagcagagtaaaattgagtagcattacctcatgtttaaagagaagaactcatgattattgaagaaatggatcatgtcattcgagacaaaatcagtttatctgcttgtgtcatcaatttttaagccatcaatttataggtatgaccacgccagatacctgagatagaaaagccaattatacacgcaaggagaaacagtcagatattgatgaatgacagaggtgctagcatagaattgtcatgtgccacatacgaacgtttcagtcagtgacagactacatatatgacgatggccccgttaaattatcatggagctgagaaatacagagtaaggatgtaaagaaaaaaaatatttttgtgtagctgcacagtgtgtttgtgtcttaagctaaggctcattacaaaagagtcaaaaagttaagaaaatatttaaaagtttatagagaagttatggtaagctaagcctaatttattattggagaaagaaagtttcatttttttttaaatttagtgtcacctaggtacagtatttacaaagtctgcagtagtgtacagtaatgtcttaggccttcatatccattcactcactcactcagagtaactttcagtcttgcaagcaccacttatggtgagtgctctatacagctgtaccatttttcaaatctttactatcatatttttactataccttttctatgtttaagcatgtttaagtacacaaatactattatattataattgcctacaatattcagtacagtaacatgctatacaggtttgtagcataggagcaataggctataccatatagtgtaggtgtatagtaggctttaccatctaggtatgtgtgagttcactctgtgatgtttgcacctcaacaaaattgcctaactgcatttctcatttctcaaatcattaagcaatgcatgactgtatttttagtgtactatgatagcacaaaaaaagggatatagttatttctatcaagagggatgtggataaaaaaacaataaaatgagtattacagtgaaagcaaccgagtgagataattacaaagtcattgtctcaattatgtaatgaattgcttccaaattataagggcagcaatcggattccatcgaaaggaatttagacaaaaaagatatacaagtagcaaatacccacgtgaaaaggtgccaacatcattactcattagggaaaatcaaattaaaactataagagataccactttaccttctagaatggcagaaatgaatatcttagtccgtttgggctgctacaacaaaatgccatcatctgggttgcttattaacaacagaaatttatttctcacagttctggaggctggaaagcccaagatcaaagcagatgcagtgtctgggcaggtcccgctttctggcttatacacagtgccttcttgttgtatcatcacatagtggaacatccaacaagctccactaggcgtcttttgaaagagcattgatcccaggatctcccaaaagccccactcttaatatcatcactttgagagtcaggatttcagcacgtgagttttaaggcgacacaaacattcagacaatagcaatcaaaaagattgacaacaccaattattggcaaaaatatagagaaactggattgctagtggaattgtaacatgatgcaggcagtttgacagtttcttttaaaagttacacaagagtagttatatgacccaatgatttgattcttaggtttccacccaagaaaaataaaaacaggtctatacaaagacatgtatgcaaatgttcatagcagcattattcatgataataaaaaaaactaatagcagtccaaatgtccatcagctggtgagtagataaacagaatgtggtgtattcatatgatggaatactaatgagcaataaaaaggaatgaagtactgatacaagctacaacacggatgaacctcaaaaacattatgctatgggctgggcgcggtggctcccgcctgtaatcccagcactttgggaggccgaggttgggggatcacctgagctcaggagtttgagaccagcctgggcaacatggtgaaaccctgtctctactaaaacaaaaaattagccaggtttggtagtgcatgcctataattccagctgcttgggaggctgaagcaggagaattgcctgaacccgggaggcagaggttgctgtgagccagcatcacgtcacttcatcccagcctaagagacagagcaagactccatctcaaaaaaaaaaaaaaaaaaatttgctgattatgccatgtataaggagccagacacaaaatagtacatattacatgattccatttacttgaaatttctagaaaaggtgaaacaatggggatagaaagcagactgggattgcttggagtggtgagtctgagtggggactgactacaaacacatgtaaaggaacttttgggggtgatggagtgttctaaaactggaccatagtgatgattgcaaatccagaactcatcatgctgtacacttaaaatgggcaaattttattgtatataagttatacctgaatgaagctgtccaaaaaggataaaggagatgaacggatatttttaaatatggaaatagagatagtaaatagtcacatgagaaaaattcacagctttgttaacaaattaacaaataaacttacaatctttaatgttattaaaaaatagcaaaaatggaaatgataaaataagtttacagagttgtaaaaaatagaggtctattccctcacacagcgctcttgatactgaaaattttccatttgctttggagcattatggctatttatgactaacactatgaaacacttatggccccaatacctagcttttatttatttatttattttttcatggtcttggcctttggatactaatgacatctggctggaagattttatttctcatccggcatatatcatgccatcaaacaagcatgtcaagtgcaagagtgacttaaataaactaacaagctttcacaaagatattacaatcacaaaggatgtattttctctagtctttttctcctgtgtccttgtctcaacatcatagtgatccatatttttaaagggtgcagaagttgtgatccatccagagcccaatagagaggaaaactgactgacttattttggtgaaaataagtagtggtagctccaaaggaaggaaattcacaatgaattctccaaaacacaagtgaaaagctttgctgtaattcatgtaaacatgcctaatatatttaattttatactgaagaaacaagcaaaaatgtttagtgcatctaaatggtcagagatactggaaataaaaagcaacaggacctaagtaaactttaggtagttcttttagtaataggatataggtcaacagaggaaaaataatgtgtataaaaatgctgagagcagtattaattacatttagaaattgtgatagcccaaatgcctaattatagaatgactgtctatatctaagtagtagaatactatggaaatgtttataaaaagaaacattgaaaagttggaacataaaatatgtatacagtaatgaactgattatttcaaatggaaattgtgctattacaaagaactatttgaagaaaggttaatcttttatggaattaacagcaaaccagatattaataggtattatgctaaaaaagaggagagtggggttctttgtttaaacagatttgaaaatctctaggtttcttctttactccaggaattcaagtattttaatatgctaatgtgtaatatatagctatattagagggacagagctcacagagctaccactacttattttcactaaaataaacccatagaacacattttaaggaatactgatttatactgaatgcccactaattttttacattagaaaaaaaatcacttcagattgttaaatatatatacacatatctatagatatgtgtgtgtgtatgttttgagacagggtctcactttattgcccaggctgaagtgcagtggcatgatcatggctcactgcagcctcaaccctctgggctcaagcaatcctcccacctcagcctcctgagtagctaggaccacaggcacgagctatcatgcacagctaatttttgtatttttttgtacagatgggaactccctatgttgcccaggctggtctcaaacttctgggctcaagtgatctacctgccttggcttcccaaagtgctgggattacaggcatgagccaccatgcctgaacaaaatatatatatatatttacagtaatttcaacatttaggaaaataaattggtaatacttcctaaacatccttaacatttatgactatccagattgacagaatttttatttgcttggtgtcagtataagagttggactattcagtgctgctatatttcctgtgcattaaattattgtatctaacattaaaaccacacatgtatatgtatatgtatacatgtcttctgttttctctttgaaaagaattccctttggttttccctttcaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaaggtaagagagagtgacacgtgtatttctttattttaaattattttcagtgcctattttcaaaaatcataatcaaatctgaacacttcattccttcaaatccagcattatagttccccaaaggtctacaagttaaattttccaaagatgtgtctataactgagagatgagggggaattttcaccagaatccaccttcttcaaccacctgtgtgtgaggaggaagttagtttactcaccactgaaacagttctggctagagatggctaaaaagcaacaaaggaaaagttcaggaaaaaacttttaaaaacctgtcttatttcctaaaagattattattggagggtgagaacgtagcagataacatccacaagatttactttatacaagttacataatgtattttaatatggggaaaccagctttacttaacgcatatatcttgggaatgaatcttcatttaaacctatttgtttcagagattaatgagcctcctacactgtttatgtttgtcttgatcatggtgacctttactcagagtacatttattgagaacctacaagatgctcactgtgttggaagaaactagtttgtgtccactctgtagtggcaccttattgtgtgatgctttcaaattttcaaagtaaatttacatcttagatctcagtgccgtgccacggaaagaccattctctacagagctgttatttatggagctctagttactgttactgcagttgaatttaaagaatccccacctgctgtcccagacacaactttagtgacttcttgctcagtgccagagctgcctggttgcttgagtgtccttatacacctgtgtccctgtcttagtccatttgagctgctgtaataaaaatacgttagaccaagtaatttataaacagcagatttgttactcacagttctgaaggctgggaagtccatcaaggcaccagccaacagatttggtatctggtgagtcttgctgtctgcttccaagatggcaccatcttgctgcatcctcacgtggccaaaggaacaagggaactcactggagtctcttttttaagagcactaattccattcatgagggtggtgccctcatgacttaatcacttaccaaaggccccacctcttaatatgatcatactgcatattagactccaacataagaatttccgagggttacaaacatgaaaatcatagcagtccctgtgtaccagtgcttcctaaaacattgtatttaagtgcatcgccaagtgtagcaagaatgaaaatgtggaagaagctcctcagcaacctttttccttttagtgaatcgccttttcatggaattccttaaataacattttttccaaagtaatgttaacaaacagcttccaccatattttctgtagtgccttggtgacattctttggcccactatggtcctcttgagttatgtggtctagttggtctagttttaattttctcagctctataacctcacaagacagtatacccaactgaatttacaaaattgagcatgaattttctatatgatcatttttcactgctgtctatggagaaacttatatgttcaaactaattatataccaataatatgtggccacttattgaagcttctgtttcccaccaaattattgacttttggctgctgttttgtttgtttgtttgtttgtttgtttgtttaggggccatgaatacatcaaaagattgtgtgttctgcctggaagaataatgaaccctgccttttttatttcttagtgttttattgtattctttagaatgcagttacagaattttagaaagaaaaggtcttaaagaccagctcaaacctattattttacagataaggaatggaggcacaaccaagttaaattattttccaaatgtttacctaactaattagtggttgttattttgaaacactgataaggggctgggtgtggtgggttcatgcctggcatctcagcactcaagaatccgaggcaggaggatcacttgaggccaggagttcaagaccaacctgggcaacacagcaagaccttgtctctacaaaaaaaaatttttttttcaattagccaggcatggtggcacatgtttgtagtccccactactggggaggcttagacagggggattgcttaagcctaggagttcaaggttccagcgagttgccatcacaccactgcattccagactgtttgtcataatttactgttttattgattattcatgtgtatcagctgtttacagatatttgatataacatgtaagcagctatgctacttgaatgatgtctagcttttacaacagagaacagaagatttcttaaatgagattaagcaaacacattgtgaaatgtaatccctatttctaagactctgcctttattatcagtatgaatgttggtaaaccatagacagcaacttatgtctaagctttaaaatttcagacatgaaattcaaaactaattgtgaaaatcaaaatgtattattatttactggtagcagtattaagaggcagaaaaatttagttcaagtgtataattggaaatagcactaaaaataaatattgctataaattagccactcattcctgtgtgcctcgaagccacttaatagaaaataaattaacaatttgattgagcaaaccaagatactcatatgtttggttggtactggtatttttatgttaaactcattggtattcattaactaattacatacatttcttttttttctttttttttttttttttgagactgagtcttgctctgtcactcaggctggagtgcagtggcacgatctcggcttactgcaacctctgcctcccgggttcaagcagttctgcttcagcctcccaaatagctggaattacaggtgcccaccaccacacccagataatttttgtatttttagtagagatggggttttaacctgttggtcaggctggtcttgaactcctgacctcaggtggtccatccaactcggcttcccgaagtgctaggattataggtgtgagccaccatgcttggccagttacatacgtttctgaaaacataatatggacatttgccttgctctcccagcattggctccttccacactaattctccttgctttgagggaagaaacccagaaacgattttatcggcattgtttccacttttaaccagttctgcctgaaagaaaattattaccccaataatcaacagtatcagaaaatttgtagatgcttccgtttaaaatgatcattgattttttttttttttttttttgagatggagttttgctctgtcacccaggctagagtgcagtggcgcgatctcggctcactgcaacctccacctcctgggttcaagcagttctcctgccacagcctcctgaggagctgggattacaggcacgtgccaccatgcccggcattttttgtgtttttagtagagacggggtttcaccatgttgaccaggctggtctcaaactcctgaccttaagtgatccacccgcctcagcctcccaatgtgctgggattacaggcgtgagccaccgcacctggcccctgcgatcattgatttttaaagttgatgtttgtaaatgttgctaacgcccccaataaacaacagaacataagactgctcttctccaccagtgcttattgtataactaagttattccccaaaagtttaacccaactttaagggacactaaatcaaatgccataggacagactgcagagcaacttaaaaacttgagttagtggttagtgggctcaagagaatcacccttaattttatgtcttgggtatgttgcaggaataagaaaggtccaatttaagtgtgacatgcagtaaagagaggggcttttaggatggttttgcaaaattaaaaacattcaaaacaaatgcctgtaataagaacatatttaaagagaagaaaagtaagcttgaaagagctgtagatgttagaggtttccaattcatgcagaattcaaaattaattttatgtttgttttatgacagatatgtaaaattagaagatagagataattggatctctgtggattctgtcacatctgaaattaaacttgcaaaacttcctgattttgaatctagatatgttcaaaatggcacatacactgtaaagattgtggccatatcagaaggtaagttattaaatagatctttttcttgattatatgtatttagatttttattttccaacatcagaaaccattgatttgattgtgtataaaaacctaatctcggccgggagcagtggctcatgcctgtaatcccagcactttgggaggccaaggcaggtggatcacgaggtcaagagatcgagaccattctggccaacatggtgaaaccccgtctctactaaaaatacaaaaattagctgggcatggtggcatgcatctgtagtcccagctactcaagagactgaggcaggagaattgcttgaacccaggaggtagaggagcggagatcgcgccagacaaagggagactccaactcaaaaaaaaaaaaacaaaaacaaaaacctaatctcaccccagcacagttgcttgtgtctgtagtcccagctactcaggcaactgagatggttggaacacttgagcccaggagtttgagaccagcctggacaaaaaagcaagacaccatcttcaaaaaaaaattgaggggtagataaaatttaaaaatagatgtctaaaaaaattttttagtaagatgaaataagcacctaatttctccagtagataaatctcacatttctacttggtaagtggattaaaagatattacttggtccaaatttgaaacatatctaggatagaaaatgtcctaagtggttagtaccttctccactccaaattggcaagggaattcaaactatgtctgttgtcagcaataggaacagaatgtacatactttttctctcttatttttaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaagcaaaatcactggactacatagaaatctaaatattaagcatgatatctaaaatatttgtaagttgtatttcttctcataaattatatttccaatatagttttttaaaggagtttatgaaatgaggtcctgaacctactgacatatagtatcttttatatgcttatggagagaagaaaaataatctaaaatgtcttgaaggtagctgggtattccctaaatagcccttgaagtagttttgtctggtaaggtgaggagtaccaagcctttgtcagcaccacaatcgtagtagtttgccttctaaaaatcttgtagtaacagtaattccatttaaaacaacatttattgagcacttgctatgtgctaggcattctgctagcccaccctatgtattaccatatttaatccttccttcaacattattccctgattaaagctgaggataccttggtttaactgggggtaagtaaagctcaaacctagaacatgatagaaacaacataacaggggagttatctgattccccccttccccatgtcagtggacatgtccatatgtccacatccaggacatctagacacatggaccatatgatgtgttgatgtgagttttcagatgtccttcagggtggttctgaatgcagaaaagtctatccagaaaactattttgttttaaacaactagggttcatttcagtaaaatttcaaagacaatagtcagttttttttttaatttacagctttattgtgttaagtctagcaaatgtttgaaatcattttaagagggtttgaataatgtttagtccaattaacaaattaaacaccatcaatatttcaaactgtatttacagatttaatatatttagtttccttatatatttcagtgatctgaattaacaaaacctcccagccaggtgcggtggctcacgcctgtaatcccagcactttgggaggccaaggcaggcggatcatgaggtcaggagatcgagaccatcctggctaacacggtgaaaccccgtctctactaaaaatacaaaaaattagccgggcgtggtggcaggcacctgtagtcccagctactcgggaggctgaggcaggagaatggcatgaacccagaaggcagagcttgcagtgagccgagattgtgccactgcactccagcctgggtgacagagcaagactctgtctcaaaaaaaaaactccctatgatccttatactctaaaattctaataaatttaacttacaaatacactgagttgtatattacagaatattatcaataacaagttgaagccgggcatggtagctcatgccttaatcctagcactttgggagggtgaggcgggtggatcacttgaggtcaggagtttgagaccagcctggccaacatggtgaaactccatctctactataaatacaaaaattagctgggcatggtggtgggcacctgtaatcccagctactcaggaggctgaggcaggtgaacctgggaggcagaggttgcagtgagccaagatggcagcacagcactccagcctgggcaacagaacgagactccatttcaaaaaataagaagaagaagaagaagtgtaagagtgctaatgttccttgatcttagaaggtgcatgctgaagaatgtcgtgctatctgtaacttaccttgaaatagttaagaaactttaaaaaaaagaaaaagtgggtatatagagggcaaagaaagcattgttgcaaaatgtaaacagttagtaagggtttgttaatattcactaaaatattctttcaacttttctgtaggtttgaattttttttccattttgaatgtatatagtgttgagaacaaaaaaagaagggactagagaaaacaagatcagcccatcattgaaaatgattaacgctgaggatgggtaccatgggggttatgctcttctctttattactatgtttgaaaaattgccttaatgaagtttttttttaaagaaatggtaaaataaaggtcattcagtagaaatgttaactcaccacttgtttgtcactgtattcccagtgtatagaacagttcctagctttcctagacccacacacattggttacagctaatcatcatgaaagtaggtgtccaggtctgaacctttgctatttaaactgcatattcagggcctatagacaaattttaatgagcacacttcaataagtgaaggaagaacaaagtacctaattggagttaaatacaatcagcaatgaaagaacatttgtggaatttaatgttgcctcatccttggtaatcgttcgtttttatttccttctgcctcccaaccttgtaggtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctatgtaagtctttaaaagccactctgttgtgcttttgggaatctgagtgcactcctggagatgtgttactatggtagtcattgatttcttcacagttattctttaaccacactagagcactttgagggtgaatagggaaacaactgatgattggcaaatcaccaaagcataatataagactcttcagaattttgttttataaatgtatatccttttctggtttcagtaacttaggaactattggcataaacttcactggtattcccattttgatgagctctgtgagggcagcatgctgtctgttctcttcactgctgtattcccagtgtgtggaacagagccttgcatgtagtaagcgctcaaaaaagatgtgttgcatgactttgggttatgggcacaaggttttttacaaacccagtttattccaatcaatcctgctttgtacattcaacttatcagagctccgcctccctgatattccccgcttgccttgtttcttcgtcagcaccaaaagtaggcagaccctctgagcacttcctgtccttcctgaccgtaagatgttctcaaccagtcctgcctgccctacccacgctccaaagacctcgggtttccttttataaaagaacaagggactgcatcctgaggtcacatgaaatatcactctacttgaccactgaatatggacagagggccgcctccaaggcagcctaggctagtgcagtgacagaggagaggtctgttagacaaggggtccccaacccccaggctacagaccagcacctgtccatggcctgttaggaaccaggccgcacagcaggaggtgagtggtggaagagtgagtgaagcttcatctgtatttacagccactccccatcactcgtgttaccacctgagctctacctcctgttagaccagtgctggcattcgattcttataggagctcaaactctatcgtgaactactcatgccaagagatccaggttgcgtgctccttatgagaatctaatgcctgatgacctgtcactgtctcccatcacccccagatgggaccatctagttgcagaaaaataagttcagggctcccactgattctacattatggtgagttgtataattatttcattatatattacaatgtaataataatagaaataaagtacacaataaatgtaatgcacttgagtcatcccaaaaccaacccccctacccctaacttccctgtggaaaaactgtcttccatgaaaccagtccctggtgtcaaaaaggttggggactgctgtattagagccattggtagatgtgcaattgaaagcacagcactcaacagtctgcagtgtacttttataccatcatctccatgctatggctacatatacagatacataacggtaaatgacttgtctcagcttaccaagtttgtaggtaggtactggagctgggactgtatcttttgctcagggattccttgcactgctttctcatctcagattccctggagcctaatgtggtacttggcacataatagacacttgatgaatgtttgttaaaattgttgaattgccactggctgatttcagtcttcttattaatcgtagtagctgtagttaatgtgctgttgactgtttgacataaaaacgaatctaggcagtagccagttcatcattggaagctgccaaatgggagtggcagatgggcatgcaggtgtgtttaattctttactacattgatcaaggggtcagccttggtctttgcttcctcctaggggtaaaataaaatctaagaagagggctctgaaattgttatatgtttcactttattatttctaattactgttttcaatagtacatatatttttgcaacagtgatttttttttaattggaccatagttttaaaaaaattaatctttaagctggttttgatgatttggatactatctgaacctagtcttggtattccactcagcagccacagacagcctctttttgatgaacaaggccttgaatctgtaagactccctcatcctgccttcgggttttggagtaattcacccaaaacaagcttggtaaggttggatcagggtgaagaaaagaaaaatagagctgtaaataagtgaagacaagtccaggaagggacatgcaaattccaaaattgtgcaatataaatttagaaatatatcaaggttaaccttatctgtgttcaattttgtgtctgtacagtggtaccacttttactgctgatgtgccattgcggaaagggcgccaaaggctttacccccatacctggcaccatagagatgctgcatccttggaataatgaaggagcaccacctgaagacaaggtcagtggatcagatgtcaatatgacttgtcttcttcttgggttttaaaggggcctagggaagtgtttcttacatgtttggttgagtgagtaaagtgatcactatggatttcactcatgtgcctttgttaagcaaagagttcaaatgacagcatattttgtgtttgttgctggggcagaattgagatagttttactctgttttgacacttcccatgttgtagagaatgtagagcaaggttcaggaagagcaagagtgtgtaggaatctaagtcttttgtcctaacattaaatgggcagttttcataaccaggaactgcttcatttccatttccctcaatacatagggtttgcagaggtaagcccacaacccccatgacacttgtaaaatgttgcaaaaccccatttcccaactacatcatagccatatccctttgtctctctgttgcaccttcaccctggacctctcaccaccatctgttatgagcaccatttctaataggataggatttagcatcaggtggcagagaactcagaataacagtggcttaatcctaaaatgggcattccaagatcaacatgatgattcatccgcagcatggtccccagttccctcttccttgtttttcttccatggttgagttccattcccacactgtcctcatgtcctagttctagctacctagctgccgtccccacattctaaccagcacatgggagaaaagtgaagaaccctctttaagcacacttcccggaacttgtgtacaccatttctgcttcattcacattgaccacagtttagtcaggtggctatacctagtggcatcagaggcttagaaatatagtctttattttgggtggccatggatccaggtcaaaacaaagttaagaattctgtaactatagaagaaggtatcaaactgtagagggaggttgaaatgccattggtcgcatagagtaaaggagctgagactgtttgggctttgttttctctttgggttctatccacctataaaacaagaagagagaagaaaggagatcttcataagacttacataagttattcaactcaaaatactttttctaactggcctcagtggaaatagcttataccttcctatgcccacttgactcagatccttctaccaaggatgaaggattccctccatcctcctgactcagttctcagctgtgtttgctctcacaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgatgtaaggatgagttttatgtattggtggtggggggtggggggaacatttgtatgtgaatgtgatattattagggtaatcattgccttggatccaaatgagactttgggttttttttttttttcttttttcagggaatacttataggcaataaggaaagagaaatgggacccacagaatcagtcggtgttagctaaattatgctgcagtaaccatgatcttagttctcacacaggcatatttctcacttacagttatgtttttgccagtcagtcagctctgctttccttcatgatgtcttcatatcaagatgcacactgagagagcagattgtacctgggaagctgccgtccttgtgacccaaagaaaagaacaaggcagaaccaggcaatggctctcaaagcctccacctttttacaccacatttcattgaccaaagcaagtcatatgaccaagacagatgtcagtgggtcggaaagttgcatccctctgcaggagcaggcttggtagggatgagctccgtaggagaggcagaggatatataacctaaaaaacacaatctattaagtccatttaaattttaccttctgtatgagagtacttggctttgctattatgagggtccaccaaaaaatgatgagaaaagttccaggaagatgatcagatgcaataaggaagctcatgctagaattgaggaattagaagcagaactgaaaataaaagtataatgtagaggtcaggcacaatggctcatgcctgtgatcccagcactctgggaggtcaaggcaggcagatcacttgagcccagaagttcaagaccagcttgggcaatatgttaaaaccctatctctccaaaaatacaaaaaattagctgggcatgctggcacacacctgtagtcccagctactcagaaggctgaggtagggggatcacttgagcctggaaagccaaggatgcagtgagctgtgatcataccactgcactccagcctgggcaacagagtgaaactctgtctaaaaaaaaaaaaaaaaaaaagtataacatagagataaagtatacttcagaacaaggaatattaccaggaataatgagggatagttcataatgaaaaatgagtcagttcatcaggaggcctgaaactcctaaatatgtcagaacctaataacagaaatttttaaaacttaaagcaaaaacaactgaaagagaaacagacaaattcataatgatagttggagagttcaacctgatctatcagtaaatgaaagaacaagtgacagaatcagtaagcatatagaaaacttagtactgtgaaccaaatggatctagttgatactgacagaacactctatgcaacagaagcagaatacacatgctttttcatatagactgtattctagaacattaaataaatgtaaataacttttaaagaactgcagtcatacaatgtactttgatgaaaaaaaaattaaaaccagagatcagtaacaaagagatatataaaatatactcaaatatttataaatacacatgactgcaaattaaattatacttcatgaaaatttgtggggtactactaaagtgatgcttgaagggaaattgtagcaaaaatggctatattagaagatggttctcaaatcagtgacctaagcttccaccctcagaagttagaagagcaaattaaacccaaaacaagcagaaataagataatgatgaattttagagcagaaatcaatgaaatatttagcaaaaagtaataagaaaaaaaattgaagccacaagcttattatttaaagaggtcaataaaattgataaacattttaccagactaattaggatattaagagattaagcacaaactatggatgttagaaataaaataaagaactttactacagatcttacagacatagtaagaataattttttaaaaagtaggactgggtggttttcttgagaacaaggccctgtgctcccatgagaatggacagagttggaatataaggcatctgaagggccctagagaggagtaaggggaggggcttccattgaggaaagcaagttacttctgtccccctcttctaaatttgcaaattattagcgtgctttcccactttctgctcctttttaacctcccatctttcataccatccttcacccaccttcaagtattagcttaacagggatgtgggtggtgtcaagcaaaaccatttcttggcctttcctgtctcactgctaagctcaattctagcgtcctgtttgttttcttttggtaagttttccctctctccactctaatcctgctccagtcattcttggttatgtatgtgtgtactaacttttgatttggaagtaatttcaaagttatcagaaaatttgcaagaataatagaaattttgaacccaataaacattttgccacatttgctatttgcttttccattttctctgtctctctctcactgacacacattcacacacattctcttacattactatagtacagttaacaaatgtagaactttaatattgacatagtccatatttcagtttagccaactatcacactatcttttacagcaattttgtttttctcaggatcctgcattccatttagttgtcctgacactttagtctcctttaatctgaaacagtcccctctgcctttctattttttccctgatattaattttttttaagaatacagtccagttgtgtcgtaggatctctctcaatttgtgtttccctgatggttccttgtaattaaattcacattactgcattttgaacaggaatatagagtcttgttttaaaatgaatttatattgctaattatttgtctgttttgtgtttgttttgttttgttttcattttagaaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgtttttgtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaccctttccccatagatttttatttctctattatattttacaag

SEQ ID NO: 12020 - DNA, 17746 bp, Human
gaagtgactgtcccaaatccaattcaagctttttatcttcttttttcaggcccttcctgtaaaacctggctgacacacaaacctagctggggtgaggctccaggtgtgatgaaagtttggagttgccccatgaatgggactgaggctgatgtgggggtgagaaggcggaaggacagagcatgtgaagggagaaaggcaggctggggcaagagagcagggtgtgactctggcgagggtgggggaaagggggtgatttgaccatgtgtcaggaagtgtttctctccaccctcccctggggagagccttgaccccaaggtggctttgttttggggaagcaggtggccaggcagctgctgagggagggcaaagtcatggcttgggcggtgaccatgcactgaggtcctaggcccgatactcatcacccaaaaggataatctaacagtggctcttagccaaataggtgacaggtgagcttctgtctgaaaccagcccaactatatcataaagcctcagatatggcctaggggaaggcaagcgatctagagaagtgagagaaaagaggcctctaaggaaatagagtggtcaagtgcttagtgattattattaacagcaacaataataatgggtcacatttattgagagcttatagtgtgcctggcactatactaactacttttatgtgttcccgcattcatttctcaaaaagctccctacaaagtagtcattattattattgttattattttttccatttgagagacgtcaaaactgaggctcagtgaaattaagtttcttgtccaaggtcacacagtaagtagcaaaggcaggattcaaactcaggtctgtagtgattccagtgcactatggaaacctaggcctaggttactggagcaagttaagagggcagggccagattgacccctgcaaaggtggggatagggagggacagtgggatagactgtgtataaatagcaggcctgtttttatccctacacacaggcagaatccggcaagtgctctatctggcacaatttcagggctctgaaagccaacccagccctgtgtcaaacaactctctccccagcacgtccctggaaactgaaatacctactgagacactcatttctttgggtcaggacagtgactccagaagacccctgcaaaagcacatgggttggaagagaaacacctagtgtctgtgaaacagcaatctaggttagccagctgggtcctatgggagggtggctcattttttatgttgaggaaaaaggtggcagtcaaaggcaaggaaaagaataaggcttgtttcacaacctgtgtctctccaatctcagaagcctgggaattacaacccatagttcaaaaatcctaatgtcccctgagggaagatgggaggaagccactccagagactaagagagtactaacttcctttgcttttgctggattgatactaagtgcctgcaacttcaactctggttatctcgggtttatgagaacggctggcattcacgtgtctaatttttaaatgatagatgaattaattattatttgatacttgccgtgttggtaggccaaaaggtgggcttctgaaacttagagggtgacagggatggagacccctggtatggggcttagatgaagcaagaggccaggcccggaacagaactcagctcagcagtcagtcacaaggctgcagagtgacaggcgtttggggaaaggtaggaaccgctctccgccacctgccggtcagtagccctacccacaatcaggccgcggctgcctcggcctggtcccaaaaattgtgaacgccgccctctcctcccgcccagtcctccgccgcgcccgcggggtcgggggctgcgctgccggcgccgcgagccgggcgagcttcccagcacgggaggagggagggggcggcgccgggcggggcggagcttccgcgcctcctggagccttattcccggccgcgagccgggcagcgctcattcggccgaaggagctacgcgggccacgctgctggctggcctgacctaggcgcgcggggtcgggcggccgcgcgggcgggctgagtgagcaagacaagacactcaagaagagcgagctgcgcctgggtcccggccaggcttgcacgcagaggcgggcggcagacggtgcccggcggaatctcctgagctccgccgcccagctctggtgccagcgcccagtggccgccgcttcgaaagtgactggtgcctcgccgcctcctctcggtgcgggaccatgaagctgctgccgtcggtggtgctgaagctctttctggctgcaggtaagagggctgccgacgcccccggagatcggggggatgggggcgttgtgctgggggcatgggggaaggtcgccgcagcgcacccggcacgggccacttggtggggcccttgcgctctggcggacgggcgtcggcatcggtgcgtgttggtcaggggtctgggcgggtgtctgatgcggcctggcctctcgcccgcagttctctcggcactggtgactggcgagagcctggagcggcttcggagagggctagctgctggaaccagcaacccggaccctcccactgtatccacggaccagctgctacccctaggaggcggccgggaccggaaagtccgtgacttgcaagaggcagatctggaccttttgagaggtgggtgtggaggccccccatccttggaccttggtgggctgttgaagaataagcagatccaagattcttgctgtttgggcaatactgtgggttgagggtattcatggagaacctcggggaaaagctgatcggcctgatgggcactgggggatcctggaatataggtcccactctctctctcttgtcattgcctcacctgctgggttgctgcccttctgggtactccggggcaaattgaatcagacgtgttgtctggggttgttacgttcttcttaggtaagctgggtgataggaacaaggaatggttgagatgctttccctagagctactatgtaaaaatgggcgccagttctaattcccatatcaaatgactattatatataaaatagaggtaacacatgcggagatgcccaggcacatctctagaaagtgtgcagtgttggcctcctccatccacctgtctccagattggggaaacagaggggaatgaggagctcttggccgccctagatgaggctgtgaatggtgagcactgagcccctagggggctgtattaaaatgctggatatctgtgaatgctaccggaaacctgcagcttactgagcaccttgcattcctgaggagactccaaatggggagggctgtgtaggatcctccaaccagcctctttggctgtggccaagtacaggtacagggcagagtccagagcctgccagctctcctgcctccaaacctgaggagattatccagagtagagcaaggactcagcactgtaccctggaatgactatatttggttggacagatgcccacctgttctagttccacctgctcctcagctgcccttctccctcattcccaggagctttccttggatactctctctactttgtataaatcaagcacatactccaaaactgagcctgggctcccatacttcatcctctcccagtggccctctggggttgcccatgacctgaacagcctggattctcctggccctctcctcctaggctgggcagggctgggctgtgactcaccccacccccaccccccacccacacggctgctcctcttacctctgcagacctgactcactgctccctgtccatggcaggagcctggctgtcaccctgcaccttctccctcccctttctgattggcttggcccccctgccttgctctccccgaagctctggtcactgggttcctctgaccacctgtatcaccttctgagctctgagggggcctgggactggatgagaggaaatgaaagactgtgggggctgctggcacctacttctcttcccttcttttggctttgctgggcaaggactatttttcaggtctggggatcctaccacctaaaataaatgactgctaccatttattaaattcctactgtgttctaggcacttgatatgttatcctggctaatgtaacacttatagcaaccttttgagatagttactttggctatccacattttactgagaacctgaggttcagaggagttaagtgactgcccacagtaaatagctgaaattggagcacaggtctatggacttcagagcccattcatgcctggatcagcatctcaggtgctctagacttgtgagagggaggagatgggagtgtgtgaggcagcttggtgtggtgaggaaggacattggagtgaagtccagagaacacagttctaatcccaatcctgcatgaccttgagtaagtcactctgcctgccatgagttttttctttttttcttttttttttttttaaacatagtctcactctgtcacccaggctggagtgcaatggcacgatctcagctcactgcaatctctgcctcccaggttcaagtgattctcctgcctcagcctcctgagtagctgcgataacaggcacacaccaccacgcccggctaatttttgtattttttgtagagatgagatttttgccatgttggcaaggctggtctcgaactcccgacctcaggtgatccacctgcctcagcctcccaaagtgttgggattacaggcgtgagccaccgtgcctggccacatggtattctttgaagtccctctagcttgagactctaagtctctagtctaacgtatcatgcttacccttctgtaagacacatggctgtagccatggatgtgggcacctttttcctgatgggggataaaagggtgggattgggctgataggcatagtccctggtcaatcccagctggatatctgggtgaggctgtttttcccccagtctctctgaagcatggaaagaaggagggagtcatcattgttccagttccttctggacagttccttactttccatttttctatcccttgtacaccctgtaccccccaatccagagagctataaacaggacattgggggttaaatatgaatgaatctttgagaaagtgggtgagctgtaaagggtatgcaagttaaatattttgcttgaagttgaaaaagcaaggccgtgaccagggctggcctgcttgctgttcctgagccaggctctgccctgggctcatagtactaaggggtgccccagaagagaccacctgaacacatggacactgttcttatattaggagccctccaaccccagaacctccaagtaccttctctagaagcaatttttgtgtgtgacactgtctttctgcaagtggttcactgagtacagcatcaggaaatgaggctgattgaaggccaaaatagaatgaagtgggtgtgggggagtaggagatgggggtgtaaggtggacagtggggtggaggtgaggttggtagaattgcccagttactcaacaaaagcattctgagaatgaggctcttacacagagactgtgaaatgccttccttgggacccaccctagcttctacttcctaccgaggttccctctttctggtggttctgcccaatcttcctgctcttccttctgcctcttaggaggcactgagctaaggggccttcccagatctctgacttcaggtggaatcaaagcatatatactcctttcaagcactatgctcttctgattttcttcccaaagagtcagactttaacagagtgcttttctcctacagtcactttatcctccaagccacaagcactggccacaccaaacaaggaggagcacgggaaaagaaagaagaaaggcaaggggctagggaagaagagggacccatgtcttcggaaatacaaggacttctgcatccatggagaatgcaaatatgtgaaggagctccgggctccctcctgcatgtaagtgccccttccccagggctgaatctcatcagcacactttgtcagccacgtggctgttcctcgttgtcactgttccttgaattcataatttcacccagtttcttctcaacctctgggcggaagttgggaggaggggaaatatatttttagtcagcggaagccccctcccccctataggatgcaatttcctgtggtatggttttgtgacgtgctttaatccttggggacatttcctgcttgcccagaaatgagcatgtggctaggacagctggcacctgaaggcaggcccttaattcttgcctgatgccctactctgggagggagaagccagtaggaaacatggcagagtgggcttccagggcagagtagagctcctgtgggaaggtaggaagtgcatttggatgcatgatgtataggtatgtgtgtatttgggtttatgtgcatgtaagtgtgcaaatgtggattgactgtgaggcatggcaggactgtacagagagggatcatcatggcggcaggttgaggcctctctttcttcttccttatcccagcaaggacgaggaggtgggagacatggagagtactggcctttggccacgttgtgagagaacaattcctttgtgcagggttcacaggaaatggaacctgacccattaggcatcagcccccggtcaggcaacatcaccccttccctgggtaggtgtgtgggtggaggggctgtgggttccttagcctctctcctaagccaaacccagcaaacggctgccttggcaacccctcagggatgacagcactgccatgctctctggcaggcataatgttgccactgtgcctgaggccaacaccctgcgtcaggctgcaaacatccattcccttccctgtggggagggaggctctgggggccttagtgggagactctggacagggccaagagactgttgtatgcacactgcctccagcctgtcaagaaggcggcgtgcctggcatcccttctactggtgattggtgcagatcccttagctttttaaagcttccttgttttgtctgatcacacacagcagagctgccctgtatttggcagttggcagacagacccatcactccccaccatgtccacagtcacttgtgcatcctttcctataacatccttgtcaggagcttggtattagagggagttgtttaagagtggcatagaaagcccccatattatccttcccaaggtcttgggacagggtgggaaatgttcatcttaaatttgtaaaatggcatcattagtacagggtgaagaaggtgactcaagtagtcaaggtggattgaggtcaggaatctgtctataccagattggtcctgggcattttggtggatggatgtggggcttgcactgtgtggttgagaggccttataaggttgccctcctggagagctggactcggatgaccacctaaacccagagaacctgatatgggtgcccaggccaccttcccagtggtccctagggatagtgataactataatgatgtcatatctcctttgtcccagagtttcagtgtttatatataatatgagttgagcccaagtatgttgagcccctatttggtggcagacactactttaggagctggagagatatagtttcctgggatttttcaaaagccctctgctgagtaggcaggacttggtacctctacttgaaaggtgatgaaactggagccagaaaataggaagtaatttgcctgaggtcaatagctaaataagtagttggaaataagacagagtctcagtacctgactcctagtccaacatgcttttcatgccctcaagctgtactgggtgttggctttcatctttctttcctgtatctgtccttatagagttggagcagcattttatagagggcagagggcagctgttgtcctagaggtctcttattcttttactagtctaacagcacagcaatctgatttgaaaactttacattaacttcttgggcagaattttctttttctttgttcttttctttctttctttctttttttttttttttttttttttgagacagagtctcactctgtctcccatgctggggtgcagtggtgtgatctcagctcactgcaacctctgcctcctgggttcaagcaattctcctgcctcagcctcctaagtggctgggactacaggcacctgccaccatgccgaattaataatttttatatttttagtagagacgtagttttgccgtgttggccaggctggtcttgaactcttgacctcaggtgatccgcctgcctcagcctcccaaagtgctgggattacaggcatgagccaccatatctagccttttttttttttgagatggaatctcgctctgtcacccaggctggagtgcagtgacacaatctcggctctctgcagcctccgcctcccagattaaagtgattttcctgcttcagcctcctgagcagctggtattacaggcacatgcccccacatctggctaatttttaaatttttgtggagatggggtttcaccatgttggccaggctggtcttgaactcctaacctcaagtaatcagcctgccttggactcccaaagtgctgggattacaggcgtgggccaccacttcctgggcagattttcagggggttgattgcatgtctggactggccccctactgcctcctgcccttgctactcagggcagaaagcagcaagaagacagaaatcctggtttgggggaatgtgacatctgtgcacgttcatctggggatctttgtggctcttgtttgactccagacccaggaaccactagccagggtgtgtccaggctgctgtggtgagcctgaggctagctggcttcctaaactagccctctgcagccaccatgaacaggaaaaccctttttgtgtcaccagccaaaagttgccctcaaagagtagtttctgctgggcacagtggctcacacctgtaatcacagcactttgggaggccgaggcacgtgggtcgcctgaggtcaggagttcgagaccagcctggccaacatagagaaacccccgtctctactaaaaatacaaaaattagctgggtgttgtggcgggcgcctgtaatctcagctactagagaggctgaggcaggagaatctctcaaacccaggaggcagaacttgcagtgagccgagatagtgccattgcactccagcctaggcaacaagagcaaaactccatctcaaaaaaataataataataaataaataaaagagtagtttcctgggattcctgactagttgcctacccagaaattggctgcagagtttcctgtggctggaggaaaactggggacacttgggctgaggaggactcagagctggaggagagacaggctagggggctctacttggcctcactgcccaggtgctaagaaggaatggtgatcccgcttctcttgtctccatctgacttgggtgccccattcctcaggccatgggcagtaacctctggagtctgattatgtaataactcacacaatgtgggacttggcctttataaagccctttcatttgtattacctcattttatcttttcacaatactctagtgaagtaggcatttcttatccctgtgttttacatgaggaaaccaatgtttagaaaggtaacgtgacttgcccaaaattacctggctagaaatagcagcagaaccagtctggaactcatgcactcagtctcctccatccagacgtgtcccctccacctcctggggtaaaggtggagaaatccagtttggaagatgtctctggaccctagagggttcttgcatctgttgtaatacaagttctgaaatgggtcacagacgtgggtgggaagaatgtgtcctagtctggtgggtggctggctctggacaagacacaaaattttgcccctaccctgggatgcttggaatgtactcatcccccctccttctctggggaagccaggagttgtctgcaaagggagggggaggtaggtaatattaggatgtttacattattatccttttgactcagggtgggggtggagggattatgtaactgaattgcgggactctgaggccaaactttatttctatcttctgagtaactacctgtggagtttgaatgatggactggaagtgaaaaacagactcaacttcagcttccctcctcccaggaaagcaaagtctctgaagtcatccagactgctgttgaatcctggctctacgactcactagctttgtaaccttgggcgaggtgtttaacaaaagctaagcctcagtccatctttaaaatggggctagtaacttctccttcacagagctggctttaaatgaaataattcttgtaaagcagttagcacaaagtacttggctcatggtaagccttcaatgattgctaattattattctttattattcaagttatgagtaataaataataataacatagtcagagagaagggtcagactgccccccaggagcctatcagatatgcttccttggagttacctgcgctatcctgcattgttcaaagtggaaggaatgatgaatttggaatctgccaagacttgttcctagtcttagccctgctgcttcctagttgtgccacttttggtgaatcacttaatttctctgacccttaatcttagcttttccatctgtaatatggggttgtacctgcctaccagaatgttaggaggctcagttgagctagtagataaggctagtggcttgtgaatggtaaactgctgtgcacaagtgattttccaggggtgcttgtgcaagtgtcctctatgtcctggcaggataggggtcgcttttaggcctacatgggctgatgggacagatacatggagaggctgggcaaggaactgtggactgtgctatacgtatagtgggcctgacctacatttatcctgctgtgaggtggtttctcgaagtacccaggaggaactagggcagggagaggctcagggcaggaaagcaagaatgcagtaccacccagcctggcccctctgccactgctggttgtggacaagtctgtctcttggagcttccctggtgctctgtccgcaggaagaagggattccttgttctgaggtaccagagaaagcacctccttcccagagaaagcacagctcagaaaagagggccaccaggttcttggtgcttccttcagcagctggtggtctaaagtcctcaggcagacagtgccactgtgccccctggctggatggtaggcagttgtcaggtgtgagtgggcagcacactgagctcagagtcagacaatctacatctacatcttcatttctgtcttactgtgtgaccttgggaaaaccactccacctttctgtaaaacagggctcctacttatatcaaaggatctctgggatgctcagataaaggaaaggatgtgaatgtgcttcttcaactgtaagcacgtctgagtctttctaagagcttcaaggaaatgctttgtgttagaaaaggcagttgccagcccggtgtggtggctcatgcctgtaatccttgcacattgggaggcagaggcgggtggatcacctgaggtcaggagttcgagaccagcctagttaacatggtgaaactccgtctcttctaaaaaattacaaaaattagctgggcgtggtggcgggcacctgtaatcccagctacttgggaggctggggcaggagaatcacttgaatccggaggtaggggttgcagtgagccaagattgcgccactgcactccagcctgggagacagagcaagactctgtctcaaaaaaaaaaaaaaaaaaagaaaaagaaaaagaaaaggcagttgccatgtgatttatttcttgagtgagaagagccaagggattgtttctgacagtcttccatgctctggcagggcagctgggcagaaagatgtttcttgatttgtttggtttgtcctgtgatgaaagaggcctggtagctcagcgtgcagaggccaaaggccagagttgagctcccaagttgggccctgcacccagggggagctggagttaaatgaaggaaacttgagaaaaacgactcctggcagaggcacagggcctattaataggctggacagcagtggagagggactggacgctggaagcacgatggggaaggctgggtttatttctgggtcagaatgttgaggggcctcactggagggagtgatacgaattccctcaatttagcctaccagctcttgtgcccaagccctcataagtggcttaaacagaacgcctgaacacacatgtcataaatcagccacacgtggaacatatctagctgaggccttcaagtcctcccttgctttttccatgcctagaacaggattctcagcccagagaaccagaggaaatggaaaaggggagggtgtcaagtgagagaggaatgctacagagctttcagaggggctttaaagagttttctactagaggagaaggatggaggatgggcagggatcgtggtcagggattgacaggctgagggtatgaggaatggggtttggcttatgcaggtgggccattgccaagagaggccaaagcactaactccatctccttcttgttctgtcttgaactagctgccacccgggttaccatggagagaggtgtcatgggctgagcctcccagtggaaaatcgcttatatacctatgaccacacaaccatcctggccgtggtggctgtggtgctgtcatctgtctgtctgctggtcatcgtggggcttctcatgtttaggtgagtgttggggtcccctgcaggctgtttctgcaaatcactccctttcttcctcctcctgggccctctccttgatggtcacatgcacttccctcaatctttccaaatcatgggctagctccggggtgtagattctccaaaaacctggtatttctggcatgacatgagtcctgtgtctagagcccagggtcaaatttgcgaggccatagcaggttctgctcctcacaggagttcttttcctgcctccatgacccagctacccactcatggagtcactttgtcacacatttctttctcctggctgttctttgatggcattagtatgtggtttggtagtcaaggtgtgggtggtgctagtggtatatccttccacttctgaggcgtctggacctcaggccctgctttctaatccaggtatgctctagcttgggagacccaccaagcactctatgcctgttttctttctttctttttttttttttttttttgagacagagtcttgctctgtcgcccaggctggagtgcagtggtgtgatctcggctcactgcaaactccgcctcctgggttcacgccattctcctgcctcagcctcctgagtagctgggactacaggcacccaccaccacacccagctaattttttctattttttagtagagacggggtttcaccatgttagccaggatggtctcgatctcctgacctcgtgatctgcccgcctcggcctcccaaagtgctgggattacaggcatgagccaccgtgcctggctctatgcctgttttcaagcagtgtaactcatctgtcatgagacctggaacaagttactgtctttctgaggattgtaaccttgtagtgattgtaatgtttgtccatctacctcataaggatgttatgaggatcacgtaaatgaggtgaaagctatttgtaaattgcatcctgctattagagacaggagttcctcggggcagttgggcctttgaccagagtttgggctgccctactgcctgggcttttccaagtagtagaggaaaccaccatggcagagttctttggaaggacctgctctggacctgcactttgtcatagcaggcagggcttattcacaaaacttatcttcctcaggtaccataggagaggaggttatgatgtggaaaatgaagagaaagtgaagttgggcatgactaattcccactgagagagacttgtgctcaaggtaacgctccatcctttgccccatgacatgattatcctttgtcccctttcctggctgtgcttcagtgggtgctgaattcttcatataggggttgggggccaggctactgtgacattaatatcccattgcagaattattttcaaaaagactcagtgcttcacttaaggtaaaagttgctagagagacacctaagagagatgcctgagaggacagcttctcccaccctcatcccctcccttcccctcccctctcctcccctgggagacagagtgaaaccctgtctcaaaaagtttaaaaataaaaaagactggaccaggaaaatcttaagacttctttagactggacctggctttacatgccttccttttgtgctttaggaatcggctggggactgctacctctgagaagacacaaggtgatttcagactgcagaggggaaagacttccatctagtcacaaagactccttcgtccccagttgccgtctaggattgggcctcccataattgctttgccaaaataccagagccttcaagtgccaaacagagtatgtccgatggtatctgggtaagaagaaagcaaaagcaagggaccttcatgcccttctgattcccctccaccaaaccccacttcccctcataagtttgtttaaacacttatcttctggattagaatgccggttaaattccatatgctccaggatctttgactgaaaaaaaaaaagaagaagaagaaggagagcaagaaggaaagatttgtgaactggaagaaagcaacaaagattgagaagccatgtactcaagtaccaccaagggatctgccattgggaccctccagtgctggatttgatgagttaactgtgaaataccacaagcctgagaactgaattttgggacttctacccagatggaaaaataacaactatttttgttgttgttgtttgtaaatgcctcttaaattatatatttattttattctatgtatgttaatttatttagtttttaacaatctaacaataatatttcaagtgcctagactgttactttggcaatttcctggccctccactcctcatccccacaatctggcttagtgccacccacctttgccacaaagctaggatggttctgtgacccatctgtagtaatttattgtctgtctacatttctgcagatcttccgtggtcagagtgccactgcgggagctctgtatggtcaggatgtaggggttaacttggtcagagccactctatgagttggacttcagtcttgcctaggcgattttgtctaccatttgtgttttgaaagcccaaggtgctgatgtcaaagtgtaacagatatcagtgtctccccgtgtcctctccctgccaagtctcagaagaggttgggcttccatgcctgtagctttcctggtccctcacccccatggccccaggcccacagcgtgggaactcactttcccttgtgtcaagacatttctctaactcctgccattcttctggtgctactccatgcaggggtcagtgcagcagaggacagtctggagaaggtattagcaaagcaaaaggctgagaaggaacagggaacattggagctgactgttcttggtaactgattacctgccaattgctaccgagaaggttggaggtggggaaggctttgtataatcccacccacctcaccaaaacgatgaaggtatgctgtcatggtcctttctggaagtttctggtgccatttctgaactgttacaacttgtatttccaaacctggttcatatttatactttgcaatccaaataaagataacccttattccatagccttttgtctgtttgttttaaccgggaactggtttaacttagttatttcctaagccctgacttggtggtaggctctataccaggcctatttatgtatactaccacaacaattctgcgatgcaggtactattactgtcccatttttccagaaggggaaactgaggctcaaagtggttgtgtaacttgcttgaggatacacagctagtaaatgacagagctgggactagtagtctggctccaattattttgtcttagtacttataccatgctatctctgagataagaaagaacagatctttcgcacagcatgtttagctggctgtaatcagggaagatatccacccattcagtcaacaggccctggactcaggatctactcctatgctgcacatatgagcaggcattgcttctggcaagaacaagatgtctttgactaccctatcttgctccacagccaatccatcagcaaatcttgtcagccctacctttagaatacatgctgtatgcaaccacttctcatcactgccactaccatcacccagtccaatttcgcatcatctcatgcctgcacttttgtgatggcctctgcctttctagttccatcttgcttccatataacatatttccagtgtaatagccagagtgatcatgtctttcagatcttgtctgctctgcaggccttccctgaccaccgtattaaacaacagcacattccttctcccatcctactcttactcttcttacattgctttttatcaccactaacatattcctatttgtttatagtccatctcctcctatgaaaatgttagctccatgagggtaggggtgtgtacattgctcctctcctagattctaagacaatgcaattgagtggtaggcactcaatatttgttacctggatgaatgaatgtaggaaatacaattcagtccaatgccagcaagtggacagacatgcaatccaatgctgccctgaaagtgtgattggattagagaggggtctctgttggggaatgtggatggtggtgacaaaatgaaagtggaatttggggcatgtcatgtgtcctggtggattggacagtccatcaagtggactggggcagtgcagtagcactggacaagtgccactgggctgccccttcctcatcctcttcccttgcagagttgtgatattctgaagtttctccaggagcccacacggagatcttgtatatacttggaacatcctttcaagactttaggcactagtaactattgaagctgaacatatgcataccccaggagtaattccactcctggggattcaagagaaatgagtgcatatgttcaccagaagatatgcacaagaggctgggcactctggctcacgcctgtaatcccagcactttaggtggccgagacaggtggatcatgaggtcaggagttcgagaccagcctggccagcatggtgagaccccgtctctattaaaaatacaaaaacttagccagtcatggtgatatgtggctgtagtcccagctactttggaggctgaggcaggagaattgcttgaacctggcaggtggaggttgcagtgagtggagatcgcgccattgcactccagcctgggcgacagagtgagactccttctcaaaaaaaaaaaaaaaaaaaagatatgcacaacattaatccaagcattatttataataactaaaaactggaaaccatccaaatacccatcagtatttgatgataaaaatgaataaattggggatatatctatacagtgaagtactaaatagcaataggaatgagttgcaaaacatattgctcagtgaaagaagccagattcacaaaaaagtatatactgcgtgattccatttacttaaaatttaaaaacaggcaaaactatggtgaaaaaaaatcaggaaaaagactcccattgtgatcagtaaagactggaagagagggacttctggtgttctgataagttgtgccatggttgggatgcgggctacacg

SEQ ID NO: 12021 - DNA, 41132 bp, Human
  misc_feature (1)...(41132): n = A,T,C or G
gtgagaaaattaatttccgttaagtcacccagtttatggtactttctcaaactaagacaccatagaagtgtaagttttaaaaatattaatacatttagtgttattaattcctgtccctgcacatataacacaatgttctgttataaagttaaaaacaaattagaatcttcctaattcagtatgttctaagaaatactacttgacaataatcaataaaataaatttgcaaaacttgtcaatgatgtgtcccatgtcaaatcaaataaagatagcctttcttggataggttgttggaaaatggttgtatcaactgaatttttcatgttttacttcagattttcaattttaagttttgtttatagatttgattaaaataaaggttattatgaataggttattaataaaggttataaagttctgtgcctatgatgtgttataaatggtgtgttcagctttactagttaatgctgttgtatttgatgtcgcttcagtgaccttttttgttagtttattgttacttaaaattaagcaaaatctttcttgcatgaaatcttcttgattaattattgccatatagaattttcattcacctaatcttttttttttttatttgagacagagtcttgctttgttgcccaggctgaagtgcagtggtggcatctcggctcactgcaacactgcaacgtctgcctcctgggtttaagagattctcctgcctcaggctctggagtagctgggactataggcgggcaccaccaccccccgctaatttttgtatttttagtagagacggggttttaccatgttggccaggttggtctcgaactcctgatctcaaatgatctgcctgcctcggcctcccaaagtgctgggattacaggcgtaagccaccgcgcctggtctcattcgcctaatctttattgtctactatattcaaagtgttgagtgtgacaacaagtcatttaaaatttagtctggattctcaagagtttgtaatataatgaggaaaaaatcccaacgactttcttttactcagatctccataatgtcatttgccatcaatagtttggaatatcactgaagtccaagggcctgtggctacccaatattccaaatacaatataatttggttcaaataagatattaagaactttggtcaagaactttggtcaaacacaggagatctggaatctaacggcatgtctttggcaattcacaacctctccctctacacgtttctccatgtagaaagtaaaggccttggaaaggattgatgaaaaccaaccctaaaactccacgatgcctttttctgtactccgaatctaaaagggtgagctatgaagtaaaactctgcacttggtccaagtcattgaaatatttgcaaacgatgctagagctcgaaaagagcaaagatagcagaaaccgtccagagaaagtaacctactgctgaagctctgcaaacttgagcagtcaaccaacttcaccgctcacaaacgtttggccgctaggcattgtgactttctgcccagataaaagtctttttttcttttgtctcctttttttcttcctccctgctttgccgcgtgagattaccactcctcgggtcagctcgcgaacgccagggaggcgagtgtgaaacacacgcgccaacacccctcctcctcctcgtgcgctcctccttcctacagaaaaatgtgtttctaggcaacggcgggcggcggcgtcacttcctgccatttaaactcaggtccccacccctcgcagccccttctcctcgtttccacccctcccccctcggtcgtgggcctcattcacgcttccccgggcttggggagggggcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggtgagctccggaggcggggacgggggcggacttcggaacccgtggcccccggggaagcccagcccctcgccgcgtgggtctagcggcgtggtgtagacgcgccttgcggggacccgggaccgggcaatccgaggaccatgtggcctgcgcccgggtcgtggacgccgggatgggggagggacgagggaccaggatggcaccgagcggacgcgtaaccaatggggcccggcgccacgctgggctctcgacaaagagcccaggacctcgagcgcgcccgcgtggcttctgtctccgggcgcagggacctgagggtaaccgagtgtctgttgctctgcgtccacctgtggcagaggctcacggggtaacgggcgctttgcccggagacaccgtggatatcgattttgctgttaagaatggatggttttaataggcgattccagttggaaccatgttcctgtagtttaaataaaaaggaggaaaaacaaaacccagtctgccatctctaccagatgaaagaaaaaaaaaaaagagtacttctttccacgcccctccccgataaaatagtattaaatcttccttgtgcacttctttcatcaccctgatagttaggaggggtatttgatttgtgacttcatttggcatgtgtcatgggtttccaaaagtgagatctgctgtcacacgaaaaggggatattttacaactttcacccaaagaggtggaagtgctcagtaaactctctccctgcgtcgtcctttacagcgttcagatttttcaaacaggagcaggcatcaaaagctgttctgtcatacagaatgacttaaccgatctaggaaggatttggaagaattcaacagcgctcaggataatgagaatgtggtcactccgcgcgaagtttaagaactaaagttttagaaacaaacaaacaaaaaacactaactgcccaataatcactgcaaatcccctttgactccctaaatgtggccttacttggaggattggccccagctcccaggggagtgcctggaccaccttacctggcttgagagtgtcactgcatcctcaaggctctgcataaagcagtggcagctccctgaatgtaaggaccaagacttgcaggggccaactcttctgctagaggccctcctccagtgtagcccaaggggaagtagatcttttcagtgccctctcctttccctggatgtagttggtgttcaatcagtgattgttgaactgaattacctaaattgttcaacttcatacaactgaggcatgctgcacatattttgcattttggtaagtaatttctactattttctttttgatatgttattcctggaatttttttcccacctctggaaattccttgttctcttttttccaccacagccccttcttcctttctctccctgaaagtgatttatggcatgtgtagtatttaaattgtagtgaattaaaatggattctgtttaaagaatttcacaggaagtcatgaagttatcagagaaagccaggaatgttacaaagcacaggtggcaaactgctgttcaaaatctagaaattcagctgtagcctgtgactttggtgtaagaaaatcagggaagtttggggttttccaggtaaaactgaactctgacggctggactttgagggcttctccctcagcttgcctcaggatatggtggaactttgccctttcttgacttgaaattctttagcttcctcctgtttcatctgtggctatataattgccctacagaagtcacagaggcagtgagtaggatgtaaagtttggtatttcatgacaataattgctttattcattctggaactctcctaaaaattcaaaggtttctacaataacactgtctcattatattaatgacttcatactcctagaaaagagtttgaatgtctttagttttcatatatatgtatgaaaaacatatgttttatgtattttacgtatatttttcatttatttatatatacttatatatgtaaaaatcttttttttttcttttttgagacggagtcttgctctgtcgcccaggctggagtgcagtggcgcgatctgggctcactgcaagctccgcctcccgggttcacgccattctcctgtgtcagcctcccgagtagctcggactacaggcgcccgccagcgcacccagctaatttttttgtaattttagtagagacagggtttcactgtgttagctaggatggtctcgatctcctgaccttgtgatccacgcgcctcggcctcccaaagtgctgggattacaggcgtgagccaccgcgcccggccaaaaatcttacattgaaatctttccaatgatatttcttattatacaccatagtaaaagatcgttaaagccttttttttttgagactgagtcttgctctgtcacccaggctggagtgcagtggcagatctctgctcactgcaacctccacctcccgggttcaagcgattctcctgcctcagcctcccaagtagctgggattacaggtgcccgccaccatgcccgactcatttttgtatgtttagtagagaaggggtttcaccatgttggccaggctggtctcgaactcccaacctcaaatgatctgcttgcctcagcctcccagagtgctgggattacaggagtgagccaccatacccagcccattaagacatgtttgataatacatattaaagatggactcacactgacaattataaatttcctctaatttgaaattataaagacacattttctcttgtattcttactttggtgggggcatatttcagcataatttttttgaaacttttaagttatacacttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacaaaaaaattagccaggcgtcgtggaggcgcctgtaatcccagctacttggcaggctgaagcaggagaatcgcttgaactcaagaggcggaggttgcagtgagccgagatcgcaccactgcactccatcctgggcgacaagagcgaaactgtgtctcaaaaaaaaaaaacatggctcaacatagaaaatcaattttaataaagctgttgtagtataacttaacaattaggaagcaatagaaagacattgaaagtgatgtgaggaaagtttattcattatctctgcagcttcacctacaccatatagtctcatttacaatagtggaggtgggatagttattatttctttattccagtgagataagaaattatatcatggttatttcaagctacgtggtttgccagtttatgctgttaatagctaatatacatcaagagcttaccatatgcaaaacattttacatgtttttagctaatgttatcctcttaacaacagtgaacatttcggcagaacagccccatttcacagcgtaagaaactgctagttaagtaggccaagataggttagataacttgcctggtgttgtacagtagaaagtgagagctaagatttgaaattagaccatttattgttattctctatgttataccatctttcagtagtcttcaaaaataaatgtatgtaggtaggtttccatttgcataagggcatggaaaaatgcatgattattcttactcctctgcccaaggtggaaaagaaggaggtactgtgctcctgaaaatgaagctattggtgacatattctgtattattgcataaattaaactaggatttcacttgttcacagttaagaatttgaacaactgttaagatagtcatgactatgtatctgtatgttgttttgaaaattcctattaaatgtaagttataactaaagttctacattttatttgccattttggtgtcagtatgagcttttttaagcatgatgaagattgcttatctcttttattataattctttaacttaataaattacctgaattatacctgaattaatgtgataaagtatggtgcgtcttatctgacaggtccctgatgcatacccgtttatgagcctgatttagatacatcctgggataaataaataattgaagacactagtttggccgggcccggtggttcacgcctgtaatcccagcactttgggaggccgaggcgggcagatcacgaggtcgggagattgagaccatcctggctaacacggtgaaaccccgtttctactaaaaatacaaaaaaattagccgggtgtgatgactggtgcctgtagtcctagctactcaggaggctgaggcaggagaatggtgtgaacccgggaggcggagcttgcagtgagccacgatcacgccactgcactccagcctgggtgacagagcaagactccgtctcgaaaaacagcaacaacgacaacaaaagaccctagtttgtaataccaggcaaacattttaaggtagaattagcctaaggagagatatgtgggtaggacagcgagaactttagtgcatgcttacaaattctcaggacccttccactcctgggtgtatacccaaagaattgaaagcagggcctcaagaaggtatgtatacccctgtgttcataacagtggcattcataatagccaaaatgtggatgcaatcctaatgtccgtcaatagatgagtagcttaacaaaatgtggtatatatacaatggaatattcttcaggcttagaaagaagaaaatgctgacatatgctgcaacatgataaactttgaggacataatgctaggtgaaataagccagtcacaaaaagataaatactgtatgattccacttacgtgaggtacctggagtagtcaaattcacaggggcagaaagtagaagggtggttaccaggggttgagggaaaacagaatggaatttgttgcttaatggatgttataggctgaaatgtgtcccccaaaattcatatgttgaaggccttacctccatacatcagaatgtgattgtatttggggatagggcctttgaaagataattaagctaaaattaagctgtgacctgatctaatctgactggggtccttatgagaaaggggaaatttggatatacaaagagatgcctcagatgctgccacccagaggaaagaccatgtgaggacacagcaggaaggtgatcatctgtaagccaaggagcgaggcctctgaagaaaccaaatgggccaatgaaaaaaaagaaaatgtcaggcccatataactgatgaacgtcgatgcaaaaatcctcaataaaatactgcagaccaaatccagcagcacatcaaaaagcttatccaccatgatcaagttggcttcatgcctgggatgcaaggctggttcaacatacgcaaatcaataaatccatcacataaacagaatcaatgacaaaaacccatgattatctcaatagatgcaaaaaggccttcaacaaaattcaacagcccttcgtgctaaaaactctcaataaactaggtatcagtggaacatatctcaaaataataaggctatttatgacaaatccacagccagtatcatactgaatgggcaaaaactggaagcattcccttcgaaaaccagtataagacaagaatgccctctctcaccactcctattcagcacagagttggaagttctggccagggcagtcaggcaagagaaataaataaagggcattcaaacaggaaaagaggaagtcaaatggcctctgtttgcagatgacatgattgtatatttagaaaaccccatcgtcttagccccaaatctccttaagctgataagcaacttcagcaaagtctcaagatacaaaatcaatgtgcaaaaatcacaagcattcctatacaccagtaacagacaaagagccaaatcatgagtggactcccattcacaattgctactaagagaataaaatacctaggaatccaacttacaagggatgtgaaggacctcttcaaggagaactataaaccactgctcaaggaaataagagaggacacaaacaaatggaaaaacattctatgctcatggataggaagaatcaatatcatgaacatggccatactgcccaaagtaatttatagattcaatgctatccctatcaagctaccaatgactttcttcacagaattggaaaaaactacttcaaacttcatagggaaccaaaaaagagcctgcatagccaagacaatcttaagcaaaaataacaaagctggaggcatcatgctacctgacttcaaactaaactacaaggctacagtaaccaaaacagcatggtattggtaccaaaacagatatatagaccaatggaacagaacagaggcctcggaaataaacaccacacatctacaaccatctgatctttgacaaacctgacaccaagaagaaatggggaaaagattctctatttaataaatgatgttggaaaactggctagccatatgcagaaaactgaaactggagcccttccttacaccttatacaaaaatcaactcaagatggatgaaagacttaaacgtaagacctgaaaccataaaaatcctagaaaagaacctgggcaataccattcaggacaaaagcatgggcaaagacttcttgtctaaaacacgaaaagcaatggcaacaaaagtcaaaattgaccaatagaatctaattaaactaaagagcttctgcacagcaaaagaaactatcatcagaatgaacagccagcctatagaatgggagaagatctttgcaatctacccatctgacaaagagttcatatccaggatctgcaaagaacttagacgaatttacaataaaaaacaaccccatcaaaaagtgggcaaaggatatgaacagacacttctcaaaagaagacttttatgcagccaacaaacatatgaaaaaatgctcatcgtcactggtcattggaaaaatgcgaatcaaaaccacaatgagataccatctcacaccagttacaatggcgatcattaaaaagtcaggaaacaacagatgttggagaggatgtggagaattaggaatgcttttatactgttggtgggagtttaaattagttcaaccattgtggaagacagtgtggtgattcctcaaggatctagaactagaaataccatctgacccagcaatcctattactggctatatacccaaaggagtataaatcattctatgataaagacacatgcacacgtatgtttattgtggcactattcacaatagcaaagacttggaaccaacccaaatatccatcaatggtagactggataaagaaaatctggcacatatacaccatggaatactatgcagccgtaagaaaggatgagttcatgtcctttgcagggacatggatgaagctggaaaccatcattctcagcaaactatcacaataacagaaaaccaaacaccacatgttctcactcgtaagtgggagttgaacaagaacacatggacacagggaggggaacatcacacagtggggcctgttcagggttggggggctaggggagggatagcattaacagaaatacctaatgtgggtgacgagttgatggttgcagcaaaccaccatggcacatgtatacctatgtaacaaaactgcacgttctgcacatgtaccccagaacttaaggtgtgtgtatgtgtgtgtgtatatatatgtacggtatatatatatatggtatatatataaggtatatatatggtgtgtgtgtatatatatgatatatataaagtatatatggtatatataaggtatatatatggtatatatgtaaggtatatatggtgtatatatggtatatatgtaaggtatatatggtatatatatggtatatatggtatatataaggtgtatatatgatatatataaggtatatatatggtgtatataaggtgtatatatacggtatatataaggtgtatatatatgatatgtatatataaggtgtatatatatggtatatatatgtaaggtgtatatatatggtgtgtatatataaggtgtatatatatggtatatatatatgtaaggtatatatatggtgtgtatatatataaattcctccttagttttctctaacaatccaagcataaaaaaaaaatccctgttagaactgcttttgctgtattccatagattttgttatattgtttccattttcatttgttaagatatttttcagtttccctttgtattttttcattgactcattagatgtttaagagcatgttttttgtttttaaatttccatgtatttgtgaatattctgtagtttctcttgttaatgattttgtcagaaaagatacttgtaattatctcagtcttctagaatttgttatgatttgttttttggcctcatatataatctaacctggagaatgttctgtgtgcagttgagaagcgtgtgtattcttctactgttggatggatgttaggttcatttgatctagagtatagtttaaatttgatattttcttatttactgtctctacgttctgtccattactgaaagtgggctgttgaaatcccctactattgttgtattactgtttatctctcccttcagatttattaatgttttctttatatatttaggtgctgctatattgggttcacacatatttacaactgttatatctcatgttgctgaattgacccttttattattatatagtgacctttgtatctttttatagtttttgacttaaaatctatttaatctgatatatgtatagccacttctgctttcttttggtttctatttgcatggagtatcattttctgttctttcattttcagtctacgtccttacaggtgaagcaagcctcttataggcagcataagttgagtgtttttaaaaatccatttaactactttgcctttttattggagaacttaatccacttacgttcagggttatcattcataggtaagtagttaatactgtcattttgttgttttctagttgttttgtagatattttcttcctttctttctatcttcttttgtggctaaattatgttgttgtctagtggtatgttttgattccttgcctttttatgtatctgctataggtttttgctttgttgttaccatgaggcttacaaaaaaatatcttacaatgcggtattttaagctgataacaagtttgatcgcaaaaacaaacaaacaaaaagaaacctaacaagcctctatgcttttattccagtcccctcctcacattttgaatatttgatgtcacaagttttatctttttatatcgtctattgcttaaaaattattgcagctactatgatttttaatagttttgtcttttaacttttacacaaaatccagaatactttaattctgtgatgatgctgcataaattgcttatatctttagtcagtgtacttacttttaagtgagttttagactttcagattgttttgtgttactccttagcatcctttttttttttttttttggagattgaagacttccctttaccattttttgtaaaacacttctggtagtcatgaactcccttatcttctgtttttctggaacaggctttatctcttcttcatttctgaaggacagctttgtggggtttggtattcttggctggcagggtttctttcagcactttgagcactgaggcaggccagaagcttttggcagatgtggccagcacaggagtggtgcaatctgaagccaaagttcactgagatatccctggtattgtgagctgtccagagccctggactgctgacatcagcctggcattggtgcagcccagagattgagtttgccttgaaagcctgaagcctcgggttatgtgatcctgcttggcaccaggctggatctagagcttcagtctatgcgcactagcctggaacatggggttgtggtggtctcaccagtgttaggttttactttggcaatcctagcattggagctaaaggtatggtgtctctctccttgctgtgcttcctagggttgagggaaggatgacggggtaatataaaactgcccttcttaccctcttcaatgtgacttttcttattattgtgctgcaaccagatagtgtaatctcttatatggcttatttagctcttgtgaaggtatgttatagtatggatgcttgttcaaattggtgtttctgctggggaaaattgctgaagcgtcctactctgccatcttgctccatcccttcctaaataaatcattgttttaatttcaccagtaaagactgactgtcctcaattatgagtaagtttcctcttacatcttaatatttttgtgaaagtgaggatatactttctgatgttccttttccaacctaaaatacaattactgaagtatcagtagaaagcttgggaaaaggttaatatactctagagtaaaacttgcccagtatgcaaccactcacagagaaccactgtcaacaatttttagtatttcccatttcttgcaactttttatagctgagatcaaatgtttattgttcctacttattaatattattattattatttttgaggcagagtctctgtgacccaggctggaatgcagtggtgagatcttggcttactgcaacctctaccacccaggctcaagcgagtctcctgcctcagccacccaagtagctggaattataggtgtgaaccaccatgcctgggtaatttttgtatattggtaaagatggggtttcatcatgttggctaggctggttttaaagtcatggccccaagtgatccacccgcctcagtctctgaaagtgctgtgattgtaggcatgagccactgcacccaacctctttttccaaattgtaaacatgatttataatgtcttcataattttgatctgtcacattacccagaattaaccattcttattagtaggtatataagtttttatgtttttttcctatttcatacaatgaatatgtattcacaaatgtgtgccccgttgttctttattttagtagcttccagattataattatcagaaaaagtcagagaaatgggcagttccacgcttttcacactgtgaggggtgtttggaagcacctacctgagccttacgcttcagggagtagctgggagctgacctaggaactccgggactcaaaagccagatgtcatcaatatatatacaatttaagaatttaaggttatattatacctctacttagaacaacgttcagacacctacaagatcctgcctagtctggccctccttcctctgccacctcgtctatgcactccctcttagatgactccagtctcactgactgtctttcagcactctcacatgccctctcctcctgcctcagggctgctgcacaggtgtttcctgctgcctgaaatggacttctgcacgtgtgtgaaaacacacacacacacaccccaccaccaccactgcaccacacatacacaaacacacaactggccacttctccaaaccgtctggtcttagtttttttttttccttcttttagatgtttttgtaggcagaacagtggtccctcaaagatggtcatgtcctaattcccaggacctgtgaatatgttcagttacataggaaaggggaactaaggtcaaagttgctaatcagctgattttaagatggggagatttttcccttttttttttttttttttttttttgagatggagtctcgctctgtcacccaggttgaagtgcagtggtgtgatctcggctcactgcaacctccgtctcccgggttcaagcaattctcctgtttcagcctccctagtagctgggactaaagatgcccaccaccatgcccaggtaatttttgtatttttagtagagatggagtttcaccgtattggtcaggctggtctcgaactcctgacctcaagtgatctgcccgcctcagcctcctaaaatgctgggattacaggcatgagccaccgtgcccagccaagatgtggagatttttcctggaatatctggctgtgcctgttgtaatcaaaaagttcttcaaagtggaagaaggaagaagagagtgagaaccaaagaggtggaagcttgaaaatgacctttctgctgttggaagaaggggtcatgagccaagaagtgtgatagcctctagaagctggaaaggcaaagaaatcgattcttccttagagcatctagaaggagcacagccttatcaatattttgattttagctcagtgagatccattttggacttctgatctatagaactataagataataaatttgtgctactattcaaccattaaaaaaaaaggaaatcctgtcagtttttgacgccatagaagaacttggaggatattttgctaagcaaataagccaggcacagaaagacacatgatctcatatatagaatctaaaatagtcaaattcatagaatctaagaataggatggtggttaccaggagcttggggagatgttggtcaaaagatacaaaatttcagttagacaagaataaatttgagagatctaatgcacatcgtggtgactatagttaataacaatgtattgccttcttgaaaattgctaagaaaatagaatttgagtgttcttaccacacacaaaaaaaatgatcagtatgtgagataaagcatgttaactggcttgatttagccattccacaatgtatacatatatcaaaacaacattttgtaaacaatatatatgatttttaattaccaattttatttaaaaattttgttttgtcttaaacaactacatttctggtcatttgtgacagttagcaatggaaactaagggaatacagtgtatacagatgcttgtcctgactctccttaatctgaagtgactgaagtaggttcctgcttattctcagcagcctgggtttttgccttactatcctttatcacaatatggaattatttattcctttgtttgcccatgtttcgctgtaggccagggactgtcttctgtgttaccaatgctgacccagccagtccattataagctttcaacaaatagctattagttttgagttaagtgagaggacattcctagtcagcaagacagtgtatgtcagagccaagaggtagagaaacatgtgggtacatttgagaggctataaatcagatgactgttgtgtgaagagaatattggattgcaagcagatttacaggcttaaactaggttagaggcagggacaataagaaatggagagattctggtgacttcacattgtggaagtgacagaacctggtgctgagtctatgggaataggaaagtggaagtgacagaacctggtgcggagtctatgggaataggaaaaattatcaatgactgccatattgctggcttggtaaatggagtagatagtggtgattttcacttagaagttatcaaaagggagaaagaattgagaggaatggtaaattcagttctggacatgaataagatgcctgtgggacatcctagggtaggtctctggcagcctatcggaattataggtttggaacccaagataaagttgagggcttcctgtttgacttggatatggttgatttatgaagtttatgtaaggaaaatggtttttagcaaaaagaggaacaagaatggaactctgaaacactagtagttcagtagcagagggcagaagaaagggaaaataagacaagagaaaagtctgagggtatggtaacaccaagactagagaacgatgagggagtagccaaccagtgtcgagtgctacagaggatgcaacaggacttaatagtgtccactggttttagtaacagaggtaattaatgttccagaaaacattttgggcttttagacagtttatactaaagaattactggagcagagcataataatagtttttaagtcctttacttaatgttgtcaaattgcaaaaagatgaaattagttttcagtccagtagcagcatatgattgtgaccaaccatctcacagcatcagaagtagcatggtatctctgagtttatgtcctgactttacaatatttagtgcccttgggcaagttactcagccttggtttcctcttttccaaaaatgggacaataatattacctaccacaggtggttatgattaaagaagttatcaaaatgagtttttatttttaaagcacttaaacagtatctggcacatagtaaatgctacattgaagtgtttgttgggtaactgacagatacatagagagatggatacatacatgtatacatacatacataaaataaatgttgggtattctaattttttttatattttacaaatttgaaaagtaatgaatagtattttttttcagtcaactttatatatatactttacatatattaaaatgttcctggccaggtgcagtggctcatgcctgtactcccagcactttgggaggccaagcgggcagatcacttgaggtcaggagttcgagaccagcctggccaacatggtgaaaccccatctctactaaaaataaaaaaattagctgggcctggtggtgggtgcctgtaatccagctacttgggaggcttaggcaggagaattgcttggacccaggaggtgaaggttgcagtgagtggagatcatgccactgcactccagcctgggtgacagagaatccatctcaatcaatcgatcaatcaatcaataaaatgctcctattttaagcgaacagttaaattagttttgataaatacttgtacctgaatgaccatcacctcaaccagatgtggaacattctcatcaccccaaacagttcccttttgcctcctcccagtcagccctcaacttcatcctcaatcccaagcaatcattgctctgctttttttcctgtgaattagaatacccttttctagagtttcacgtcagtgaagtcgtaccgtaggtactctgtgcttagcttctttcacttggcatgtttttgagatgcattcatattattgcatgtaccaatggttcattccttccactccccgagtggtgttttgttttatggatgtaccacactttgcttatgaatacatttactctactaaatgtatagttttggttgttatgaataccgctatgaattcatgtataagccttcatatagacacatttttattgttttggtgtgtattcctttgattattattcctttattaactcattaaaagtttgaaaactttttcaagaatggtaactttttttgtttttgtgagttctatcttttgtccgtgttttattttgtggttttatgttttctatgttttaattattgagatagtctaatctttttatttcttctatatatgtaacatttataagttcccatgaaggaaatttttgacattttgctgtatatgcatgtatgtttgtgtatgtgtgtgcccagtaattttgggagttttaatcagttttgagaatgggctattcggcagttaatgaagacagctaacatgaaagttagggtaaactcaaatcatagttcatattcactataatttcttcagaattttttagattattttaaaatccatgtacattctagtagattctgtctagtacatttttcttgaatatgacaagtctaggttcctgacaccattcgttatcctttaagcaatgaaattttgtgtataacttagttttctgattaacttaggtttatctctttgttgtttttttgtttgtttctctttttttttttttttttttgagacagagtctcactctgtcacccaggctggagtgcagtggtgcgatctcagctcactgctacctctgccacccaggtttaagtgattctcctgcctcagcctcccaagtagctgggattacaagcgcctgccaccgcgcatggctaatttttgtagttttagtagagacagggtttcaccatcttggccaggctggtcttcaactcctgacctcatgatccaccctcctcggcctcccaaagtgctgggattacaggcatgagccaccatgcctggccctgttatttattattattattattattttaatttttaaaatttttgtagaatttaataccacacccggctatgccagacactcttctatttcaaatattatattcatttaatcctcacagcaacaatatcttcatagttatcttacagatgaggaatttgaggctaagtagcttgcccagggccacacagctaataagtggggtctacctcagagcccatgttcctaagctttatgctgtgttgctgacagggtgaggttaaaatatggaggccgggcacagtggcttacgtctgtaatcccagcaatttgggaggccgaggtgggtggatcatgaggtcaggagttcgagaccagcttgcccaacatagtgaaaccccctctctactaaaaatacaaaaattagccagatgtggtggcatgcacctgtagtcccagctactcaggaggctgaggcaggagaattgtttgcacccaggaggcggaggttgcagtgagccaagactgtgctactgcactccagcttgaacagcagagcaagactctgtctcaaaaaaaagaaaaagtaggtgcaaatctcagtaatagaatagcagattcacacttaatctttctcctgttttaggaagttaatacttaaaagaattattatttattttttctttttttcctttttgagacagggtctcactctgtcacccaggctagagtgcagtggtgcagtcatggcccactgcaacctcaacctcctgggttctagtgattcttcgactttagcctcccaaatagctgggactgcaggcacgtaccaacttgtctggctaatttttttaatttttttttgtagagatggggagctttctctgttacccagactggtctcaaactactgggctcaagcaatcctcatacctcagcctctcaaagtgctaggattacaggcatgagccactgcatcggccaagagaattttcaaagtatgcaattgaaaatgtaggcaagcagtctctagatcttaataatttataggtttctgaggttcagcattattgtcctagttaaataggcactttatcaaatatatttttttcatttgagtcatctttgatgatttctgttggtaagacaatagaaatgaatttccttttttaaaagtttatacaaagtttattaaaaatttttttttaaaaatttaaagcttatgcatttcaaaaatatcaaatacagtagcagttagtttggagtgacaagacgacccctgaagattttttaaggagagatttccttgtggtagagtagtgactgggaattgaaacatgcggctcctggagggagcgctttgcgtctttaaagtaagttatttattcttttatatttaatttccttattgatttggtagcccttacagacccattgaaaacacatagtggccacctccaggaactatttcctgtttgctcccaccttaagtaatctctcatttttctatctcttataacattttgtctactttaggtactatttcattttttaaacctcattctataaagtgttggtcacaatcccagagctttagacatgtatgcaattttttgttactgtttattatttttcaataataagtggaaattaagatctttctgttttttcaggccattttatacacttgatatgaaacttcctgtagaccattgttatttgaattgcttcttcaatgcagttatataacttggaaacttttggctgtgtaccaaatttatttaaagtcatttgaaatcatataagtccatttaaaaatgttttaccacaaatgtatttatgaatatgcagttaatgctaaattccaccttgatcattcattagctttgtggatctgtttccagtataacagggagaacactaaagctgccatgagcattaaattagataatgtctctgtaagattctattacacaattatcctgttactggcttataaaaggttcctcttaattgtggattgaaataaaacattctgcattaacatctaaagatataaattatctttaacagtgtttaaaattaagtaataattagtccaaacctcatcatgaaatagatcaacataaagtaccatgtggctcagttgaaagcaagttctttcagtttttattttaattctcattaaaatataggcaattttggagcatcagttgggggccttcccatcttcttttcaagtggaactgattggttttatatagtacttctgttgcacattttttattttgggattctggcctgcttcatcatagtgttcgtttctgaatcacagtagctaaactattgagtgcatatgtattgacttttgtgattttggaagacagcaaataaagtacctgctttgcaggtgaagaacctgaaagacaggatgtttcctattattgttttgatattagcctttttaatacaacatcatggtccatcagaagaacaagcctgagccaatgagccttagctaatcctaactcaaataaagctaccacataatgtttctccctatccagagttaacactgggtcttagtggactcatttgttcaaatgaagggacgtggcctcatgattattaaagccgtttttagcacttatggactacctatctcagctttcctggttcatttgtcttgagcacctcttagaagcattgcagactttaattttgttccacctatagacattgctttgttcacctttgtttatcatatttttagaacaggatttaatatttggaagggagatctaattctttcagaggaatatttttgtttgtttttttctgtaaactgagttaatgtgatacaattagatgcttcctttatggctgtataggtaaaatcctatgagagtaaatgtagccttttaaagtaaatgtgattaagaaatatatatacttattcaacagttacagtggcaagcatgggttgggaatggtgacttgctttgctctccacctaccccttgtctgtacccaggcaactgtccagggctggaggaaaatgcaaaataatgctgataggtctcactttaaattcatgatcaccaactacaaaggggccagtagtgctgtccagcgttccttccatgctacctattgtcttgcttttttatatgaatattttgtactttcttctctcctctcaaccattaatagctcctttcctttctccccgatcccagtgctgatgagagaataaaaatcaaccagaaggaaatgtctaacctttctccctacctggtctactaatgtacctatatctgtacccaggtactctgctggacttcagttattaatatgccctgttattatctaaggacagtcctcacttattgaattcacatcctgccttccctacttattgccacctctagcagtcatcccttctctcttctgcattgttaatgattcctctttctttaccagatcattcctatcagcatactcacatgttgaaatagctcccatctttaaaaggaaaaaaaaaaacttcctggagaccccacagttccctaaaaatattgccccatttcttcttacctctttgcagcagaactcttcaagagttgtctattctagctttctttccattctttcttgaaatttctccattaagactttcagccccacctctctgccaaaacagctctgatcaaagtcacccatgatctttccaaaggcaaatcactgatcagttctcactaacttgctctgacagcaatacttgatatggtcacactttcttacactctcttcccttggattccaagaccccacactttctgattttcttctgacttcagtggcaggttgctccctcatttcctggaccttaaacttccccagagttggttcttaaccttcccttatatgctcacctcctatgtcaaactagtggattccatcttgtggtataaactgtctattcgctgaagactactgaatttatatctctagcttggatctctcccctaagcacacactctcgtgtccagtggtcttgctttctccctgtggatgtcagaaggttcaaggccagtttctttatttccagtgctccaaactggttccttctgtagtataccttatttgtaattgctcttatcaaaaactgaagtcatttctgattcctctctagggacctgctgcttgccataccttcaaaatatatccagaatgttaacatttttcaccatcttcatagctacccctccatccaagccactaccatctcctgcatggattattgccatcgccatcttgttggtctcctttcctgtctttatctcctttttccattttccctctcattattctgccacactggcctgcctgcctctccttgaagaagctaagcacccctcacacttcagaaccttcgtgcttgctgcttcctctgcccagaatgctctaccaccaaacattcacaggggtctcctactccattcaaatgttcagatgtcaccttgtcagagagctctttccctgaaaatcctatttgatatagcaccttcctcttgcctgcattctctccaaacataattatttgtatattattaacttccctctcttctttgagggcagggactttgttctgtcacatctatatctttaagacccagaaccaagcctggaacattttggtgttaaatgaatggaggaaggtagtggtgatagtggtggtggtggtggtggtggagattcatggtattattctgttagatattaaagccccaaattagtttttaaagaattcacacacaactttttcaaacactatataaaacaaggtaaatctgtatacacacaaactttaaccaatcttaaacacagtcttacccacgatccgtttcaacctgtatttgatgatgaggctgactagccaacatttaagtaatcactatacagtagacattgcggtaagattatccagtttaattcccacaatactcctttcagtatatgttataccattttatgaaaaaggaaatgaggcttagtgagcttacgatgaggccagctgaagataggaagtggcagccctgggactggatctcagtgtgtttagcttcagaacttcttaagaatgatgggactggctgggtgccatggctcacacttgtaatctcagcactttgggaggtcgaggtgggtggatcatctggggtcaggagctcaagaccagcctggccaacatggtgaaacctcgtctctactaaaaatacaaaaattagccagtcgtggtggtacacacctgtagtcccagctacttgggaggctgaggcaggagaatcagttgaacccaggtggtggaggttgcagtgagccaagatcacaccactgcactccagcttcggcaagagagggagactctgtctcaaaaaaaaaaaagaatgatgggactttctaaaataaaaccctcctggagattcttttacatatgatctgtacatgttagtcatttatatgtttacatacttaaatagtaaagtatttgagaaataatgtttagttttagaaactaggggttaaatgttgtgattgttaagcagtaataaatataaatgataaacaagacacctttttaaaactttgagctaaaaattaaatctcatggcactttgcctaatgacctaagctagatcttgtggtctggttcatacaaacatgttctgataccaaaaccagagtgctgttgctatggctgtgaatgcttttctgtgtgagtacatagataccagtaacacagagccatggcttggagttctctgagttacttctctagagagaggaaagtgagaaatgaaacctcagcttcagatttgtaccgttaactttgcagtcgtgtattgctcttcataaaaacagcctcgaagtcaagagtaaaaattctgtgaaggtcgataaaacaagaagggaattgctaagtacaagggaagaaggtatcaatgaaacaaaccatggctagtcctgctgttaattttctggttctctagaagggacagtgccaagttagagttggggaacaaagagccccactctcctgcttttccttcttctgccacatcctgcttattctcctggtccactgaggcatgaatccccttcttgaggaagacctgaatgatgggacagcagtaacctgggggttttggtggcacatacaaaaaaatgtgtctgagagaactgacatttctcttaagatcccaaatgcctgtacagtgaatatagctgtcagtggcaccttctctggggggaaggcaggtccagattgcaaacactgtgctgagctaggttttcacagaatcaagaaagtagtgatgctctctgggagagctgttagcaattatgcgaagctgggagagctgttagcaattatgtgaagctaaatcctgttcatttagatattttagataatgtgctgaaaattgtcagtagagacacaaatatttgtaactaccatggatcttaaaatgtggctccacattcaaaataggctattgtctaatccactctgaaaacttctttgaggttctctttgttcttttgggaacacacatcaaaaatgtgaattggaactaatcagaggaattgtttgttgaattcataacatgatagcatatattgttttgttgatcttatctaatgtgaatgcagctaccaagtttttgtataatagttgctagtgcaatcttgagctattgattctgatttcttgctgattttatgctttgtgttaggatggcatgattcattcctctgttttcgttattaatttaaaaatgtagatatttatttcaaggtattataagtgtgcatatagttcagaatttccaagtgtcttaattaccaaaataaattgctgagatgtaattctttaaaattttaaaaaataagtaatgcatctttagatgagactgtttatgaacagagaaataagataggaggtgacatggataggcaattagtagctcctcctcaggattagtccataaggtgacacaaagtattcttattgtgttcttttatttttgcaggctttgtgtcatgaccttaatttctttttctgttccaacatctgctagcttttaaatggaataatttctttggtatttgcagtgtttgggagatgctttgaacatgctcagctattgtccccaagcaactgagtgggtcaaatttgagattggacttgttgtggatttaataatcaaccctttttggctttaaaatatgacttgccctttatttcactgttctcgttgtctttcctgaacaggctgctgatactttggctgtgaggcaaaaaaggagaatttatgatatcaccaatgtcttagagggaattgacttgattgaaaaaaagtcaaaaaacagtatccagtggaagtaagttacaaaccagcaccctcttctgaaaccttttttcttctcagtgctctgtaaaatttgaccttcccaatgtttctatctcccaaatcctctatttcagtcaggcccctcagctttccctgaacacacctttctgggcctctgtgtcactcctgtgttgggtgttcccttgctctcttggatattgggttttcgctcttaaaattcaaatcttactttctccctcaagctattactcatttggcacacattgcatactgtcttgtattaatctcttcctaactctttacctgtccttgagagcaagaactactttcataggaatttgtactttgtaaatagtaattaattgaaacgcatgttgtcattaattgtggcctggttatacgtttgaatgtaacaatttctgttcttctaatgtgtcccctttgaccatagtttttgtcttgttttgttttcgccaaaattccaccaaaacattaaaatgttgtaatttattttaccagcacctcagtcacatcctgagactgctaggtgtgactgctgagcacactcttttggtacccagtcaccaaccagtctggccttccagatgacaaaaaaacactgtagggaagattgagaatttttgtaatttggttgttcttgtcaataaattttctaagcaagaagtatggtgtttaaaatttttaaggattttagtgcttgattttaagagtgtaaagacttctgtcttgaatatattactaaataagtcagttttattacagtaaaaattaagtgatattaacctagatctgatactgaggatattaattctcatatgtttttaagaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagatatccttttaaataagttatgcatatacatatagctttggaatatgtatgtataaatcatttcagtctaaagatcattcactttgtttttagacagttaagttttataagtaaatatgacattttaattttattatattcttatatactaatattttctaaatgttacctttttaagttatatagtacagatccgttagcgttattcctgtgttgcactgagggggaaaaagagattagccaacttttggtctaccaattgatagaatgcagtatgctagccagtgtgcttaggaaatctgtgaatattagaagccattgttaagtacatttgtatttttaaataattatgttcagtgttctgaagtataaaattcagcagctctcaaagttttgaaaatttttcatttaaagatgagatatgatgtgtccacaatcaatccttgatactttctgcctaacatgaaccccaaaatagttcctactggagaacaggggtctaagtcgtgtgtgcctatcaacaatatatattgggggaaaaacattattatatataatacatataatatcatatataatatataaaatatatttatatataatatataaaaacattattatatatataaaaacacatatccatgtgtttcttacaaaccaccgtcttctctcaggtatctgtgattctcttagtttatgaacttacctgtactcttaaagaaactaaccacattttaccttgtagcacctcatgaaattttgactaatgtatacaatataatttacttttcacattttcatgtatttggtgaacaagtccatgatctcatttgttatttcctttgtatggatcagagccccttaacagtttgagaacaatgggagttttcaagctgtgttctgtggagctctgaaattcaaaagccattaatctattttatcttggacttcgctgccctgctttacgagatgctggccattcccattgccccaaccatggttatgtgtgatatatataaagttttctgtatattatggtattttgacatctccataaacctttctggctgaggagagactgcccatcctgggactagccacttcttagaaacagcatgggctcatgtcctttttagggtcatggatgacgctggaaaccatcattctcagcaaactatcgcaaggacaaaaaaaccaaacacctcatgttctcactcataggtgggaattgaacaatgagaacacatggacacaggaaggggaacatcacacaccagggactgttgtggggtggggggaggggggagggagagcattatgagatatacctaatgctaaatgacgagttattgggtgcagcacgccaacatggcacatgtatacatatgtaacaaacctgcacgttgtgcacatgtaccctaaaacttaaagtataataataataaaattaaaaaaaaagaaacagcatgggctcagccaggagcatccctttgatatataaactaaccagtcaaggtccagacctcctctctccagtccatacaccccaggtggcaatattcctctgccttaatcatcccagggtcaggtaccagacaactgggggactacctgcatagcttagagcccaccaaaattatccaaactaggccaaatgcagtggctcacgcctgtaatcccagcactttgggaagccaaggttggcggatcacctgaggtcaggagtttgagaccagcctggccaacagggtgaaaccctgtccgtactaaaagtacaaaaactagctgggcatggcaatgtgcatctgtaatcccagctaccagggaggccataggagaattgcttgaacccaggaggcagaagctgcagtgagccaagatcacactactgcacttcagcttgggcgatagagcaaactccgtctcaaaataaaacaaaacaaaattatccagactagctaatcgtagtgttctccccaccctgcttttttttttttcctgagatggagtcgctctgttgcccaggctggagtgcagtgatgcgatcttggctcactgcaacctccaccccccgggtttaagcaattcttctgcctcagcctccagagtagctgtgattacaggtgctcaccaccatgccctgctaagttttgtattttagtagagatgggtttcaccatctctagactagacttctttttttatctgtccatgtgtggcagcccctctgtgcatatggtcaggctggtcttgaactcctgacctcaagtgatccacctgcctcggcctcccaaagtgctgggtggcgtgagccaccatgcccagccaccctgcatttcttttcccaaggaaaccccaataaaagctctgggctaatgctttccccttgctcctgtcttctgcctcctgaccaccttgttgtcttaaccatgtggccctgagtagcctgccttgcctcccgtcactaggacctatgagtataatactttgtttttctgagcctttctttaatcctctgtgtcctcttgtggccatacctgaccatttaatacaagaacaaaaaacaacgatcacagaaaattcctgatgtggaagctgatatggttgctgatggcctccttttccccatccattcccttcccccagaaacctttgcctccatgaagaatgtgcactgctttccatctctctcctaagggtcctcaaatgtcacaaaaatcagaatggcttcttctaagagcaaaggatgggaactcctttgtctttacctttctagactagacttctttttttgtctgtccatgtgtggcagtccctctgtgcatatggtcatttagttattttgaccttcagatgtattaccttaatttaaatgcctacggcttgatataaatgtcgttccttaactcctatgacagtacattttcctatgtaactcatgaagacatctgtaattgctttaatggtaagtaccattagacttttccttgcattcttcctctcaacctatttagtggagggtgattcagaattccctgtgtcctcatcctgtcattattttcagaagttgtgggcattgtgtctcactccaccatgccgtgtattgatagactgcttttgtttctgttttcatgagaatagctgcttttcacagcattcagttcattagctccactggtagggatcaactgtgtgtggaaggggaaggggacagggacagagggcaagctaaatcagagcgggattaagcaactttcattgtcacacagtcacagagttagtgaccaaacttgaactagaacatggttctcatcagcattgtttatcaaactatatgcaagtatgctggtctcaaatgaaactcaaagaaaccataaggaaagaattaggtgaatccatcttataaccaggaaacctattcctatgcaatttgctgcccctgtgttttctccttaaaataacaatatcatgttaataattataattattaatataactaaaatggggggacgtgtgttcccaaaattatagcacaagtaaaatgaaattgtgcatatttaaatttatgtgtattatccacctatttaaaaagattctgccaagtacctcatcaagtggaatctgactttctatgtaagactatgttggaaataagtataggactattgttctattttaccactgtatttcctgagttttttaaggaagtttgctgagacttctgttaatctgcaactcaacagagatttgttgtagaatttggcttcaaaaataataaaatcatttaagctcaacatttcagtgtctcatacctaatctccactatcctcagtccaatgaacagtgttatttgaggctaaatggtcttaagaatctcagactttacaggagtcttagtcaaagcaaaatcaacttgagctgaatttgttaatgagaatcatacagctaacccatgtataatactaatacatgtattatcttatttaatcctcaaaataaatctatgcagtaggttgtgtatcccccattttatagaattgaaaatcaaagctcaaggtcacctagtttgggattgaaccaaacactctgattccagagcccacattcttgccactgtattccatgatcaacagtattttatgtaactttttatatttatttttgaccaggtgatacacttttggccattcaggcaccttctggtacacaactggaggtacccattccagaaatggtatgtaggataacttatgtttatataagtgggaaaaatgaatctactgtctcaagaaggatattttctttagctgaatgtgagctaattgtgtaaacactgtgagttagtcaagtttttatctaaaagtattgatagctgaatttgtatgtctttaattccttggtaaaattatagaactaaatgaatcataaatgattttaaagattattggctatatccttagtcatttattgatatcatttagctcaaagtcaatttttaaaaagtaatcagaatgctttatcaagtgatttttgtttcatacaaaaattaaaactattgtataaaattatcttcaggctatgtgaataaggtgtgtatgaaacaaatgaatattgtgtttagacttgggtcctatccctaagatatctatccccaagtaaccaaatgatttaaaatgatttaacattttgattaaattattttaaatttgaattttttaagttagaggatgtcaagaaatgactaatcatatggccaataatctataaaaataagttaaaatgaccacattgggctgggtgcagtggctcatgcctgtaatctcagcactttgggaggccaaggcaggtggatcacttgaggtcaggagtttaagaccagcctgaccaacatggtgaaaccccatctctactaaaaatacaaaattagccgggcatggtggtgcatgcctgtaatcccagctacttgggaggctgaggcagcagaattgcttcaacctaggaggcagtggttgcagtgagccgaaatcgcgccattgcactccagcctgggcaacaagagtgaaactctgtatcaaaacaacaacaacaacaacacatctacaattgatataaaaattgccactgaggaaaaagttcaatgtacatatcaacaatcaattcctttaaattaggtcttttataaaacattgtctggcttattaagtcaaagacatttattgactctatgagtttcatgattttcgttttcagattcagatttttaaaaacaaactaatttgaaagcaataaccaaaaaagggagtagaaaaagattactatattatctacctccttcccccacccgcttattaaaaaagtttacatttaggcatttgtattactggagtctgaagcctcaggatacagattactttttcagctggaagaatgttatatttatttctcagtaggagaaattagttgtctttgtgcttgcagatgggaaaaaaaagagtttgatttgtgaagcatgttgaactgaccagatctgtggtggccaactccaggggataaatttcctgtatatggagaatacctggagcattgctgggccctgacctattatatagtcacacacggtaacaacagatggttgccagaattctacaacagagagtttctaatgatcagtatttgtgaaaagcttactttttagaaactagtggtttagagccctcaaaattacattctactctatgtctctacttttgtgttttgacttaatgactttattgtgttatgtgaatttagtaagtccctaatagctttgcctgtcttattgtactgtcttaagttagctagaaatgttaataattatacatttgtttatacccaataacttcaaagggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcaggtgggttcagagcctttcttttgtaaattagagagggagaaatataaaaacaggttggctctcttatccaaagtgcttgtgaccagaaatgtcccaagcacttttgacattttggaatatttgcatatacataataacatatcttggggataggacccaagtctaaacacagtattcatttgtttcatacacaccttattcacatagcctgaatataattttatacaatagttttaatttttgcatgaaacaaaatattgactgtggcttgactgcagcctatcacaaggtcaggtgtggaattttccatttgtggcatatgtagatttcagcttttacctgaagtttacttggtaaggttcttttatctctcttagtaagtctaggataaattagtgaaatatgttccaactacctttaagaaaatatgttccaactatctttaagtatggaccatagtgacttatgcctcttgtttctccatattctttgttatactttttatttgggaagcttagttttatagaagtgataaatggtctcaactccaattatgtaggaaatcttactttcctcatttgtttcatttatgaaattttaaaaagctaaaacatttcacactgggtatcaggagtagagagcacaactcttaatttggcagtaccttactgattccaaataaagggagcatggtaggcaatctctcagtgactactgaatgaatgaatgaatgaatggtgccaatatagacatcatattgcagataatttaaaactatattgtatataatccaaattgtttattttacctctaggatgtgtctcattgctaaaatgggatttcacaggttaaaagtgacgctaacaagatataactggacatggaatgttttttagcttctttttgcccacatctattcctttctttcccctataaatatgtctatactacagaccattaggatgcacaatagaaaaggtagtgctggctgggcgtggtggctcacaactgtaatcccagcacttagggaagccaaggcaggcagattacctgaggtcaggggttcgagaccagtcttgccaacatatagtgaagccctgtctctactaaaaaatacaaaaattagctgggtgtggcggcgcacacctgtagtcccagctacttggaaagctgaggcaggagaattgcttgaacccaggagttggaggttgcagtgagccgagatcgcaccactccagtctgggcgacagagtaagactccatcttaaaaaaaaaaaaaaagaaaatgtagtccttaaaaagcttacaatctaattaggatataaagcaggcaagctttacatgggttttacctgggttagcttagacataattaacacactggcttcaacaaagtgtttttaaaaagtgagtattctgtttttatggtttcatgtttggaaatcctaactaaggaaagtaattttgggctacattagagcaggccttgaatttcagagtagttaggacatttatccaataaaccagtgaagatctgtgaccaaggaaatagcataattagctataatggtgcacacaggagtaatatgattaggaaagatgcttttggccctgggaagcagaattcagaagcgatggaaactgtagatgtttgcagttatgcaactgagagaacattagggctaaaacaagggccaagtgtggtggggctcatgcctgtaatcccaacactttgggaggccgaggcaggtacactgcttgagcccaggaatttgagaccaacctgggcaatacagtgagaccctatctctaaaaaaaaaaaaaaaaaaaaaaattaaaaattagctaggcattgtgacgtgtgcctgtggtcccagctactggggagggaggccaaagtgggaggattgcaagcctgggaggtcaaggctgcagtgagccctgacagcacttaatgtactccagcctgagtgacagagcgagatcctgtctcaaaataaataaataaataaaaaggctaaaacagtgattacagtgagatcaggaagagaaataacgaacagatttgagaaacactgtaggcaaaataacatttgatgtgtgagatctggagataaagttaacaggaatggaaagtgatgttgaagttttaaggttgaataactgggagaattatgaaactactgactaaaactgagtcagttttggtagaatgatgatgaggtttggtggtggtttttttttttttttttttttttttttggcagggtctcactttgtcagccaggctggaatgcagtggcgcgatctcagctcactgcagcctcaagtgatcctcccacctcagtctcccaagtagttgggactataggcacgtgccatgaatgtctggctaatttttttgtattttttgtaaagacggatttcactatgttgcccaggctggtctgaactcctgagctcaagcaatccgtccacctcactcagcctcccaaagtgctagaattataagcatgagccaccatgcctggcagataatgagtcttttggtcttcgtctggagtttggaagtttaaaagtaatgccaggcacagagtaagcgctcatgaaaacaacctgtccacaaagtactagtactttaaataaatgtgcatgtcagtcaagctgctgctgtgactacttgtgtttaaatatgagtatcttttactgttaacagaaatataacaaaactttattactgtttccagcaggatctattagtggagatatcattgatgagttaatgtcttctgacggtaagtaggttaaaattttactaactcacttatcagtaatgcttctgtggaatttataagtgaaacatgatttaaaagaaatgaacatatatttgctacctgctttactatgaagattcatgaaaattctcccttaacacttacagtaagtaataggcaaccttcagaatttatttttctttgcttgcattttgagggaaaggaatccatatggggatacttctcaccttcattgaaaataaactgttagccctttccactcctgaaggatctggtccaagaagagtaaaataacttgtctaaatcaagcaactgatctgaacacctgcctttgtaaatacccctacccaggccaatttcaagctgccaatgggaagtcactgaattagtattaatattaaccatgttgtcatctaacctgaaaaattattaaatatcagttagctacaatatgctaattactttaataatttctctccttctgtaagttcttggatcagagtcctactacctaacaaataaagtagaaacctacgaagtggtagcagttaagttagcaaatgttatagtaactagagatgtactaaacatgtatgtagaagcagagaacatcagcaaactttgtaagtccagttcattcttctgtttgcaaagtggaaaacaaaacactttcattagtgttctgttttttttttttaaggcagagtctccctctgtcatccaggctggagtgtcatccaggctggagtgcagtggcatgatagctcactgcaacctccacctcctaggttcaaatgattctcctggctcagcctcccgagtagctgggatgacaggcacctgccaccacacctggctactttttgtatttttagtagagacggggtttcaccatgttggccaggctggtctcaaactcctggcctcaggtgatccacctgcctcagcctcccaaagtgttgggatacaggnnnnnnnnnnnnnnnnnnnnnnnnnnnnnnnnnnnnnnnnnnnnnnnnnnnnnnnnnnnnnnnnnnnnnnnnnnntggtggcaggcacctgtagtcccagctactcgggaggctgaggcaggagaatggcgtgaacccgggagtcgggagcttgcagtgggccgagatcgagctactgcactccagcctggacgaaacagggagactccatcttaaaaaaaaaaaaaaaaaaagaaaaaattaacttctgtttctcaatctaatatcaatattcaatgtacaaattgttactaaatgagaatatttcaaaatacacattacacaagactttaatttggaatgatgtatttgagagtattttgttaaagatcattaaccgtatgtagaaaccatctttaacactaaatttgttttttgttcgcagtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattcaatttattggtctttgtggagaattagatgcatcaccagtatattacaacagagccattaatcttgtagcttcatcaacattaactggtttgctttcatgacgctgctgaggaatctgaaaggagaaagtattatatttaaaaacacagacaacaatagcagacaaatgacttatataagctgttattcaatttaatttttctagtcatatctttggaagtagaacaatctgtatattctgacaatgttttagagtctgaatatgctatttatactatagagcctagtactagagagccaagtactaaaaattacactcaacttacaggctttgaaaacttgggagtttaatttattagcctcaatttgttagccataaaaaaaagcaaatgatttctgcttaccagttctttctgcagaggttcaagtgaaatgctttttgcgaaatgtgcaagttccttttgtacatttacaaaagctttatttactctgttaactttttcctcattcataatgtttatcttttaaaaagaaaaaaagcattaatctatgatctcataaccattaaagataagatatattcaaccttaacctgttaaatctaaaatctaaaaactcttaccaacaaattagggataattcactcaaaaattcttatagtcttattgggaaattacagacaaaaagttttggtttttaaaaaatgggatttatgtggatatgcctcacacttatggttcagaaggctaaaatatgtgactgtgatattgtgattcataataagatatatatatatatttggtctttgtcctcatttcctgtcatacagctttttaaatcattgtattaagagggataagagtgtcttttgaatgctaataagatggctggtagctgggagtctctagatagcttcaggaggagggctagtcagataaaaacacagggttagaggattaggactttctgctccagaggagtggggataaaggttaagcccatcactaatggccaatgatttaatgaattatgcctacataatgaagcctccggaaatctacaaaagaactgggttcaaagagcttctggatagctgaacacatgggggctcctagaaagtggcatgcccagagagagcagggaagctccatgccccttcccatgtaccttgccctctgcacctcttccatctggctacgcatctgtcccctttgtaatatcctttataataaactggtaaaagtattttcctgggttctgtgagctgctctagcaaattaatcaaacccaaggagggggtcatgggaacacttatttataactggttggtgagaagcacaggtaaaacatctgggacttgtgattgtcactggaagttggggagaggcttaggactcaactctcaacctgtggaatctgacgctatctccaggtcagcagtgtcagattttaattaaaggacacccagctgctgcctgctgaagattcatctgcagaattgttaggtgtgggggaactgccccacaaatctagtattggaagtgttgagtgaccgtatgagagtgagagtaagagaaactgagttgcttttttcctgtatccttacagtgaccaaaatctttctaggctacagtgctgtcatcccgcatctatacaagaaacctggatcaaatacttttagtcccttctaacataacaatacgtctctgaatccttcctggaccttcttgtcttaatggaagacccctgatgacagcttccctcgcagtcctcctcttgagtttaacagaggtaggggtggtgctcttcttcttcactgttgctgctgccaaacaatttctccttcaaaacccttacctcctttgcaccttatgcagcctacccatagatctctctcttagatcctacctggtggcatatataaaagttctagtacctcctgtccaaataaaataatcttcctcaaatacaccaagcttttccctagctcagggcctct

SEQ ID NO: 12022 - DNA, 4652 bp, Human
ttcagttacattagttgcatttcaggtgctcagtagccaagtgtggatggggctatcatattggacagcgcagatatgtaacagtcccaccaccctacagaaagctctactggagggtgctgagttaagagctacacacgctaatgtggatcaatttctaaaatatgttgttaaatggacaaaagcaagctacagaacactatataagcaatcttttgtctttaaaaaacagtatttacatacatgttcatatatgcacaaagtaattctgcaaggatacacacaaactaatagtggctgtatatggggcaggggtagtgcatgaaacacttttaactttaggccccttcacagtttgaaatatgtatcatctattcaagataaatgaatgaaagaagggcaagcttaacagtatcacttaggagtaagcagtgaactgaaaaatccctctcagatgtattaattgggaggtcattgatgatttgagctagtcctactacccctccaccacccactgacacagagaacctgagattctgaaaatcatacagtccaattttctactctgctgacaaataatatccacagaggttaccaagttcatctagtaacagcctctaatggcagtatggaaagtacaatgtaagtctgacttcctgcctaacatgcattctctttattcctgtaatgagtacccctctgccatatgaagctgtctgaagggtcaatatgaaagcaagagctgtctaggaaggccacagcaggcttacctcgagggctccaccctgtaccttcttgattccaatcattttaagctgcagcaaatcatcgagcatcatcactgcatccaccaccatcttagcaaagaaagctttctgctgggagatcagcttggagctcagagcggtcatggcacacttttccagcagcttcctctgctccctgggacacaagggcagaatctgcatcaggtcttgaaaaccaaatccctcttatctgattctactacagtgtggaggtagttcccttccagtctctaaactcagccctctccaacttcaccttttgtatctttagggcagattatcagtgacagatggtgactgcagtcaaagatctcatatgtggcagcttttaaactacagtcgacagcttcttttgtgctctgtgggctgggacacagccaagggtctggcaggagccaaacagccccaggcacatagagggattgcagcatgcttctgcatccaatttggccacaggaagtcagtcaaggttctgacaaaggcctgacacggtgactcacacctgtaatcccagcactttgggagtcgcaggtgggagatcacttgagccagtagttcaagactagcctgggcaatacagcaaggctccgtctctttaaaaaaaaaaaaaaaaacccactacagacttacactttatctgccttcttcacggtcacagcaatctctttgatcttgttaactgcctgccaagaacagaagttgaatgagtctctcatgctaaagacaaactgctgaagtggacctcaatctctcaatagtcctgagtctgttcactcccaaatcctaagcatttctactctacagctgaaaaaacacttctaggtcttgtaactgctcagaaaaatgtaaaactctatagttcagaaaattccaagtcagaaatgcagagtgggtatacagttctgaagaatcagggtgcttccaagattttgctctgggtctgcaggtaacacgctacaacgaatgagtggaaacagctgtgacacgagattaagccaaacctcctggtttactaaaaacacctacgacaacttctagcactttatatattagttatatataaaatatgcatacaaatatataaactttttatttttttccaaagtactcctcatatattatttcattttaatgtcaccactcaaattagagatagcaaagaaagtaaggcctagaaagattaaatgacttgccccagatcacaaatgaaggttagagggcaaataatagctaggtctcaatatacaccatgaggtgcttgagtatagcatgtagtagtagtatgccatgagtctcttagtccttactaaaagactatgtctacatcatagtctaccaggctgactctaacctgaggcttaaagagattaagtaatacacctcatcaaatggctacagattagtagaactgagattactaaggagatgtcagaaaatgcccaaagtaccctgttccccagtccctccacactcctgaaaagaaattccccttcctaagagaaatgtgaaggtgtccaggcccaagagaaggttaatcagtactgccataccagctgggtggctgtgcggaaagctcgaatgatgatctgggggtgtaaaccttcctccacatagggtttcacctgcttcagaaactctgcagccagcaaggtcactgaggtggtgccatcacccacctggaagatgatgacaggaaatacacgttttctgatgttcagggaataaagccctgaaactccatttttaggcacgctacccatttaaactgaatattatttaaatggatgtcaagcttttttctggaagcacaggtttttgcaataagtagaaagaagctaatggtagttacatatccatcatgtcaaacagtcctgggctaccaaattaattccccagacagccccattctctaaagagggctgatgtggacaatcaaatgtcctcagggtaaaaaattacacacatgaactgagaacttatgttacgtacaaggcattgtgatgaataaaacagtccttgtcatgcttattgtaatacaatacttaaaataatcatggtaccaagaagcaagagacaaacattgtttaagaagcaaaaggtggctgggcacggtggctcacacctgtaatctcagcactttgggaggctgaggcaggtggatcacctgaggtcaggagttcaagaccagcctggacaacatggtgaaaccctgtctctactaaaaatacaaaaattagctgggcgtgatggcgggcgcctgtaatcccagctactcaggaggctgaggcaggagaattgcttgaacctgggaggcagaggttgcagtgagccaagatcgcaccacagcactccagcctgggcgacagagtgagactccgtctcaagaagcaaaaggtactgcaggagttcctttcttttttaatagagaaagggtctccctatgttgtctagactggttttgaactcctggcctcaagcaatcctcccacctcggcctcccaaagtgctagaattacaggcatgagccactgcatctggccaggagttaaaaaaaaaaaaaggtaactttcagtcaaatcacactaaaacaaacgtcctaggaccagccaaagttctttatatttcaaaaactatgaggaggccaggcacggtggctcatgcctgtaatcccagcacttggggaggccgaggcgggctgatcacctgaggtcaggagttcgagaccagcctggccaacatggtgaaaccccgtctctaccaaaaatacaaaaattacccgggcgtggtggtgggtgcctgcaatctcagctactcgggaggctgaggcaagagaattgcttgatcccaggaggcggaggttgcagtgagccaagatcacaccattgcactccagcctgggcaacaagaatgaaaccccctctcaaaagaaaaaaaaaaaaaactactgggaataagcagattactagtctgctaatcttttttagatggtgcttttctgtgatgggatctaaatcctatttaatgagggtgaaaaagaaaaagagctttctaagaaaattggataaactctaaactggaagaaatttatttcggtagagatggggtcgtgctgtattgcccaggctgatctcaaactcctggactgaagggatcctcccaccttggcctcctaaagtaatgagacacaagcatgagccaccatgctcagcccagaaatttatttttaacttcatgtatgttcactgtgtaaggtaagaaattctcaaggggcaaaaaaaaaaaggttactatagagaaggtttaagtgggcagatttctggaccaaaaggcattattccctcgttgaagacaaaaacaaatcaaatccagactcttctctctttaattttatatatgctatacctgttttataggcttggctcctaataaaccttttaacgtaacttcaagacatacctgtagtatacatattttgcagtactctaaaatacaaaacctatctgtcaacacatttattaatactccagtgttagaatttatttttaaaagatagactggctaatgccatgaattatacacttaaacatggtattaagaataaatattatgtctgttttatcatcagtttaaaaaaaaaaaaaaaaagcctggtgtagtggggaatgccagtagttccaacgactaaggaagctgaggtgagagaaggcttgagccccggagttcaaggccaacctgggaaacatagtaagaccctatctctttaaaaaaaaaaaaaaaagaaagaaaggcagattggaagtcttagtttacagccccattttgtaagagatgagaagtcaaattatt

SEQ ID NO: 12023 - DNA, 6253 bp, Human
  misc_feature (1)...(6253): n = A,T,C or G
gagggtggagatgggtagggtgtgtgcgcttgcgcagtgcgggggtggagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgaggtgagagcgggcagggcgcgtgtgcgcggtaccttggcttgggcccgggagaagatggaactgcgcgggggtcggggagggggcagaggggagcggcggccgccgccgcacgggttcggccagagagcggcgcgaggtgaggagaggcgcgggcgcgcgccccggttggcgcgcggggtgacggttggggttggcccggtgacgttggagcgacgcagggcgggggacggcgagccgcgaggcagccacgcggtgagaggccgccaggcggccacgccggggcgagggccaggggccagatcggcccaccggggcaagggtacctgggccgttgaggacccggctcagcgcggccacgtgaggtgggggagggggctattcggtgagagggcatgatggggggggttggcggacggccggggggaggggaggcggcgtggctccggcctggcgcagtctctgaggagggggcggccgcggcaccggaagtgccccccacgggaggctgccctcggggtcgcaggccgcatggccaagcgtggaccggggccgcatggcagcgcggggacccctccccccaggtcccggccaccggaagcccggaacggccacatggtcggcaggagccggcagcccctagcgcggggagctagtcctcgcgggggttccgagggggcctgagattttgaggagtggaagccggaggctcgggtcctaatcaccccggagggcctgctgcaggcatatgttagcgcttcccaacctcaagggccccaggagctttcctgaaaaaccctcctgtgaagtgtggcggtcagccaggtgtaagtggcaccccttcgagctgggaggccggagaaatggggaaacagggcgtttggacaggagcccaacttttctgtcggcctgggtggacagcgcctaaaagcctcaggcagatgagtttcccaccgtgataggcgttcttcaccttgtcactgtcttcctgttgtaactggtttgggagttccacggtttcgaagtccttaactctactagcctagtatgattttctactactcactactaccaaccttttgctttcattttattgtcattcaccaccccccacctctcccactttctactgactgtactggcccggcctgaaaagccgacaggacagatgcatcctgggaaaagtgggagggccttccaggagaggctgggttcctgggttctctttgggaaccaagatcgaggtgtttggcagggggatcatttcggaaacaactttgctttctcccccttggcttgttgcaagtgcatgttggcgaggcgggaatcccccaaagaggccttgtggtttcctgtagcagtgactggtttgtgtgtggatgggggggggcagtgtaannnnnnnnnnnnnnnnnnnntttcagtggcaagtaacacctgagtcctccccactcccaggaagtaggccttttctcatctctgagatttgacattccagctccctagagccttcctttcccaagccaccactttagctttgatttatgggggagaaaccagctattccaccctcccatacacacaccagttcttgagtatatttgagcccagtcagtattttaagttcaggaactttgactttattttaggtgggtaatggaataaagagttgggaaaatgtttctggagagaaatgggatagattggaggtcctgttgacctccatgcttattcacttcagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggttagaatttcacctccgcatcttgccttccccatgcctccagtatctttggcgctcccagcagcaagctgccaacagtgctgactttcctttaactctgcttttactgtctgattgtttttgtttagcgctcagccttcatacccattcagacaactacacctgctccccagtcttcagcctcttctgtggttacccttctgtccccgcatcattctctggcagtccctccgtttctccagctttgtgccaatctcttcaattcataggcctttatgctctagctattcagttgctccttccttattcttggttttcactttttctttcttcccttgagccgttgttaagtggttgcttccatcacgttgcccagggtttctccaattctacgccttcccctggagggactcctgcgtcaattctgagctttcaggtcaccttgctgcttcgttccccagttctagctttccctttggaactctgacgcaggatcaaactgcccctacctgccccatcccactctccttgggttccttgagcctccatgctttcatgggttttaacattcttgatagcacttccctcatcacctcagacttttcctgtctctttagaatttcaacctgattcgttcttgttgaatttcttgtggtgtttttccttaatcagtttttccatcttttgacttgacattgatcttggattattctctggtgtctggatccctctctgtgctcttctggcttccttattttctagctacatagttgtttctgatctccctgcaagtccttttcttcagctctttcacatttcttagtttcttatcctttcccttctaccttccttattccccagtttctcagctccttctcctggtgtccggaaaactcttcgaaacttttactcagactcctcccactcccctagactcttagcatcttatcttttatcaaggtaactgtcttctccaagcctgccatgcagttttctattgtgctgtcaaccccaatctcaacggtggttttttagcctctgttttttttctttaagaggctttactgtttcttgagttgactggttcaattccaacactccagtctttgccccaacaatgtaattctgacttccctcatcaggcaaggtcaatttgagcctttatttcctccgttttagagtttggttgggtttctctttgtgatgcatacatacaggtccatctggttggtattgacatctttactgggaagaaatatgaagatatctgcccgtcaactcataatatggatgtccccaacatcaaaaggaatgacttccaggtatgtagatggtctggatgaggatgggttagcggtttatggtggagggaggggttgggggatagggactgaccaggagagcttgtgctgggagagaggagggaaatggcaggagagggtgtttggtattagtttgctatcagtccagtttgtctatcagagcctttactgtcatgtcagcctccctgggcctactaccttcagcctccttccctatctgcccccagctgattggcatccaggatgggtacctatcactgctccaggacagcggggaggtacgagaggaccttcgtctccctgagggagaccttggcaaggagattgagcagaagtacgactgtggagaagagatcctggtatggtgcctccctccctgcttttgtgctcagctttgttctgtacgtttcttcctgagctcagacatctcttggctatccctcttgcttctccagatcacggtgctgtctgccatgacagaggaggcagctgttgcaatcaaggccatggcaaaataactggctcccaggtgagtgtgacaaatccctcactgtccccttcacattttgttgtcctcagcagagctgctgtagtcttaattgtttcaggcttactttctgcccctagcctggctctgtcctccctatccttcctgttgaaggtattatcctgtcttactaatttctctctcctacctagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaactcagctgcttatttgaattaaatgggtgtatttggaagccacaaaaagactgaactctgccactgagttcactggaacccgctgtctatcactttgacttgctgtggacctgccagccatccccccaccctccaagcaaccttgacctattccagacagttgggtgggaggcaacacaaacagcagcagccaggggcagtggcaggtagattttattggcctgggacacacaggggataccctcacccacgatggggtggggggtgtggtgttgaagatataatctgatggtcacttgtggtagaatcgcgggttctggctgtgttggatgaaggggagccgagggccaggttggctggtagctgcaaagcccgactggtggtggtgatgaaaagagggctttgtcactgggcatactctcccttccacttaataccctactgataaccacccccaaagaggaaggaaaaaccagatgatgtgggccacctgtcctacctaatcctgcttttccggatccctagtgtagggattctgacaggtaaattctattaccattcttacctttcctgctggctgcatctgcacagggagctggggggaagcaaggagtccaggggctggatgcagagcctgggggtgcatggggcgcagagaggactgcagagaacagagtcagggcctgaggcatactgaagctccccttaacatatccctaaccctgacctcccaaggtgccatactcactgagtcggagaagccagtctgctggttagcatgttccatctgcttttgcaaggacagggcaccaccaggctggaggaaacctaggtggggaagaggggcatgtgagatgagaatgaaacagggaggggaggacctgagagctagagctcctgcatgggatgttatcacctgtctgagtgggctgaaagtggccatgcacagcatagggctgtggctgtggctgagataggtactgcactgcagggaatgccgaaggagctgagaaaggaaaagacagagccattaaaatcttttactgaatggcattcctcctttgaccttgaggaaggccaagccccatccctcctattactcacctctgagctgctgactaggactataagctggctgtgtgggcccatagtgaggtgggggctgagcagtcccataggcaccaccaggactgccttggaattgtccatgctctggtgtccctgcaaaagcagctgctgagcccacgtagtgccgggtctaaggaaggagaatgagaactcgcctacaaactccttgaaagctgaaacccagtgacttgtgtgtatctgtatgccccgtttccccctaaacttaagtgcttgatatgtttgtgacttgaatactggtggcaagga

SEQ ID NO: 12024 - DNA, 13248 bp, Human
tacaagacagggttgtggcctagctttgctgcaccaaaagaacacatgaatgtattacagagtagaatatggcacttagggattccttgaagggcagaagcaggaccagagcggggtcacacagcacctctgcagtaaatctggcaaggcttggcaggccagtcctcacagtgtttctagggacactggaaccccgagagtcccccagaggccccattcctagcaactggcaaccaaagcccattattcctgcatgaacccctcctgaccacactggcaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagtaaggaagcctgcagggaggcagtgggaggaggccaagggctgggcaggtaggggaagaggcaagaggggaagctgctgcagaaggaggtgggagaggaaagcatcagacaagcaggacccttaaagagaggagggttaggagtcagggagaggaaaagggacccaaggggcctgggaccagctgagaaagacttaggaggccagaagagtaagtgaaaagaattggggtggcaggcagaggagttggtggggggtggggcagccatacctgacacagagtgaagtcggctaggaaaggacaggtgtgggtgcatggtaggggctgcaggggaaagttggtggtgtatgcagctggacctaggagagaagcaggagaggaagatccagcacaaaaaatctgaagctaaaaacaggacacagagatgggggaagaaaagagggcagagtgaggcaaaaagagactgaagagatgagggtggccgccaggcactttagataggggagaggctttatttacctctgtttgttttttttttttttttttttttttttttgcgaggtagtcttgcttagtctccaggctggagtgcagtggcacaatctcagctcactgcaacttccacctcctgggttcaagcaattctcctgcctcagcctcccgagtagctgggactacaggcgcatgcaaccgcgcctggctaatttttgtatttttagtagaaacggggtttcaccacgttagccaggatggtctggatctcctgacctcgtgatctgcccgcctccgccttccaaagtgctgggattacaggggtgagccacagcgcctggtccctatttacttctgtcttctacctccaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgaccgggtttgtgagacattgaggctgtcttgggcttcactggcagtgtgggccttcgtacccgggctacaggggtgcggctctgcctgttactgtcgagtgggtcgggccgtgggtatgagcgcttgtgtgcgctggggccaggtcgtgggtgcccccacccttcccccatcctcctcccttccccactccaccctcgtcggtcccccacccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgaggtgaagcccccgccaggcccagagcccctgtggccccctcccttcgccgcggcgcccctgcctcctttacccggtgccgctgcgcacctctccgcatctctggcccggtgcagctgcgcacctgctccgccgcccgcgcccagggcgccttccctccctggccttccccgcccgctgccttcgctttctggccctctgcgcgcctatctctaactgcgcctctccacccttgcctgcctctctcccggtgctcgccctcatctacggttctatttgtttctaagttgggagcctctccgggcggtgcatttttatcctagagcgtcccttttggtttgcatttggggaaatgtcttctctcaccgttcctcacctcccccagacttcccttggactcccctctctcctgctcttccccacggcgcccctctccgttcgcgcttcctcccctctgctgcacgggggagagatggaagaagtggggatctgtcgaggcgcagaggggaggacaggcccagctcgcctccactccccaccggctcttatcctcttcacttcccgctgcaacccccagggactgcagggcctttctcaggaccctcttccccgacacctgtattgcatgcgcctttcgcgggaagaggagggatacacgtttgggagagagtgggaccttggggaaggggcagtgttcaggcagctggggtgttaagttggggaggtatgggggctctggaagagaggcccaggcagcccatcctcttcttggctcccaggagaaatgcaagcctggcagccattccgctctgaggagatctgggggaaccccaccggctggccaagctgcaaagaggcgcgggaaccactgtcgtgcccctcccctcctcactgcagtgttctcccatctcatcatttgatcttaccccgccccccactgcagtgacctccccttcctcactgcattgaccttctcctcttcccaggggggagggggaatcccttctacagccctagactgcagccagcgcctccctacccaccccccacccactgcagtaacctctttcccatccctcccagcctcccgccccgcccattgatctcaggctccacccctctaagcctcttatctttctccttccttcccttccacccgaggagatcccagccatcatgtccatagagaagatctgggcccgggagatcctggactcccgcgggaaccccacagtggaggtggatctctatactgccaaaggtaatgggtgtggcatgggccttcctacagccctagcttttccacggccaggctgggttcggccaggggttcggaggccttttttgatacccaggggtatggggtgctgggccaggctcacaagcctgggttgtggcggttggatcctccttgtccggggagccagggtaggtgggtctgtgttcgagtttagcgtgtgaggcatgtcctgcctccgtgtgtctgcctgtgcacttgcatgtgtgcagacgtgtgctgcaagcaattttctttctgcgggctcccacttgtgcatgtggggcctcagatgggtggatgaggaggccacttcttgtgcatctgcctcagtgtgtgtgtggggtgggggtggggggatgttagggagcagtgtggggagagagctagatgtggtaggcaggcagtttagagccagaaggctgaaggactccctggcccctgtgtcctcttcactccctctcattccatgttcctcctttaggtcttttccgggctgcagtgcccagtggagcctctacgggcatctatgaggccctggagctgagggatggagacaaacagcgttacttaggcaaaggtgaggtcccttctcttttccagactctcccccacctcagccttatgcccctacctcacaccagtccccagtcctcctctagcatggcttcccctcctcccattgatcccttccggcccctcctggcccgacccagtccagcctcttcctttccccaggtgtcctgaaggcagtggaccacatcaactccaccatcgcgccagccctcatcagctcagtgaggcctgctctttgctggggatagcagggccagagttctggaaggaatcccggagcagggcaggaggaagggaagaaagaaggcccactcttaggaatcatggttacaagggggaagggtggggaacagcttccttaatgcaccctgctcccatgggagttcaggtcccctaatccaggtaggcccctgtcacagggacctggttggaccctggccaaatgtgagcttgggtgtgaatgaggggaccctctgccttagggctcagcctccagcctggccctgggtgatggaggctctgccctcagggtctctctgtggtggagcaagagaaactggacaacctgatgctggagttggatgggactgagaacaaatgtgagccggggccgggagaaagtggggaagcgtcagggtggggaggcgtggagcagatagagagctgaagggccagtgctgtagtggcttcctcaggaatgactgtcaggggcattctcctctcaaagccagagcaaggggagatgagtttagctgcagagggaaggaccgacagtaggcagaaggaagaccttctttgcagcatacagaggagggggatggcctgagagagtctgtggtctcagggatatttagaaagaggtgtggctctctgccgtttccaatctcctcctccccacccattcctctccctgctgttttcaagagagcatggatgaggtgttgctggggcaggggtggggagggaggagggggtctcctttactggctccttttggagactacagatggaggcaggagctagaaaggagaaggggacattgtgctcagcaccttcctctataatctcctagccaagtttggggccaatgccatcctgggtgtgtctctggccgtgtgtaaggcaggggcagctgagcgggaactgcccctgtatcgccacattgctcagctggccgggaactcagacctcatcctgcctgtgccggtgagcaataagccaggcctgcggctctcccaggggcgggtgggggagggagcatgcaactcatgaggaatgatgggaggaaagtgaattgagggaggtaaagaggaaggatggggacgtgagacttagtccggaaagctgggggaagtttgggatcttgggttaacactcctggggcgggcagggaggggctctttgacccttctgtctttctgtggctccccaggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaaggtgaggccaggagccccactcccagctctaagtcttaccctattgtgggacatcagaaagggtgacacagttcaccaagtcctgagtaggcgtggagggtcctaggactctgcaaactccaaaaggtaccagttcttagagtggattgcagagagcctgccaaattcacatgcagacctagggggacagtatttttttttttttttgagacggagtcttgctctgtcacccaggctggagtgcagtggctcgatctcagctcactgcaagctccgcctcccgggttcacgccattctcctgcctcagcctcccgagtagctgggactacaggcgcccgccaccacgcccggctaattttttgtattttttagtagagacagggtttcactgtggtctcgaactcctgaccttgtgatcggcccgcctcggcctcccaaagtgctgggattacaagcgtgagccaccacgcctggccaggggacagtcttttacctgcctagccagatgtgttagcatctgttaagttgccactggaaggccgggcgcggtggctcacacctgtaatcccagcactttgggaggctgaggcgggtggatcacctgaggtcaggagtttgagaccagcctggccaacaaggtgaaaccccgtctctactaaaaatacaaaaattagccgggcatggtggcgtgtgcctgtaatcacagatactagcggggctgaggcaggaggatcgcttgtacccgggaggcggaggttgtggtgagccgagatcatgccactgcactccagcctgggcaacagagcgagactccgtctcaaaaaaaaaaaaaaaaaaaaaagttgtcactggagcccttgggaatactgggagatggtctggatgacctgttggattcatcccatccattcgaaatctgtcctgtccccgtcccaacctcctaggcctctagaatccctaatttttctgtgccttgggggaaactgtatagggaatggaaagaatataggtagtggttaagagttaaggttctggggccaaataacctggatttatttgaaccttgacttgtggagttactgctggtgaactttcttacttctctctggaaataataacagaatctagctcatggtagtgtgaggcttaaatgaaatatatataaaatgcttagatgacatgataccaatgaaagtatagtaagtattattaagagaattccattcctctgtgttcctagaagatggcctctcctcccagacctggggataaccccaacagcatccccgccacacttccctcaggaacagccctccacctctgccctgaatgtcttttctttccctcctcctccttgcccatccctcctgcttgtactataatctcactgtattctgtccccagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctggtgagaggaagtggtgtgagggggaggtctgggggcaggcagggacgtgtcccagcaactctggaccttatggggtgctgactcaggcaccaggtgggggtgtcctaagaagaacctgagaaccagggagagggtgcaggagccacctgcaaagactgggctttgtatgtagtgtaaaaatgcaggtacccgtgaccaatctgttctgtctcagatcctgattaaagtcatgggttctgaaaactactggggtcatggggaaggctctggaaggaaccagggatgatatgagtgtgactggatctagcagagaactagaacatttcagtatctttgattgatgaaattgtggatgctgaatggagctgggactgatgtgtgagtagaaagaaggctgagggggactgaattagcttctgcaagtctgcccagggcctttatctcaggatggaggcagttggtcgccatcttcctgacacagagcgaaagaaaatcaacataattgcagaattaaggatttggattagcaatgaggaagggcttgctggcagtgagaacaggaaaatgcaaagctaggttgtgaacccttgttactggaagattttttttggggggggggtggggttgttttttttgttttgttttttttttttgagacagagtttgactcttcttgcccaggctggagtgcaatggcgccatctcggctcaccacaacctccacctcccggattcaagcgattcttctgcctcagcctcccgaatagctgggattacaggcatgtgccaccatgcctggctaattttgtatttttagtagagacaggggtttctccatgttggtcaggctggtctccaactcctgacctcaggtaatctatccaccttggtctcccaaagtgctgggattacaggcgtgagccaccacgcctggctggtttgcttttaattaactttttttttttttttttttttttgtagagacagggtttagccatgttgctcatggctggtctcaaactactgggctcaagtgatctgcatgcctcggcctcccaaagtgctgggattacaggcatgagccactgtgcccagcctatggaagtggcgtgagatctctgctcactgcacgattctcttagcctcccaagtagctgggattacaggcgtgcaccaccatgcctggctaatttttgtatttttagtagagatggggttttactatgttagccagggaactcctatcctcaagtgatccgttcacctcagtatcccaaagtgctgggattacaggcatgagccactgtgcctggcctctccatgtaaggttttatgaaataagaatcaggagccaggcgtggtggctcatgcctgtaatcccattactttgggaagccgaggcaggaggactgcttgaatccaggagttcgagactggcctggcaatacagtgagacctcatctctacaaaaattttaaaaattagctgagtgtggtgccacacacctaaagtccctgctactcaggaggctgaggtggcaggatcacttgattggggaggtggaggttgcagtgagctgagattgtgccactgcactccagcctggatgacagaatgaggctctgtcaaaaaaaaaaaaaaagttaagaatcagttagggcaggcttacactggggggatttgtcttagcaaggatgagcaggtgtagttaaccaagggcctgtccatttcagggaataaaggggcatgttcctgcctgatgtagagacccagggaagatgaacacctcccccctccccaccatgctctctctgcagtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgagtgacttctggccctctcctgtgtggtcctcgtttctataagactccttttgcaagtgctccagcctaattctacccaggggtgccaaagagagcggggaacctggaatcatcctcacagttctctcacctctgcccctccacccctgattctctgctcccctcccagatagctttcccctagatgtttcctgacatagaccaaggttggggctgggaagagagtgcccagtgtgagagctggagaatcagtgctgtgtgtggatacaggtgcaagctggcccaggagaatggctggggggtcatggtgagtcatcgctcaggagagactgaggacacattcattgctgacctggtggtggggctgtgcacaggccaggtgagtgaggcagcctggtgagtgaagagaactctctgtgggattggtatttctagctcacccacctggtctctccttccaggtgtttgagggtgtcaggggagtttcaggagagcagaagtttcctttcaggggtgagagggcagtcactgagctgcaaatcctttgaaatgtttcagatcaagactggtgccccgtgccgttctgaacgtctggctaaatacaaccagctcatgaggtgagggtccctggggtgggagcccctggcccagatggctaaaggccccatttgcctgccagaccatctgtagcaccaagggcctggataacagtccatttcctggataacagtccaacagataatattggtttttgcttcctgggtttattgatggcctgattgacaaatcccagagatcacatgggaaagccagggaatgctaagccttggggcaggacacaaaagcaggtggtgtgggggtggttggagtctgggggacccctagagagagaagcaggatcctcctgcatccctgaccacttcctttgtggttcatctctctcagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgcactgttgtgtctaaggagtcttactctagtccctatgaggggagagaagatggagcacctggaagctggtgaaactggatagcagagctgggggggcacaaaaagaggaagacaaactgaacaaatatggccgagatgatggcactgcctaccccattctggctaggtggggtgcatgtggcccctgctttcttagcagaaggcttggctcccagacgcaggtgaattaaggggttcaagagcccctaaaagcataaaatattttgtgtgtgtgtgtgtgtgcacgcgcattttgggggaaagggggtctaaggtgttttcatatccaaagggcttgtggactggagcagctcctgtactgggcctctgccaacaaaaccctggctggttctcgaatggaacaggacttcatggccatcacccactgcaagatggggaaatgggaaggaagaatggttccgggggtagtatacggaaggacctaaggaaacagagtcctcaataaactgaagattcaggaacaaaagtgcttaacagaaccctggctgggtcagactaacagtaggtttccaatatgtggctagagacgtactactccttagctataactcgttaactcttatggggcctcagcgttgagatgctcattctaggtacccccgagggggacaaatcccttcctagtggctcggatgcaaggttgcgtcccacagatagggtttgcacatgggagatctaaccactagagggagtcagagttttgcaggacgccatactggacgccaagtgggaggaacttcaaggctgtcccctgcgggcctcccgctctgcttctgcgaaggtctggtcctggctccctctgccatcctgcccagctccaaggctaaaataggttctagttctgtatgggtagggcccatttcttttcttgccctccttcccgggtccctgacacctcagccattttcagttcaaagagcctcatgccccctttccatttctgtgccttttagtttcagtgtgggcatctcatctttcccttttctcctggcgaccctttatgcctcccttggggtttcctgtactttcctctgtgcctctcagttttctctggggtccctgatacccatcttaccttagtaactcccagactgaccaggactatcctagtttgagcctagttcctagcctctgtcctttctttcatccctcctcaccaggtcgccttctctgacagtctggccccccaacccccaaagtatcggggttggattgggttacagctagctctgcctgggcctcccaggcccttctctccactttccctttgtgccgttgcctggagaccaatgggttgtggggggctgagccagagagggagctggggtgagggatggctggggctgtgtgtgtgcgtgtgcgtgtgtgtgtgtgtgtgtgtgtgtgtgtgagagagagagagagagatgtcccctgcagctggactataagcctggccctcaggtaggggaggaatgggagagggtagacaatggtttcttttgtgactctcaccatcccctatccccacatatgcctaaatttttcttttagtatccattgtagcccattccttagtgattaaaaaacaagggagaagagctcagcctggaagggatttggaaagggcttgagccaaggcccagtgggagactgaactgagtggtacagaaagagaggaaatgccatggggagagagggtgagagggaaagggggagccctggaacaaagtcaggggtggggaggagcagcagctaccctagagcaagaggaagggagtcggggtgcacagggagacagggagctggcctggtctcagggaggccctgggaggaaggtgtgcttggagtggtaaagtgagtgccaaccaattcaagggacttcagagtgatgactcattcccaggccaaggaagtgttcctgttcctgcgcccagttccccagtgctctggaatcttg

SEQ ID NO: 12025 - DNA, 89268 bp, Human
aaacttaaacatactgtgatctcaagaagtttaggattgcttcagaatgtaaaattaatcaatacaagatgggcctacaatttagaaaaacatatccctttttcctttaattctttttctgttactactattttgtgagaaaaacagcagaaatgttacagagtaaaatggacccgtttgcttttaaagttttgttttttgtttgtttgtttagtttgtaatttagaaccgtttgaaacaacgtttctcagagtgtgctctgtggaacagagggccctcaaaaggtacctcaccagaaaaagctgtcttgtcaactaaatggggaaagtactccgtcgtgtttcctctctgggaggctcacaatgtgtgtcaccatctggaggctctgcaagaatggagagtagtaaaagaagatttttcactttaacccagcattgtttgcttggcaagtagatctgttaatatccatggattgtatgctggggaaataccaagtttttcatagttacttaacccttgaatatttatcctcctcagagcatggaagcaagcagtagaatgcgatcgttgatatatggactttaattttttaaattttatttatttatttatttattttgagatggagtcttgctctgtcacacaggctggagtacaatggcacggtctctgctcactgcaacctccgcctcccagcttcaagcaattctcctgcctcagcctcctgagtagctgggattacagatgtgttccaccacgcctggctaatttttgtatctttaggagagacagggtttcaccacgttggccaggctggtctcaaactcccgaccgcaggtgatccacctgcctcagcctcccaaagtgttgagattacaggcgtgaaccaccacacctggccagatatatggactttagactcagacaacgtgggttcaaaccccagttctgctatttgccaggtgtgtgaccttgagcaatagcttaacctctctaaatgtcagtccatagctaagctgccagtaaatatgaagttcattgcgatttttcttcctgagcttgtcattcagaaacaaaatgatagatttgcatggatgatggatttcccaacaggtcaattttcacatctggaatctactttaaacgtgctctaccacatcaaagtctaaggaagtcaatctcacttggaggcacactgcagagacaagtaggccttcttccttgtccctctgtcctttcagacttctccccctcttgttccctctctcttcttaagctttccagctccactactgctttggctaatttctttgggttccccctctctcattcacccagcaccagctgaactgatttaggtttacctggctatgctttccaaatctaattcgacaaatatttactgagtacctaggtggtccttgaatcaccctgagcacccaattccaggatatgacttcttcaaaggacagaattggaatgtttacataatatgagggaaaaaaaataaaagaaaacacttagcttctttagcaagctatctgataaaatagctgaaattcaagaagccctttagttaggagggagagattgcgaacacaacaggaagaagccccaggctgagtggcaaaggttgagattttctatcgtaagcacacctcacccaaacgcttgctccctgaaagctgctgacggagctttggcgagggctcatcctcccgttggctgataagcgaagccctgttttatatttaactcgctgcagtgcaggaggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagtaaatattaatttttgctttacctcccttaagctcacatatctgctttccatttcttttcctttccttttcactttccgcttttaattattttgttggtctgatattgatcggctcttggtttcaattctggctgtccatctgggaagccaaaattgttgccctattgtatttccaaaccctgtcataaaacttgaaagtagtgaatgagcttcgtagagtcaaaagtcagtgtaagtcttttattccatcaggagaaatcataatatactgcaccctatcttgaagatttccataaattatctcaggtttgagaactgcctttggtaaatttcactagtgatattcccaggctatgtagcaatatatatacagcaatatatatgaacttttaaagtggtattacactaaatttacgtgaaacatcagtaaatttcagttattattttgtccattttttttttgtccaatgtctcttttttggagaagagagacattgaaaaatcacatgtgatccacagaattgtctttgtgtcttcatctggaaaggaagacaggactgtgtttttttctgtctccgatggccaggaccatgctttacacataggctttcaggaaatattcattgagtccacacatcagtggcataggtaaatttggaggcttgttgctcatgatacaatgtgcaaacataatgctaagccttttacaacataaaagatatattaagtagttaaatacatacaaatatttgtatacaaatatctatctagatagataggtatttattccactttcccacctatttgtctagcctttgtattgatcagtggctactaccagagctatgttaaaggcataaactctctcattgaactccaaaaacttccttcacactgtggatatagcccttgcatcagggaggaaggctacactacaccttgtgttgtgtctggactgctttgacctttgctggcttagattctgaagaggtaaatgattaagaaagcttcttgtcacagtttagagatgtgagtcttgggccagtccacccacaaatatccctttttttctgttgttttaagcatcttacagagcaagcaaattttttggtcaaaattctttctattgtttgtcagacagacccacggactaaaacaaaacatttaaatattcctatattcctgtgtggtaaactgataaattgagtagaagtgatagtttgaagaaaatatctgtaggggtcatgcttatatagatcttatatcttaatactgctagcaaaaaaacactcttaccatttacgtattttttctgttcataagaattacatcattgaaagcataaaaattatcaaaaaggataatcaaaataatctgtaagtaatttcactgcccagtggtaatccctgctagcatattaatgtatattctaatgtttttctaggcaatcaaacctttaattgcattatatctgtctatctatatgccttttttacttaatgtcttgagaagttccccttattcttacatgttttcaagaatctgttttttgttctttattgagacagggtcttgctatgttgcccaggctggtcttgaactcctggactcaagcaatcctcctgccaccacttcccaaagtgctgggattataggcatgagccactgcacacagccaagaatctgattttaaagatgtgaaatattccattgtttgaatacattgtaattttttaaaacaaattatattgttgagcatttgagttgtttctagtattttattattataaacaaatcatcaaataacatacttctaaatacctctttgtatgtgcatctgtttatttccttaggttaggatatagtcctaaaaatagaattgctgggtcaaagtgtacaaatataccaagatattgtaatagttactttgtttattgataacataaataatacacgtttattgaaggaaactcagaaaacagagaaaattataggaaaacataaattcatccataaattctttacccaagtatagccattgttaacatttaggcagagactcttttagtacttttctggacatagatagctgtggcataattatattatacatagtaatgtgtaacatgcttttccaatatagcatcaatgctttaagatgtcatttgatgttcttccacaaatgattcgatggatacatggtaggccattgtatgactacaatgtagttgattcacttttccattaaatatgagtatttaagttgctcctattttttcacctataaggatctagaagaaggcgcatccttatattgactatccttgtaaataactatttatggacattttctaatatttaagaaaattcctagaagatgggccaaaactacctgtgtataaatgcatgtatgtctgtgtatatatgtgtacatgcatatacatatatatgcatgaacatgtgtatgcatgtgtgtgtgtctccaaactgacttccaaaaaatatgtcccaaactccatttccaccaacaatgtatgaaagcgactattcctctgagccttactaacaatacaatgattttttaaaagtgtttgccaatggtcgagggaagggcaatattctgaagaatatccaccttaaagagattctaaaaattcattgaagtgaaagcgagtcaagactttttaaatattattgctaaaactttaaaactgcttcttagatcataaagacaagagaaattttatctgaataaaaccatcaaaatatttataaaataataaaataaaattttacacatattaggaaggccaaaaattggaactatgtagtctccattaataagtttctattatgtactttataagtctaaaaaaagcattatatacacaaatactctcactctttgagttattttagtgtaccagttaattttgccataaaatatataccagagagctgcccttctgaagctcagttgacttaacttttgattggagattacgaaatgatggcaacatcggtgaggaaggctgatgctcagttcagttctcactgaggattggtgttcccaagtttgtatgtttcattgggagcagttgaagctctcacattacaaaagatgctgccagttctgtactgcacacacatggttttggaacagatctggcgtcagctcaataacctcatttaggctaaatggaatactttttgttatccttgtctgaaatatttcaagcatatgagaaaagtgcatcatgcttttttttctagcctgtgagtaatattttggcaatgcagcctctaggagttctcatccacaggctccatataagggccaccagagggagttcactgggggcagtgcctttctttcatactatagagtgagcttcgtcatatgtgacgtttgtatcattttaaacgtcatcatagtaatacatttgaagtacggagtcaaaattatattttctgaccttaacgtaaaatgtaactccaggattgagtattagtagttagggatattaatgtgacaaccacaatgcaaactaaacaggattgcactcagtagtaaccaaaattacttaatttctgcaaatacaatcaggactttgagcttcacaaacttcacagctacccaagttgctttctctcaagattgagacatggggaagaaaggggacaaaatttagaattccacattgtctttctggggacagagttgtagtggggcgtggaaggagaaagtttgagaaacatccagtcgcttttcctttatcgatctacctcttcctactcgctagtctattcttcagggtctgaggaaaaccacttggaaggattggaacctttggaatgtttctctgaccacaccctccttcttcccattttctcaccgtgttacgtaggatttccagctgttcccttccctaaaagagtttccctctactcaaactccaaagtatatattttcttctctccaagatttggcttttccttgtcagcatttggattatgcttacttagcacttcccaaagtatgtactgcagaattctagttgcatggggatcttagtagatattaccagaaaaatagcaggggagagattctgtggctaaatcagtttgtgcaataatactaaatacaaaatgatctgttttggattttgtttttaattatggaacttttcagagacttttttttttttaaagagatgagatccaggctggggtagaactcctggcttgaactcatgagttcatgagttcaagtgatcctcccacctcagctttccgagtagctgggattacagggttttcagaggcttttatatgataatgtcctctatgtagtttcccaactctctgtgactatggattcttctgtggggttcctaagagtagggatatatgtctttcctttactgtttggcacacagtgagcactcaaatattctcaaatggaataaatgaaaatattatcatataagctctcacatgactagtatcctctggcaaatgctgggacacattgcattaccacagcttctctcccataaacgagcctaacttccaccaataacatctctacattcccacttagggtgaaaattttcccttggttccttttctgcctaccctgtggaagggaagagtttatatgtgtatgtatatatatttgtacttaggaatgcaatctccgtagtttaaaggcagagaaacagtggaattgacaggaagtacaaccggaattttagagatcatttctagtttgggctgccaaggtgttcttcgtagcgctagtaggatttaagctgaattttgatgttctggtgggagttcagcagcagagacaagtgagaaactaaaagcaggcaaaaaggaaaggcaccaagtcagaaaagcagagtggggacaagaaaattagtttgtaggggaagtttatatgaacaggctagctagatatcactgaggaaaacccttacggaggaaaaggaaaaatagccatgataggcattatgaaggagaaattaccccatgactttttggatacagatggcaaaagaaagagttaactcaaccatccacttggatatatgaaagatattgcagcaatccaggaaagagaagataaggatcagataggaaacgtgatttcaggatagagaagagagggcacagtagagaaaatagtttggaggtaaagtagtcaagatttgacgattgcttgactatgaggaagggtgagttaaagttatgggtctaggataccccagctagccttcacctcaattgatattggaaataggtgggaagtagccaggttagaagggaaggtcgtaagttcagtgtcagatgtgttgatggcttgtcagacatctaggaagagatgactagtaggcacttgcataagtatgtctgaagcacaaggttagagcttgtaataaagatttaggagttgagtggaaacatcggtgagataatcatcattaagtgtgtgtgtgtaatgtattcttacctgcatggatgtgtatgtatactcaagcacatgtagttttgatcttgaaatttttgtcgtatgtcagtttgttcattatattcttagattagtatgctgagctattatcccattgtcaataaaaatgtcaataaagaatagattttaggttgggcgaggtggctcatgcctgtaatcccagcattttggaaggctgaggtgggcggatcacctgaggtcaggagttcgagagcagcctggctaacatggtgaaaccccgcctctactaaaaatacaaaaattagccgggggtagtggcacatgcctgtaatcccagctactctggaggctgaggcaggagaattgcttgaacccaggaggcggaggttgtagtgagtcaagatcgcgccactgcactctagcctgggtgacagagtgagactccatctcaaacaaacaaaaaaagaatacattttctttttggtcttgtttacttgttgcaggaggctaagtaaatttcttttattttggaagcaagaaaacaaaaagaaattttacttgaccttgaatatcttctacatagaaaaaaaaaattggaaaataaagttaaataactaactggttcattcaaaccaccataaaaatacatagaggtctgaacaatctagaggggttgtttttcaccaagctgctcctctatgtaattctggaaccctttatttagtctatatagacccctagcaattgtgactacctgtcccgaatcagaagctctgtgtttaaggatttcacccaaaacttgctgtttattttgctggttcaacttataaaattgctcagcacagccagagagtcttcactggaaacagcatgccagatgatttatgagataattaggtaccttttttggttttttttttagagtcaattcagagtgatccaagccataacttgtgccatcgccccttctccctcagttttcttaaagtcaccttgatctgatccactcagagatgccagagaaatgctcttcccttttggaaacgactaaattgcatagactatcattttattgtgctaggtctagtaagtgacttattaatgtggcatagggaggcccttgtgggaaggtggtttactccaacacatttgcctggcgcgataattattcaggacgtacccacaagtcactcctgaacatattgtgctattagtcagcctttttctcttaatttgcaagacaagtcatctgattttaatcactgaataaaatcttcccaaagaagttgtgatctagaattgttttgtattgttatctcttattccttgttttcaactttgcacacacttagaaaagtttagggccaactgatggaatttaggatatataaaaaggagcttttgagttattctgaagttcatgagaaaaagaacaggttaccattttaaaaatgcttacattgcctatagtgtatatacaccaagtaattttgttccagtatatattgcagtcaaatgaaaggatttgaaatatttcagattgtgaaagtgctatgtcagaaagcactagcattctagatttataagatgtagaatgaggtatatcctaaccacattatgtaaattttaagggagtttcaaatgtattactacatgtaatctacgccttctcacttccccataacgctgtgaggaggctatacatgctctggtgaccaggttttacagatgaggacactaaaagtctggggttttgtgacttggtcaagatcacactttagtagctgaagtggattagaatgtaagaatgtttgctcttagaaaagggttttccccataaaatcatattggctctgaactttaaaaaagaaaaagaaaataaacattatatagctcttcgggttgatgaatgtcactgtatctatatctgggtcactgtgattgagttagacttgctgtgactgacatttgctgagaggaccactgagctgggccaaacacaccgcacagagaaatctcccacactgttctgttccatgtccgttggcaagctcaggaatacgctagtttaggaaggtagtttttgcctacaatcaagcagaatgtcttttaaagagagaaggtgagaaaaggattgaaaattattttctttcctgggatcttaggaatatatattatatatattatattatattttatatatatattatattatatatatatatatattcatattctggcatccagccaagagtaaaatagagtatttgaaaacataccccatggctatagcttaggaaagtgtaattccacttcctccttcctctcacctcccacacacgaagatgtgtgtggtgcgcgcatgcacgcacgcacactcacacacactcatcttctcaaattagttagctggcctatttctgaggtgtgactcagaggagacattcttgcaaggagtgacttttccttttcccctgcctctggaagacatcagaagtcagaagaattcagaaggaaaaggcagctgactaaacatggggttggagcttggtggatcttataaaactttcaaactctgggaaagtgtacaggcttttttagagtctgatatacttgcaattaactacaatctgcaagatgtttagaaacttcaattgactaaactgttaatgtcacaaaactaatcaatgattgttctattgcagaatgaattcttaactgaggcttttcttgggtaactttattgtgacataatttcagactcataggaaagttataagaacggtactaggaattcctagaaatacttaacctagattcaccaattgtttacgttttagcctgtaccccttccccttcctttccagagcacatggaaacatcctctccctttaccccttaacatcagagcatatttcttaagcacgggggcattctctaaaataaacatagtacagtcatcaaaatcaagaaatttaacattaatacaactatctaattcacagtctgtaatagaattttatcaactaacctaatgatgtctttttgaatgttttttcccccagtgcagtacccagtctggaatgctgcattgcacttagtgtcatgcccttttagactcctttaaactgaaaccagtcccttagtccttctttgtctttctaaagttaatatttttgaagaatacaggctggctattttgagaatgtccctcagttgtagtttgtctgattttcctcatgatttaaaaatgcaagttaagttttttgtttttttttttctgtcaggactatcacagaagtgatgtgtctctctcaggaaatcacattagagacacattgtgctggtttgaactattattactgatgcttcctttgatagcttgcttaaggtagtgtccaccaagcgtctccattgtaaagttacaaggtttctctttaggtaactttcagggagtttttgaaaccttgcaaatatcccttcctcaccaaactttcaccccctggatttggcatccactgatgattttttaaaataattttttccttcaaatattattagtaggcaatctactggaaggaataactttcccttctcacccatttatttattcattttaaaaaatcagagtaaggactcagagattgttaatttgttcaatgagttattatcccgttgtttattgtgatgttccaatactcccataatttgccaaaggcagtcaaatccttggctgtagtaagtccttgaatcaaaataaaatgcacgctcttctcatgatctctgatattttcctgatctggcctctgctgacctcatgtcaaacttatctctggctccagtccgtctggttcagtgttctttagccacactggacacctttcaattcttcaaccacagcaggttctttttcatcttagggactttgcacttacggttccttctacttgaacatgtttccctgaacctccacttgcctggctttttctcattattcagatctcggcaaaccaagagattgtgaccactctacctaatgttgtttaccacttttcctagtcattctctgtctcttccagtgttttattttctatgtagctgtcatcactctcctaagttatttatttatttgtgtgtctcttgtctaacactctgtaagcagtctggaatcttatctatacatgtaactgcccagtgggttcaccttgcccgctgcctagacagagccgatttatcaagatggggggaattgaaatggagaaagagtaattcacacagatccggctgtgcaggagactggaattttattattactcaactttgtctccccgaacatttggggatcagagtttttaagataatttggcgggtaggggcttgggaagtggggagtgctgattggtcaagttggagatggagtcatagagggtcgaagtgagtttttcttgctgttttctgttcctgggtgggatggcagaactggttgagccagatactggtctgggtggtgtcagctgatccatcaagtacggagtctgcaaaatatctcaagcattaatcttaggttttacagtagtaatgttatcccccatgaggaatttgtggaggttgagactcttgcagccagaggctgcatgacccctaaactgtaatttctaatcttgtagctaatttgttagtcctgcaaaggcagactggtccccagggaagaaggaggtcttttcaggaaagtgctattatcaattttgtttcagagtcaaaccataaactgaattccttcccaaaattagttcggcctatgctcaggaatgaacaagtgcagcttaaaggttaaaagcaagatggagtcagttaggtctgacttttttcactgtcataatttcctctgttataattttgcaaaggcggtttcatacagcagctagaaaaatgtctgcaaatgtgtgcatgcatgcataggtgcttgtgtgcgcacgtgtgtgtgtgtggaagggactcaattaatgtttcttggatgaatggatgatataataatttagcctgatattctttatgatatgtctttcttagtttccagaatcctgaaggacaaaatttttgtttgtacaaattattaatgaatggaaattaccatttctttacttttatactttttactttgcttcattttctaataagccaatatacaatattcttttactgtaatatgtttacatgtaaaaagtgtatgctattgatttttttgagcaattactcagaaaataatattttcaccttgaaattatgaaaatactaaacattaacattttagtttacaccagcatatgcctagttagagccataaaaaaaaatgctgctctctctttttaagagtgagctttaaactaggacaaaggttacttcacctaggagattactcagcactgcctttacatgaaaatgaaactgggggttttgtccctgttgtaacataaataacaaagaatgtgccattagggacagggactggggactctggaataacctccactctgtgacagaagacagctgttcacttcccataagggcagttagacacaagcttttaagtttggctttgtgtttatctacttgttgctcaatgggcttggggtggagagagtactagctcataattggatttatttttgctcctccacagagttttagttatggcaccaaaatagctgttaggttgatgcaaaagtaactgtggtttttgacaaataaatatgtgaatgaaatatctgaagcaatctgactcagaattttttaaaaatttgttaagctaaaaattccaggaaaacctttgacaaatatttgatagtcttctagatggaacctcatttttagaaatgtaatagttataattgcatagctgatttttttttcccctaggaatagagacataggggttgtcagaagaggcagcatgcatttcgtttgtttgtttgtttgtttctaaggagcatagtggccaccgatcatgaaccaacagatgccaggaaatcttttccttgttttgatgagcccaacaaaaaggcaacttatacaatatctatcacccatcccaaagaatacggagcactttcaaatatgccagtggcggtaagtattttttaaatgttttgtttatgcagagagtctgttgacaacattaggccagttacctgattttctgtgaaagagaacccattgaattctaaaactaaatgtgcactaatagtttatttagctgagtgaaatacattttggcaatctttttctttgagtcctagaagtctgtaaggtatcacagtccagtaagaaagccagattggtgtttctgtgcaagagacaatgccatagacacacacatcagcttgggctctgcttagctgccaggatccctgagtcgtgacagattacagtaatggcaaactaatggaattacagacttgaaaatatttgagggctactcactatttagttttcaggtgaatataaatccagtttttgttttgtttttttgaaaaagataaagctactatttaaaaaaatcatcacttaaatagtgggttgtggaagcaaactccagggaacactttgcccatagactcctttggtgagtgggaagtgcttgttaaatgtctggagaaaaaaaaaaaacaggctataaaaaaggatgagttcatgtcctttgcatgaacgtggatgaagctggaaaccatcattctcagcaaactaacacaggaacagaaaaccaaacaccacatgttctcactcgtaagtggaaattgaacaacaagaacacatggacacaaggaggggaacatcaacaccaaggcctgtcaaggggtggggggctaggggagcgacagcatttggagaaatacctaacgtagatgacaggttgatgggtgcagcaaaccacagtggcacgtgtatacctatgtaacaaacctgcacattctgcacatgtatcccagaacttaaagtgtaataaacaaataaataaataaataaaattaaaaaaagaaaaaagagaaaaaattttaaaaggctgataatttctgctgtataaattatttgttaacataaaacacttctctctgttattgtgtctcatccctataatggataatgttgttacctagagtttcattgcctcaaagttgaggtttacatactttacacattcgacatgtaaaagggtcagcctcatctttaggtataataatcagaaggacaccagccccaaattatgtctcccatctttctgatccactatttgaaatattgtcattaaaattcatctttttaaatgataaaatattccttgaaaaagcaacaacaaaataaagcaaataaacacttaagaggattaaaatatactcttagcagccatccatgcctcagtgagaattaattatcaatttgttttcttctaaggtttgattggagaagaaagaggaaaggataaacttaaagtatgacacaccaatctagatgaaggtggggggaaaaaatggcaaagtcaccaacttctgcttaagaacttcccttatggccttttcactgtgcagagttacactttaccttctactagatccagatagtagtcctggaagaaggagaatattctgggttcttaggccatcaaaactaacactactaggtttttatggtagagtaatgtagcctggagccccaccacgattatacaagggcatgcacacccgtgcttgaagtgtcagccgcacccattctaatccagcctccctcgcttaatctctttttaaaccatcccaaatagagtggctgcaggagatgtggaaatgtttaataatggaagcaggagttgggcaagtattcgtggttgaagtgttaggattggtgatcgacagtgaggacagcagagctggcatggacagaacaagccagataggtcagtagttgtgtcaagcaatagaatcctcctctctgtccatggagaccgagccactgactttggtgaccatacctttggtgtttgatgtagacaaccaaagacggaaaagagaagccaatgttccgctacaccaggtacagcaattgccctactgccagtcgaatcagcaaatatctgagcacgagtctgtttttcattaggagattgcagtactctgaaatattatggtcagcatgatgtgtttagtgtagacagataaactcctatttaactgatagtccactcaaaattttatttctccctgaaaaacctgatacagtgtgtaattcagtcagtctttaacagttctaaaaacaaagtaaattttcctgtagtcttttcaacatcaccacaaacaatttgacctctaagctttgacaaaggacttctggctagaaagcaaggtttggggcaaccgtttatttgtttgtcttgcatatatatgattgatattttgatcgataaaagtttatcttttcttttcaatagaaagaagagtcagtggatgataaatggactcgaacaacttttgagaagtctgtccccatgagcacgtacctggtgtgctttgctgtacatcaatttgactctgtaaagagaatatcaaatagtggaaaacctgtgagtctcattatattttaaaaatttaccacctatgcatttgtaattaattatctacctttttgggtagtttttttttttttttttcaaacaacatgcctgaaaagccctttagtccccagggtctgtggacttgataatacatagaaaaatgtaggctgaaaggatacaggtaaaaaataaaccaacacaacagacatagatatttatggccttaaattatttcaagggaaacatgtgctgtaagtcaaaagctagctcctaagtataccagcacaaatatattaaaatgtttgggtatgcccaatgtaataaaatgtttgggtatatgtgtacctctcccagatatagactagagagagaggaggaaacctgaggtaaaggaacatccttcgaatgacaaggcactgaaaagtttatggctccattcctatatgtaatcaaaataggtagcaacaaagtatccaaaagcattttttaaaagtatgataaaatataaataagctttttttaaaaatatcaagacgactagttcaatagttttctttctttcttttttttttttttttttttgagacggagtctggctctgtcacccaggctagggtgcagtgacacgatctcagctcactgcaacctccacctcccgggttcaagtgattctcttgcctcagcctcctgagtagctgggactacaggcacccgccaccacgcctggctaatttttgtatttttagtagagacggggtttcaccatattggccagccttgtctctaactcctgacctcaggtgacccactggccttggccccctgaagtgctgggattacaggcatgagccaccgagcctggcccaatcgttttcttttgaagaaccacatacttttacctaattaattttttcattttggaggcccccattttgcttatatcctgaacatatgtttaggttgtctagtaagccagttaattcacctctgtgccatatatgtcatatatataaagcctcatcatctttgcaatataattttataaggaggaaatcatcacccccattttagagatgagaaaaattgaagtttaataaatttaggctatttattcaagattacccagctggcaagtggtagaaacttaaattccaaactccttccagatactgtatcttgcttagccttctgatgtgtgatattctgaaaatatctttacctcttcatcagtcactggaggagaggggatgggttcctctatttctgtgaaatgaacaaagggaaaatttgcctttgctttggtgtggtaggagttgatattcagatgtcctcaacctgggttgccagcatgctgcctataccgtatacaaattatagcgagtgggggatgtccacagaccttttcaaaggggctgcatatcatgaggactcatccgtattctaacttttccttgacacataggttgctttgatgcaaccttcagtcgtggtaaagggaactactagtggctgatagataatactggtatgaaaaggaaatggcatcagaaataggaagttgttttttctagattgtgctgagtgcagtcgatggcattcctcttgcttaatatagaggtgagaacattagtcaagcttggttttttctttccgtctcataacaaacatgcaattttcatctgaagctgctttcttcatcattgacaattcaattgcatgactgtctttcatcatgtgcaggtgtttcccataccaagttttaaaaattattattacattctgagcaaatttttctatttgaggtagaaataccaagaggaaacagaaaggctaagcaattgtactaaagatgacaaagtctcataggtaagaacaatgcatttaaccaatcagcagaggacatagtacttggagttattttctaatagtgacagtgagcttgaatttccaatatgactctatcaccaggtcctctgaccaaggacatttacttgtaatattatactaactaggtaaatcactagagcctgtaccagttagttagctgggttcttaggatggattttatataaaggatttgaagtgatataatgaaaaaatacagttttgcaaaagatcccaaaatgtcctgtaggtggtaattatttcttaaatggttcttctatgaaaactaagagcataacattttgttttaaataagtgatgcattccatcatttgggagggaaacaaacataatattgttttaatacattactgtccaatcatctattttataagagatcaacagaagccaaattcccttttgaaacttctcagaggctctgagccagaaaaattacaagaaaatgagatatgccactttccccttcctccaacccttccatagaagacaggcagccagagtttcccctcctgaaaaaacagtggggccgtttcctttaaaagttgaacagaacctaatgggagaaatttaaggcatctagtgtgaatgcaaatgctccacagtgagttcctcctctttggcatttgggaggttcccctcctggctccctacccacttactgtaagttgaaatctaatagttgacacccacccaagtacaaactgctcctggtatgatttcccactccagagagttacagaaaaaccaacctacttaaatctattgaaatgtaacatcagaggaaactcacaccagcctcagagtcctacattcttagaacttaacagacaagctaagaataaccaggtatatgaggaaaacaagtaacataaaagaaaaacatccaagacaaatagaaacaccgtgggagtaaatagtgataactggagaaacaaaagagaatcccgaaaaagtcataacaaaattaaacatgcacacacacaacctttaattaatgtattcaaaaattcaagaatatgatagtcataaaagaaaaaccaaaaagtgacgagaaaacgatcagaaatagtagtcagagttttagaacgtgatttccaaagcatggcttgggtctgatccccaggaacctgtttccgacccattccttccaaaactggagctcaatatgcttatagcttccgatccttatgtcttgttcccatttttatattttatcactaatttctgagtattaggattagtggggtgcatcaaagcatccctttactgtaccacctgtacccaaagtcctttattacttttttagtaaaaaacaaaaataaaaaatgaagccatgtatttgttatgtacaccattaataggtgactattcttatccattcttcttctgacagtattattctggtacattaaccacctgctattcataatcagattatactatgcaatctaagaatctataatgccctgattcaacttgcttgggtatattcacctctctgacaatagttcctttatatcaataaacacagaatcaatgcctgcattcttaatagtttagttggagagagtacagcagactttagagttgagccattcattatgtttaaaatatccttgtcgctcatgagaaaaattaaattggttttggaggtagctcagaagtcttttcactcttcatattttctttttaaattaattgcattgcattttgattcaatgctaaacagagtaacatgaagagttacttagaatagtttagcaacaattgaagccagccactgatggaaggaattttttacaattctgcaagaaatctactcctgaggtcttcttcaggtttagttgattgattagggttttaaagtaaatgaaatcactgaatttcaccccagaaaaacaaacaagtggacacaccctgaactgtgcatagtatagagagattatatgactttttagttatgtgaacaaactgttgagttattgtttaaaaaaaatgtaatcctattgttcctgcaggagtcatcagagaggaaacaatatccccaataagcatgtcatgaacctgagagttcggcacaaagttccccattggaatttattgcaattcattttcaaaccaagaacaatgtacattataaatatatttttgagtttttaaaattataggtttaattcatgtacattattgaaaatttggaaaacgcaaagtaggaaaaaggaaaatcccccgtattagtatatataaaatcatttgaagttgttaggtttgtgttgctttctgaggtacagttgacctacagtaactttcccagaatgctttcgctctgcatgattctttaaggaatcaaattcaggacgagttaaatggcaatggtggccgggcgcggtggctcatgcctataatcccagcactttgggaggctgaggtgtgcagattacttgaggtcaggagtttgagaacagcctggccaaaatggtgaaaccctgtctctactaaaaatacaaaaatcagccgggcgtgatggtgtgtgcctgtaatcccagctactcgggaggctcaggcaggagaatcgcttgaacccaggaggcagaggttgcggtgagccgagatggtgccactgcactccagcctgggtgacagagcaagactcggtctcaaaagtatacataaataaataagtaaataaataataaatggcacgagtgatttcgttcctgagaaacaaaaatctcaggagcccttgaatttctttgggggcatttggcatctgtattttataaagaagtatgtgcaaaaacaagaaattaccttgttggagattatttcaactctagtcaagttttccttggctttcctgaacagagggggaagctgggaggaattattcactaagggaatgctggtggaagatattatccatttaattaggtttgtactatgaccatattaattctaatatatcagtagaagggattatgttgtactttcttccaaaaatcttacaggatgatcgctgaataattgcatctaggattctctctgtgaatgggttcttcctactgtctgtgtcttcttacttgcttccatcttagtccgttgtttgcctggattagaaagataggctgaaggcagagtatgtatgtatatatgccatggatttttaaaaacagcctatctttataacagttttaggttttgtgccatagactttgatttatgtatttctcttcatagaaataatcttattttttaagtttcattgctttaatgctcagagatatatttttaaacttcttattttgaaataattttagatttacagagagttgcaaagacacaagagtctccatgtaaccttcccttaatgttaatatcttatataaccatttatcaaacattcgtcaaatctaagaaatcaatgtaatacaatactattaactaaacaacagtctttacttggatttcaccagttttttcactaatgtgccttttctattccaaaatccaatagatgatacatctacattatacttagcaatgctgtctccttaattcattctgatatatgacatttctcagtttttttcttttttatgatcctgacactttttaagagtactgttcaggtatttcgtagaaagtttctcagtttgggtttgtgtgatgtttcctcaagattagactgaggctttggattttggagaataccacagaggtgaagggtccttttcatcacatcctatcagggggtacatgacatcctcatgacttattcctggtgatgctaactttgatcacttggttgagatggtgtctgctaggtttctctgcttcagtttactagttttttattccaatcttctgttttttagaagcaatcgctaaatgcagtccacacccaaggggaagagagttaagctctacttcctggagggaggagtcacaaagaatttatggatatacattatgaccaccacagtgattaataaatatttagggagtgataattaaaggctatgtgaatatcctgttagttcttcaggttttgaccacttattgtagcattccccagtggatgtccacaacaactgttattgtggtgttctaaaggtgatttttctgttttcctcagaattatttttgacatatggtcatttcattattttaaaaacttattttggctgtggctttgctaagttttcagaatgaatttgatttctagaacattttaattagttttttttaattaatttctttactggaagggttatctttaaatggaaggttattaatctcccttgaaggaaactgtttaatttagtaagccacggaggattgctaatgattcttattttttatttaaatttacaaaaatataaacaaaataataaaaataatgtaagattttatggggtaatttagattttttaatgttcattttttaatttcttaaaaattatactgcagtaataatcactaagcatcagacaacttaaattttaacttaaatggaaagtaagtggccaataaatgctttgtgtaacctaatggccgtgctgagtttcttcttaaacagcaattcatagcaggtgagttccgactcagagtccgaacatgttttgaaccagcatagctacagcggaaaaaaaggtgttttttcacctaaacttcaaaccaaggttttgcatattcatactaatttatctatgaggaaggagcaaactaaaatttagaaagaatatatcacattgataaggcagaacttaaaaagaaaaaaactgatgtatcactattcctttcaactaagtaccctcctctgctaactttccacctactactggaagaatatttaaaagaacataaactttataaaatttaacacattaatggcatgttcagtaataccagctatgtaccttaaatatgcatttatatatttaaaaacaatatagatttattttctctttctcatcctggctacctcagtattgataatgaaacagtttcttcaaactgattattgtgtacatttttattgagcatctactatgtgcactggaggatgctaaaccctgaagagagtgaaatatgctgatatctgtacttcaattaagatgtgcaccagatacagtcaccactgccctgtgccacccaagtgtgttttcaggtctttcttggtgttactagccctgagtgccaaggatctcagcttgtttttgggggatcctttaagcatgctcgtcatttaaaatgatgtggctctttggaacagctcagatgagaccttgcaaaaaaaacctcaagaggtaaatggtgctacttctgcgggatgatcagcagtgaaaagtcaggctgctgtcaataagtagagtgaccatataatttatcatctataaatatatatataataaataatagaggaggtgttattaattaagctggaacaagacgtataaacaggtaagcaacagatttacattccagggacattcctgggcaaacctgaatgtatggtcacctctatcaatagaaaacactcaatagacaaggacaataaggatgtggatccagggcacagcggggctgcggcactttccaggtggaatcatgcagggccctgcctggcttctgacccaggtgacggtggcagtggtaacgggcagtctgtttaagctgattcttttctgttccatggtctttccaagttcaaggttctcatctcagtcccctcacactctttcagggtctgtttcaggtcttgtcccttcaaccttccctcaccttccctggcccaggtaaattttgtctagttttttgagacagagtagcctggacatctctttattctcttttcaattattattagagttaaaaaccctgtggtttgcttttttcctggccttctgtttttattgctaaaagtcttttgaaaccaggcccttacaatccaaaaagtttgggcttttaaatgtgttgtgtgggcatcaagagcctattttgaaagtcaaaaccataacatttatttttttcccctgcatttttcaatgttcttactggcaatgtggacaccatagtgtaagtatcaatcacatataaggaagtacgcacacagaaaattacagaggttaataattcagtgtattatctctaatgatactaacacttttgatgggacacatagaactattacatgtcaaacattgcttatgtgttatttaatactcgaaataaccctatgacataagtgctgttgttatatctattttacagctggggaggtcaagattcagtcttataagtagagaaaataggcagcatgatatgtgaaaacaaactttgtcctgaactctagcgtcagtcctgtcttagacttcatttttctcatgtatacaatgaggaagtttattttcaaatcaccttcaaactctaaaattataaatagaggtctacaatccttgtcccaaaccctcatggccagttgtatgttggaattcagaaattttcagatttgtgaaaggtaatgtagtttgaatactatatgttaatgattaactacagtgggatttggggcaatgtcttataatcagtgatacttctgcagcaattttttatagtgagaaaaataaagatttttgaaaaactcttaacagttcaggtcatatgatattgccaaattagtttgcttaaacatataaaaagttttagaactcattggatttattagtgtggattaggggttgtgggaactggaccagtgaacggattggggtaattatcagtgatgcaaaatattttttctattattattaataattctggattcatagaattgacgtgtggagtaaaagaaatgttgcatggaaaatgcttatcacattccttgaaaaaatttaagttctcaataataagactaataagtaatcataatactatcgctgagctttgtgcttggttttggttgcagggacataaataatcattgaagataaagatggtgcacagcctcattaaattgttcaaggaagattgatctaatgcatctagtcatgattgtcaagtgaagtcaagtgtggcaaagggacacgtaaaggaagtaatggtaatcaaccaggaatcgattctcatggacttaagttctatctctcaaatggtttgagacacttgaatgaaagggataacattaagaactctaagagcctacattacagcaggctccaatatgataagggaaaagcaaaagctatgttaaagcagatatgtcttacctcccaaaagaatatcagctgaataaggctgtataaagcccaaagtttttccactgatactagctccatagattcagtgctttgaaagacgactaatggtatccaacagtagtataccaggtaatttaatttgcctagggaagttactgtcttcaaaaagtaaatatatgcatgaaagttaggttcttgaagacttataaacttcatatttatgtttatatataatgtttacatataaagtgataaagtagacatacgaactttatatttaaacgttaatagggttcttaaatttaaaaagtcatatatgactcttttaaaagataaagaagaaagaaaatacatgtatgcatccctcctcactccatgttatttcagtatgggttgtcacacgcttaaaaaatcatctcagtaaagcaagcacataaactagaaaaatgtcaattattaaataatgatgacgagtcaggggtaattgcctgaactttatcatgtacagaagtgctgaggcttagcagatgataggggagagtcagtcacctctgccaaagcccagagagaggagaaggagatgcagatggagcatacattaaaggtggggtcagagagcgggaaaagtgtggtgaggatgagtgaaggcatcagcacaagggaggatgctttcaaaatcaccaaatccaagcatcacagatgttctgttgttacacggattacagaaaccatgttggagctttaaatgacagaaaatgttggcatgttggtagagtctttaatataaaaatgtttgtgatatatggtagttaagacacagttatgctttggcttaatatgttacaaaattaatgggctgtagctatatattctctgattgtttggctctgttgatcaaagtagcagttatagaataaaatctatgacctgatttttttatggtaacttctgtaaaatatttcttttttaagcttttattttaggttcaggggtatatgtacgggtttgctatatagtaaattgcatgtcataggggtttggtgtacagattgtttcacttctcaggtaataagcatagtgcccgataggtggttttctcattctcaccctcctccctctctactttcaagtaggccttgatgtctattgcttccttcttggggtccatgagtactcaatgtttaggtcccacttataagtgagaagatgtggtatttggttctctgctgctatgctagttctcttaggataaaagactccagctttatccatgatgctgcaaaggacatgatctcattcttttttatggctgtgaagtagtccatgctgtatatataccacattttatttatccagtctactgttgatgaaaataagttgattccatccacgtctttgctactgtgaatagtgctgtgatgaacgtatggaggcctgtgtctttacggcagaacagtttatatttccttgggtatatatatcctgtaataagatggctggatcatttggtaattctgctttagttctttgagaaattgccaaactgctttccacaatggataaactaatttgcattcccaccaacagtgtataagtgttcctttttctctacaagtttgccagcatgttattttttgaccttttaataatagccattctgactgggtgagatagtatctcattgtggttttgatttgcagttctctaatgattagtcatgttgagcattttttcatatgcttgtgggccatatgtgaaaagtgtcttttgaaaagtgtctgttcacatcctttgcccattgtttaatagggttgtttgtttttgcttgctgatttaagttctttacagattctggatattttaccttagttggatgcatagtttgcaaatattttctctcattctgtatgttgtctgtttactctattgatagttccttttgctgtgcagaagctctttagtttaagtccatttgcctacttatggttttgttgcagtttcttttggcatctttgtcatgaaatctttgccaggtcctatgtctggaatggtatttcctaggttatcttccagggtttttatagttttaggttttacactttttaacctgtcttgagttgacttttgtatatggtgtaaggaaggggtccagtttcaatcttctgcatacggctagtcagttatcccagcatcatttattgaatagagagtcttatccctattgcttctttctgtcaactttgttgaagatcagatggttgcaggtgtatggcattatttctgggctctctattctgtgtcattggtctgtgtgtctatttttgtcttagtaccatgctgttttggttactataggcttgtagtatagtttaaagtcaggtaatgtgattcctccagctttttctttttgcttaaaattaccttggcaattatatttttggtgccatataaattttaaaatagtttttttctaattctgtcaaaactatcactggttgtttgataggaacaccactgaatctgtgaattgctttgggcagtatggccattttaacaatattgattcttcttattcgatgttttctttttttttaattattatactttaagttctagggtgcatgtacacaacgtgcaggtttgttacatatgtatacatgtgccatgttggtgtgctgcacccattaactcgtcatttacattaggtatatctcctaatgccatccctccccgctccccccaccccacgacaggccctggtgtgtgatgttctccttcctgtgtccaagtgttctcattgttcaattcccacctatgagtgagaatatgcggtgtttggttttttgtccttgtgacagtttgctgagaatgatggtttccagcttcatccatgtccctacaaaggacatgaactcgatgttttctttatttttgtcggactgagttagtttgggaagccagtttttgagctctgagattctttcttcagcttggcctattctgctgttaataattgtgatttcattatgaaattcctgtagtgtgttttttttagctctgtcaggtcattttggttctttcttataacggttattttgtctttcagttcctgtactgttatattgtaatccttagtttccttggattggtttcaactttctcaatggttctcaatggaatctcaatgatcttccttcctatccatattctgaattctattgctatcatttcagtcgtttcagtctggttaagaacccttgctgtggaactagtgtggttctttggaggaaacaaggcagtctggctttttgagctgccagagatcctgcactagttctttctcatctgtgtgggctgactttccctcaactgtggtggctgatgttccctcaactgtgctgtaatttgagtacagtcagttgatttctttcctggatgttttcagaggacgaagtgtttgtgctgggtcattatttgcgctgaattcatgtcctttgtttctcaggggcgttatgttagcaaagtatttttggtgctgaagtttgggctatgatccagtagatggtgcttaagcataatggccagtagttaggctcttgctcagccacaaggctcctctgtgtttcctcctaattgcagctgtgctctctctcagtgctctgaaactgcctgctcctctccaactcaagtactggctgcagatctcagcttggcactcctgggctgctcaccacagccttggagcaagctcaggctttatgctccttctgcagcctggaggcagcaggggaagggaccttggcagttgctgtagcagagggcttttcaccggtcttttggaactccaccccagagaaatgcagagccactaccaattggtgcaatcagcccggggtcaggtggttgtattgtgggcccaagccaagggcctgcctggtgatgagcaggggtaacagggggttgtggctgggacaaactggcttcttttccttagggtggctgcagcttactggagatatgattaaagcactcagggtctttgatccatacctagtccaagggcagcaagggcagtaccattgcagcagccatggcagaggggctttcagttgcctctgggagatccaccttagagaaatgcagagctgctgctactgggaatgttcagccaggggatggggccactgcactgctggcctgagctgaggtccctgcttggtgaagagctgaccctgattatgaagggtcatagatcacagatgatctgcagactgaccaggctgcaaagacagagcatatttctatggacttgagtttctcagaaacaaaagaggaagggactgcttttattttgattgaatttacattaacatcaatcttctttaaacactgccttccactgtcaccaacagaaatacaaaaaaagaaaaatgaattacattgtctcagaagcatactgcttaaagggagttcatttactgacatgggaaatgagaaaatattagtggaaagaacacattgagtctgtctccttcccattgctccacctacggtgggagacctcaccatgatctttcaacttcttttacaattctctttcgctcaccaaatgttgtgtgcagcaccaaagcactgaatatgtagacaacagtggagcgggtcaagaggactgcccttcctgaagtttttaatgcagagaacagatgtgatagaaaatctgagagttttgacacaccaattagttcacagaagaaaaattctgagactcttggtttatgacatggcaatcctgtacgaacgtgatgacttttattttagacggttaattccctttactctgttcaatggccaaaaactggagcctcagtttcactcaacttcttggaaaaatacctgtcattgttcacaaagaggacaggagggtaatccaaacagtttcactttttgattgcttaacaactattagagaaaatgtatcatcacttctgtaagaaaaaaaaaaaacttctaagagtattgagatgattgagtgagttgtgccgtcttcggaggtgaagacgaacacatctttatttatgcaaataaagcaagaatgccagttacctagtggatgtgagaatagtgagccagcactggtaatttaagggatgctctttcagaatgtgttctttatattcgtgaatcattccagtgttctttgcttctaggaaaaggtggttcaagatgtgtgcctaagtgaataccaaaactagcaacgcattgggaataataaagagagtgggcaatattttctttttttcttgtttaaatcctgagtcagctgttctaattaggtaaatggtcttgaacttactaaatgattacatcttttgctttccttgagggttttgaatcaggttgtaggcttagcaggtatattttatttgaatttctcacaaacttttagcagacactagttgtctgaggtactgcttcctctttcagatattgagaaatgcctaaacacctgtaatattcttttccagagaccacatctactttcacgacactatgttgaagaggattcttgaaaattttttataaagtcagacatgcttagaattggggacaaaaatctgtacttggtttgatttataaattatgtcataaggacacaaagtagtgacttagagaattgatgtagcttaccaagatgactttctctcagggaaagtttggatcattatattttaggttctggagctgaatagttggaatatcaaaagggttatttcgaaataactagatagaaaagcacaagtagataacacgtattcaggggctctttgcatgagaaaaatcccattaattcaattcctctaggacaaatgacacagagagaaagagacagagacagagaaagagaaagagaaagagcgcgcaagagagaaattgataggtgggtatatggatggatgaatagataaattcatagattttaagaagataatatatgttctaagtagaaaaaattaataacatttttcaaatgtctgggacatcatgccaaccattgtgtcttacattatttctagtcattaaaatcacttagtgagttgtgaagttttattaacattttacataaaattcctccagagtctcagagatgtgaagtgatttatgagacaacacgctagtatgaggcagaattggaattcaaattagacatatctggctccaaagcccactttctttcaagtatgttatgcatcacagtttttgtattttgttgaatgaagaataattttcactgaattttttgtgttttgtttaatagcttacaatttatgtccagccagagcaaaagcacacagccgaatatgctgcaaacataactaaaagtgtgtttgattattttgaagaatactttgctatgaattattctcttcctaaattaggtgaggatcattttttaattttcttatttttaatattgcctttgtttttatctaagttaactcatttcttctaattatgtcaccatcagttaacagttatccttaagtccttttattctatgccgacaatatcttgggctcaagtaagcctcctgcctcggcctcccaaaatgctaggattacaggcctaatcaaccatgcccagcctgtactgtgttcttatctgatgaatatataatcttgtgtttccaaataaagatgaaagtatgtgcacaaaatggcagagcttggtagtgatggagccacaaatagcaacgtagatcagttgatttcaaaatcggcattcatcccaatacttgctctgcctccctgtcatcagcgagttaaaaaataatagggataaatgatgttgtaagagccccatgtgcttccagtctttccattgttgtacaaggcaaattctagattccccagcagtttaatgaaatactggtgctccttccagcaataattttttctaatacagagggagacatgcattcttcataaagcaaaagtggggctacaaccaaaatggtgtgcatatgacatttctatcaatagtggaaatgctttattaataagctcgagagctattaacaaagactttaaatataacacccatatagatgtttgtagggatgaaatgaaggcagtaagaaaacaaattagccaacagttggcctccctgtatctgtttctgcctttactttaataacttatcaatgcacacaaggggaatgcaaaattctctgcatgggaatggctgtggctcagagcaagcttgtagatgctgcatgtctcttcaatggatacaattctattttttgattgcttaacaaatgttagagaaggagctggaaaaagaaacaagttttcatcaaaatcagaatattgggccaggtgcagtggctcacgcctgtaatcccaacattttgggaggcccaggcgggcggatcgcttgagcccagaggttcaagaccagcctggcaacatggtgaaaccccatcgctacaagaaatacaaaaattagccaggtgttgtggcacacacctgtagtctcagctactcaggaggctgaggtgggaggatcacttgagcccaggaggttgaggctgcagtgagccatgattgtgtcactgcagtctaggtgacagaagacctcatctcaatttaaaaatatcagaataatatttaataaaatattgtacacatgaatttaaagatcctttgccttttatctcagttgtagcacccaggataacctgagaagtggaaatctcacaaatttattactctcttctcctctctttctttctccctctccccaactcctttattctgttttatgtgcattttcaaccctctcagaattaattatatcttagactccttagaggtgacttctgcatttattagactccaaagagttaaatatacaagaattagttagttacaatgccagtactgaccaaaaaaaaaaaaaaaaaaatgagattgcaaaaaattccttttgttcaaggattaagtgcaaactgcactccacaacattatgaaaaatattggcccttgggggagatacttctctacttttgaaatgactgtcttgtgataaaataaccaaacctaaaaatgagataacatgaaaaggaaactactattgtaatcttgacctctacttaagatacatccctcttcattcttttataaaaagctctaagaatatttattttggctgggtgcggtggctcacgcctgtaatcccagcactttgggaggccgaggcgggtggatcacgaggtcaggagatggagaccatcctggctaacacggtgaatccccgtctctactaaaaattcaaaaaattagccaggcgcggtggcgggcgcctgtagtcccagctactcaggaggccgaggctggagaatggcgtgaacccaggaggcagagcttgcagtgagccgagatcgcaccactgccctccagtttgggcaacagagcgagactctgtctcaaaaaaaaagaaagaatatttattttaaccagaaagaaagggccttctcttatatgttaagtgaaaaatcaatttgttttcatttctgtgcctcatttaaattatacataataataaagaaattacattctgtttacagttcattaactggggaagctgtattttggccactaatcatctgagcattttctgtcttgggatttaacatagaactgatcaacactgcctcctcctgtcagatattatgtgtaagactatagaaactcctgtccaacattttagaactgtaagggaatctagagagaatatagtcaactccatgtttctccaaccaatttaatacataaaagcggatgataagctattagattggtatttctatcaatattttatagaattagagaaaaatggagttttatattcttgaataatctgtgtctttggatggaaaactgtatctatacacttggaagctcagaacttctaaatactaatttgaaaacttctctttttcctcacggcttatcccctaaaacacatgtagctaataaaaatgaaatacagagagaaacaaaagacataaaattatagaggcattgccattagtgtccttctttaaaacaaaaacaaagcattgatatctggagccagcagggaatgctctatggaaattttgagtgcattaggactgaaatgttcgcacacatgattacagttctttactctaagaaattatttttaggcttttaaaaaacattcatccaaataacttaatttggtaagaaaagctatgaacaaatggaaagaatgtatttctcactggactctttcttcttctatagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcaggtacagaatcttagcactgaatcagcttgtttttttaaagtggcttaagaccacaggaataattcaaattatttatgacttagcaaataaaaaatagccaactcagaaaaacttgcatgaaaatctttcttggtactaataaacatttagccataaagagactttgaaccacattgttttgcctttaggaaatatgcacgaggccttcatataaatttatgtaccccagtaataactaaataaaggcaataaactaaagacaatttaatatcatttaaataatcagaataaagcaggaaataaatgttaagtacaatgcctgccacttctgtcacagtgacaacattggcacggacaaataaatgttttgacattttctaggcctctctaccatacccataagaatgtaattatctctttattgcttataatttcagtggtttggaaatattgtgaccatggactggtgggaagacttgtggctaaatgaaggatttgcttctttctttgagtttctgggagtaaaccatgcagaaacagactggcaaatggtgagtcctaaacacataaacttgaaatctctcttttcctcatgcaaagcagatggaagcctttggactatgataatggtcccgagtcagatggcaagtacagtggtgagcggggaattccactgtgaggatagggtggagccagctgacttccactgactacaccttgccccagtacctagaagggcagctgatcatcacaatctggggatatccttgacagagtcactcaaaacacattatcaaggcaggaaaaaaaaaaaaaaaacaggtggcatagaaaatgttaactctgtgttccagaaagtatctatagcactaaccctttgaaaaaatgtcggagtctcatttgtgaacgacttactttatttcagacagattgcagaaacagtgtgatgaagagataacataaatttagtagttagattagttagattgaagttcaaatcctgaacacatcatttcttagatgcatgacagggaatatgaccttgagcaagttacataatatctgagtccattttctcctttatgaaatagaacattattttctatcttgtaagcttaaaagctcccaaatgtgcatgtaatgactattaacaggtagtgtgtccctcagaggcctggaatagaaacttttatgaaccctaaaattttttttcagaaaagctaggtatagttgttatttatatttatatcatgggagtattcttgattgcatatatgaatgtgcaaataggtggatgtgtctaattacaagaggttttgtactgtgtaaaatactgccctctactggacagaacaaaaaagttaaatgcttgaagcccttacagtttctgtagcctgctttacaaagcgaaaagcctaatttacaacaattacttctttaaaaatcttatctacatctggatttttttcaactatggaactattgacattttggagtagataattctttttttgtgcgggactttcctgtgcgttataggatacttagcatcccagacttctattaactaaatgccagtaacctgccagcccctgttgtgacaactaaaaatgtctccacatatttccagctgtctcgtgggggacaaaaatctcctccagttgaaaactactcatctacatggaaaattgctgattttataatttattgaaaataaactgtataaatggaaaattgtgttgtcctttattttctcccatacagtatactgaggcccttatagcaaactgttataagaaattataacattttaatattgtctaatattccaagtactgtgtttcaaaagcaatggctaaattccagaagaatttgctgtgcacttcttaagtgaaatttaatcacatcgttcaacacaacaattaattcattccttcatctattcattcattcctttttttttttttcctttttgagatggagtctcactctgtcacccagactggagtgcagtggagcaatctcgggtcactgcatcctccacctcctgggttcaagcaattctcctgcctcagcctcctgagtagctgggactataggccctcgccaccactcctggctaatttttatatttttagtagagatggggttttgccatgatggccaggctgatcttgaactccttacctcaggtgatctgcctgccttggcctcccaaaatgctgggattacaggcgtgagccaccgagcccaacccattcattcattcttcattcagcaaatggaggactccaaaatgaataatgaataaaatacacttcttgcccttaaggagttctcaatttaaggtcttgtggatggaagggtcagatagataaagatattttataagcgagctcaataaataccacaatcatggaatacctcgtttcactggtgaaaaatcggaaggccaggaaaatgatagaattttccaacatcacagagataggtggtagcaaaatccaaaatcacacacacagctggtagcaaaatccaaaatcacacacacagctggtatagtcaatcttcctcacactgagaacaggatctttctactcaccatacttaaacttcctaggtatacaaaaatcaaaatgcaagtcaaaattatcttgattggcagtcatcacttgacagcagtacctttcctgttataaatgaaacccgcataattggaaaatgtaagccaatacaacatactcctgttttggaaatatttttaattaagtagagccaatgaaatttttaaagttagtagtgatttagcagagttagatttcagaatcttactgcttaagagtcaaaataactatagcagctaatgggttaggttctcattctgtgccaggtactatgccaagtactaaccatgaattttatcactgagtcctgtgcacagttccaaaaagtacaggccataattacttctatttaatgggtgaggaaacttgcttaaacttatatatctagaaagtaaaaagactgagctttgaaccaaggaaatctgacagtactgctaggcctgtcaaccagtctgtattgctgacaagacctaggagggaaacgagaggtgattagaactaaaggataaactgccaatattttctttcattaattatgaagtatccaaattccaataacaagttaatattagaaaaacctgaacatcaatatttggcaaattgatatgcaacctctcttaattcttagaccaaatctgtggagtgatgtcatcattctcattgcacagatatagaaatagggcttgaaaagtttggcacatatccaaaagtcacacagaagtcgcagaagcagaattcacagaagttgatgtcttctcggcctgtcatctgggggaaaattaaaaggaattagaagtagaagaagggcatgaaatcaatatagctcaatcagtgcaaagtatgattaatttgaagacctaatgtttaagtaacttaagtcatttatatttattttcctccaatttttcttatatatggtattttagtttataaactagtataaaggaaatactatattcctttggctcattctttcatttcagcgtgaccaaatgttacttgaagatgtattacctgttcaagaggatgattctttgatgtcttcgcatccaattattgtgactgtgacaacccctgatgaaataacatctgtttttgatggaatatcctatagcaaggtgggagaaatagaacattgttttgaacatcttcctgtttagtgacttttcttttagtggatacctaaaaatggtaagaatggtcacactgtgccagtgagctttggaaaacagtgtagaagttattctgagtgctgaatattcaatagtttgtacttttcagtataatttagtgctggtcattgtcacagaattttaaaagagatttttaagaatttctctttacacatttgtatataattattttcattctgataatttaatatttagacttgaagcatcacatttcaaattgttttatttgattttttaaaagacaataaatctttttcttctatgtggtcaacaagaaatgctgtatatgtgcacagctttcctagtagaacattttaatgcctgcaataaacatttaaatccaactcagaaggaaatacttttattcctttttagaagatgtaaagatgaatttgttagcatattgtaggtgaggattttttcttcactaatattttatgaaaagttgctggaaatctgtaactccaagatttatgtgacacattctgtcccacaatatttcatatagtctctccttcaaacatattccacatctgtatgtaacataatttaaattttattttagtcattttctacttcagcttctcatgggtttcccactacactgagatgcttagaagctactgcatgctaatacattttgttatcctgagtaatacctaaagtcttatttgagtcaaaaatattataattattaaaatgaatacttgagtgaaaaagcttctatgtattagcatttgaaattcttagcatcatatttttgactttccctctcatatgattcccatggtgtatgttcagccttcttgtattcatttttctttgatattatgaatgattccttttatctttatgtcgaaatgaaaatttcgaatccacttatagcctattctaattattcacatgggagaagtttaaatttattcaatcatttttccccttagtcctagatactcctcaggtttaagatattatgtccaagataaataaatgtttctaggcctttagctttctaaataggtataaaattaatttagaatgcttaataacttacaataaaaattactaatttaagtgggggcagtgttcttttttcattcagttacttgaaaattgatttaaaatattacaaattgtgcatttcagtactaaccttataacacataaaaagaaagtacagagccaagatgttcatcagattcttcagatgaaaggaaagcaaatgagatagactactgagaagagaaagattatatgcctaaattatgtatccatgtatattaagctatttgaccagataattccttgactatctacttccctctgctaaatataattcttattttcaaatatgaaaatatatttaataagttggcagaattttaccctgaaactactttcctcattcatcaaagaatgtgattttttagactatttctctttcattaagaaagccccatctgctggtttatttggggaagtgcaataattatttgaatctgaagtccctgaaatgatggccattttagcaatttctctttaccttttagttattttagatgcatagatacagggactgtgccaagtggtattttcatcctaaaatcatagagccatataatttagcagaatcatcttgaggaactaatctcacaaatatgatcatgaaatactagttgcaagagtaataactgatcattgttccttacatagcctttattagtttcatttgtctttttatccccattgtagggatcttctattttgagaatgcttgaagactggataaaaccagagaattttcaaaaaggatgtcaggtatgatttattacttttagtgatatcaaaattaaactacattgatatgtggctggtgaatgttaagatatgtgattaatcaaggataatttcctttttaatctctttactgaggcatagataatatagcaaaagataaaaacatgattttacatccaattgagtacctacattgtatctgtaatgatcatttagcagaagtctcatggagaagttgaaacagattacttagttatttttgaaactccttacatgtgtcttagtcagcttgggctgccataaggaaataccatagactgggtggcttaaacaatagaaatgcatttttcttgcagttatggaggctggaaagtccaagatcaaagtgctggctgattccgtttctggtgaagcctctcttccgggcttgcagatggtagacttcccactgtgtcctcatagcagagagagagagagggagagagagagagcactctggtgtctcttataaggatactggttccatcataagagtcccagcctcacgatatcatctaaatgtgacagctcccaaaggcttcgtttctaaatactatcacactgggggttagggcttatatgaatttcagggaatacgattctttccatagcaacatgatataaacatctaaatttatctataaaggtcattccttatactgagtacaagacttttcccttattattagattagaaaagatcaatattagtatgcttattacaatggagtcagtgaataaagaggcttgcttccttttggtaacagaaatgacaataaactttctgaaacatttcacacatcccacttaagcgtattattccaggagatgtttctgtttcattttcgtttttctaacagaccctaagccaatcgtcccaggtttgtttttatttttaattttatcaaagtagctacaatgtgtccctataactgccgtctctgcaggttggccccattccagcctagaaatgaagttctcttcctactctttcccttccacctacatcctgcctgctgcgataacccaggtagtcaggagtagcagtgctgacggtattcatcccagagagcagaaaacaggttggagaaatgccccctgctggctgccacagaaagtacttcttctgtatgtgattccccaggagaaggtcaccattcacatagatctcactcccatcaagccttcttatgtggcatttagccctctctacactactctaaaagaaaacggcccccttctacccaatagtgaaacatctaggtgattattaaagtaagaaataaagtcaagatttcggaaatatttggaagtatatcagtatattttaaccctttgtctattagtaaaatattttgtagagacattaggtgcaaagagagaagctatgtgcttgtgcttctgcatcatgagaacatcttgtaacttttccataagtttcaaactcaaatgttatcatatattccctcactgtaagcattattattattattattgttattgagacagagtctcgctctgtcgccaaggctggagtgcagtggcgtgatcttggctcattgcaacctctgcctcccgggttcaagcgattctcatgtctcagtctcccgagtagctggaattacaggcaccaccacacccggctaatttttatatttttagtagagacggggtgtcgccacgttgcccaggctggtcttgaacttgtgagctcaagagatccgcccgcctcggcctcccaaagtgctgggattacagccatgaaccactgtgccctgcccattgtaagcatctttaatcagggactctgtcttctatatctttacccatactgcagggcctagtttaattacacatgttacgtcatcctgaaaatgtttgttaaatgaatgaatgagtgaatagcctataataaattatacaggacatagaaataaagaagattcattttcaaaaattaagttaaaattcagtttgtatagttttgattctaaattaaattgtaattaataaataacaattttggcatcttcagagctggcttcaaattaaataatctttcatattgactttgatagagaagtactaagattccttgaaaatgaatagctatcctaataattccataaaactctcatatttcctttaacctagtatctatgttataattaatttaaaaaaccggttttgtctaaaattaataattcttaagttaaaagtcttcctttaactgtgatcacagatggtgctaaaaactgaactatgaagaatagatattaatatttcatgccattatagtgctatggaatgaatttacacaaaacacccaaacacccttttccttcaatcttcaaacactagctaatatctgaaaatagtatatgatcgatatggaccacatcgaataaaccctcagaccaactggaacatagttccatagttcacatagtttgagcatcccaacaatatcctccttgagttgtcatcatcactctatgattgttgccctgaaatcccacaggctatgaatgggagttcaaggtatttctgttgcaaatactaactttctgcccaaagtgactctttattagctaacctggtgtggaactaaatctggggctggccatttgtctattctctttcatgctcatcaccttgccccaaactcaacctcaaacagcaaaataggtgcaggatgggggaaataagagcaaaattatcaactggaaaatctttaaggctatacatgtacataaaagatgtaatagagaaggggacattcataacaatatgtggtcatgaaatagaaaccgagaatatattcttcctttctttttcttctagtatcagtagtactgtcaataagacaggaatgggtcagctggaaaatgtcttttcccttcttgggatactagtaacagaaacattgttcgtttccttttgtgctcactgattccaactaataatgaactgtgacctaggtcatcgtgtaattttgacttgaatgattacatgattattcaaggtgaagagggaagtgtcttaatatagaatattcaaaagcactaatctagacaatataaaattagtaccttttaatatgctgattacataaatttccattcagcctgtggttcatgagaagcaagaaactgcaattttaaaagcagtaacaacaataacagtgatgaaaaccacacacactgatccagggttcagaattctcctcatcataatctcaggcaaatctcttcacctctgaaggcacccaggtagttagggagagcagtttccttcacctcaaaatgtgggagctttattaaataatatttaaagtcccttccagttccacgattgcatggttctaagctcaagaccttgtagtagtcaaactcctctaaattaattttaaaagatattcaatagaaattgtcatcaaaacacagctatggttataactattactatgccaagtattcaattattattatttaaaaatattagacatttgatttaccaaatattcaattattttattaagatatgatgaatgatttgtgcaactttctgtaatgaatacctaaaagtgattgctgcttctcccttcctttgcctgccctctggtggtagtgccaagaagtgaattaaccaaaagaacaaatatggaggcagcattccaaagtggcttcatccctcttccaggcttcttggagtccttctaatactgttttatctctatgtctgaaaagaagaggaatttaggaggtaacgtgatttaggtacagcacctactgaaaattatagcaacttagagtgaaaatgatatgtgcaaagttaacattaagaacactgaagatggttccattttctatcaaagacctccactttcagtcaggacaattctagaaagcaacagaggagtgatacagcaggaacttaggaaagtttactggcaaactccaagtggctcccagttacgggattagaagactgggaattttttctggggataaatcacactatatttgaaaactcacatatagaaagaggttttgtaaagaaaattgccaaaagaagcttaaatctaaaagacttgtactttaaaatatttgaagagtgaagacttatgctttacagtgaataatgtccccaattcatccaccaccaccaccaccaccaccatcatcatcattattattcaaaaggttgtatatttatttccttagagcagagatcagcaagctactgtctgctggccaaatctggcccaccatccatgtattttttttaaggctcataaactaaatatggtttccacattattaaatagttgaaaaaaatcaaaagaagaagaatattttatgatacatgaacattgtatggaattcaaatatcaatgcaacagccgtgctcattcatgtacatgttatctatggctggttttgcgcaatggaggtagaattgagtagcaggggttcagttcatcttgtgaaagtatgagaaaagcaaacattgacttctaacatgctgattattttttacacacagatgtacttggaaaaataccaattcaagaatgcaaaaacttctgatttttgggcagcactggaagaggtaaggaagagtatatgtccccaaatatttctttgtctgatttacaaatggcttaccaatcattttctaatctaactattctatccttttattttctcatatttgttaattaattaatctccattttgttttcaatcttaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttgggtaaggctctataatgcattgaaaaaaacacagaaatttggcagaaatattggtaatttgtttatatcctattgttgagtacatgatggatgagtgatatacaagtataaagccacagtgcctttaggggaacaaggaattcaaaaatagccaagtgatttccaggtttgaaatggtgggcagagcacatccatccgcatcctgttctttacagatattgaagagaggaatggaattacctaaagaaataaacctacaagaataaagaaaataaagggaggggctgtaagtgtcacagagttctgaagaagtaaagcagaaggagaaatacagactgaggaaaatacaaccagataataataagggaacttccctatccctagacaggttctaggtacagtgttagcatgaagactgaagggtaagagtgagaagtgaggctggaaataggacaatgaattgaaagtctagtctcaggacaatttgtgccagctggacccacccctcacccctactttctctccgccacctaccatttctttctctgcacacagctctcagaaatctggcaatggctccaggaaaaaatacagtgggcttgtttcctaaagaaattgactaaaacagtagaggagagctaaggatttccatttggttgagactctcagagtaaagcctccctcattatgttatttgcaggatgggtgggctggagctgacagcacccctcatacacacaggcagagctcccagtcagaccttctgctcagcagagaaacttacttcaaaaatacaactcccttcagcctgggcaacataacaagagcctgtctctacaaaaaatttttaaaaaggcactggagtatggtagttcatgcttgtagtcctagctagtcaggaggctgaggcatgaagacgacttgagtcatctcaagtcaggagtttgaggcttcagtgagccatgatcacaacactgcactccagcctaggtgacagagcaagagctcatccctaaaaataataaaataaaataaaataaataattatatatatacacatatatgtatgtataaaatcccttctcgataatagagagagtacacgccagctactagaatcaatttaactctttcttaaatatgaatgacaaagatcacaagatacatgaaaaaatttggaaggataaaaggttaaaatttcatgtgaacaaacaactcctgactttataagatgcataattaaggaaacaaaataaatgtatgagatgcattcagagatgaagaactattacaccaatgaaccaggagcagaatgtcttagaaaggacaaattgagaacacaaaagaacctgaaagattagatttctgattctcaaaagaattaatagaccaactaaaaataaatttggcaaatcctccaaaaatacagggcaaacacacatagagctagcaaatataaaagagaagacaaatatgaacagtctagcacccaacagataggtgtttttattttttggcttttttttttttcgagacagagtctcactctgtcacccaggttggagtgcagtggcgcaatgtcagcccactgcaacctgtgcctcctgggttcaagcaattctcctgcctcaacctcccaagtagctgggattacaggtgcatgccaccacacccggctaatttttgtatttttagtgaaggcggagtttcaccgagttgaccaggctggtcttaaactcttgacctcgggtgatccacccactcagcctcccaaagtgctgggattacaggcgtgagccactgtgcctggactagataggattctttttttttttgagacaaactctcactctgtcgccaggctggagtgcaatggcaggatgttcgctcactgcaacctctgcttctcgggttcaagccgttctcctccctcagcctcctgagtaactgaaactgtaggtacacgccactacacccagctaagttttgtattttttagtagagatggggtttcaccatgttggccaggatggtcttgatcttctgatctcatgatccatgcacattggccttccaaactcctgggattacaggtgtgagccaccgtgctcagccaataggcgttctttaaaaggaaaacagagaaacttggaggcaaataatatcaaatacataatagaggacacaaggattctgattaacagaccccacttagtaaacagtacaaacaggaaaaaccaaaaccccaaaacatacatagatacaccctcacaaaatttcagaaaacagagacataagttagtgtggcattagacttctccacatcaaccctgaatgcaagaagcgaatgaggcaatgcttccaaaacactgaagcaaaaaatattttcagcctctagttctatacccagtaaaattaaaccaagtgtgaaagtacattaaagacgctttcagaaatgcagccccagaaaatgatttccacataacacttttttgaaagttacttaaggctgcactttagaaagggttttgggggttggaggagaaagagaaagaaaagaagggaggatatgaataaataaaaaaaaagtgaaatacatgggacacaggatccaggaaacggtacatccaacctaggaaaaccacgaaaggaaatgctcagggtgctgtgagtgcctgtaagggcaggatgactggagctgaggtaggcgatctccaggaaaaagagaaattctctccagtgggtagtgcggttgggaagatgaaaaaaacttgaggatttggtgaaagcccatccgtttggtcaactataaaaaagaaaattagaaaaaacccaaatcaaagactatatataaaaattatgatccaaaaatatgaagcggagttctcacaagatctgatggttttataaggccattttccctgctcttgcttgctctctctcacctgccgccatgtaaaatgtccctctcccccttctgccatgattgtaagtttcctgaggctgccccagtcgtacaaaactgtgagtaaattaaacctctcttctttattaaaaaataacaaaaatatgaagcagatagaatgattttatgccattgatacagtataagaaaaggctctgatattagagaaattttacttaagtggctcaggggccatgaaattggaccatggtgtaagaaatagatctccccacactccttgaccaacactatatacaatatacatgctataatttcataaatattaggtattgacttttaactttataatcagccaatggaaaatgtaaacatttttgttatggtggcagaataaattgcaaatataaagtcttgacattgtaacaagaaaaatcaactgacaaaaaaaggacatggaagagggagaaaaggtgggagaaagtgttgggatactacttcagtggtgtgcaggaacggctgtcttcccaacttagtaacattttcttgtcagtgacatgttggtagcttgaaaatgctcctgatgggagtattacgtggaaatgagcaaatactacgttttgcccatatgaaaactgggtgttaaacatttaccagtactccagtggatatcctcatttaagtcaggagagtagttaagactaaaatttatgaagcaagaaatggcagtatgagtatattatttagaggcacaattacaaactacagaaaatctaaaaataattttattttattaaattttatattaaaagagaaatggaagagaaagtaatatatatataagctcaatcaccctcttttaatgggtaagttaataaatattgtctaaataaaacaacagaggcatttaaagtccaattagactacaaaagcactaaaaccagatcacttaataggggatgcttccgagcagggctggcctgtgggaagggtgagtaaggagatggtggtttttcaacactaactttttaagtttttgagtagtgatgaatttatctacaaattgcacacattaaattctcctgagcatttaaacagcacttacaaacttaatcaagtcctcttaaggatatatcacttacaagaaacttataaatgtaaccaaattcttctaaacaacactagctaaaattttaccgaattcatttacaatttcaaaatacaaacaccaccaaagaagcagatttataagtctaattaaaattttttctatatattttatgaatccaacaaattaaaactcaaatatagtgtatcaaatttcttgcacattttcattatgttaaaaatcaaacccttaacaggatttttctagacatttaaatatggctactgagttaagattttctaagtatttcaattaaaacaattccagtatgtcattttctctactttgccaaatgtatttatttatttaatttattttctgagacagggtcttgctgtatcacataggctggagtgcattggtgaaatcatagcttactgcagcctcaatctcctgagctcaagtgattttctcacctcagcctcccaagtaactgggactacaggtgctcaccaacatgcccagctaatgtgtaaaaaagtttttgtagagaaaaggttgttcaggctggtctcaaactcctgagctcaagcgatcctcctgccttggcctctcaaagtgttaggattacaagtgtgagccatcgcagatgacctcaaattttaaaaaatgttttatatattgtaaaggctgataaagcatgcaaagcacagctgaggatttcaaaacttatcacacctgcatgaatacaacttgcacaaaaatcttaatactataaacatttctgcataactaaatcgttattttcgtatgtatttcttgggtgccagctgctcccatctgaaggaaacaaattcaaaatctcaggaactccagtcccgggcctggccccaggagctgggatgtaccactctggggacatcttcctagcccgggttacccagctgagcccctcctagagtggatactggcagcgtagcacatcactagtcctctggacgttgttcccatttcacccatgcccagtttttattgccccctctttcaacatttgaatgctttgcttgagcagagagaatcttcacccgttcccacccacgtgtcctctaatctccactgcctgattgtcactgaagagacactttgtcttctttttctccttaatgacttcattgacattattttatagtcacatatataaattattgtaagatcaattatcttgtagcaattagaataacacaaaaagatgttttagaaagtctttaactctaaactggttcctttatagttactggtctatgttctagcaaattaggttggccaactctaataaccactggaatatttggatattaaatctaaaaatatgtctcttgtcaaacaagcttccatttggaaagtttcacagtaattattctctcttactatatgagtccactgatttgctgagcctcaattaattgggagagggaagcaggaggtggagtagggcagggagggtcacagaaggctttcttttccagggatgtgatatttaaggtgagcaaattggtgtggggaagtgactgctctggatgttcaaaatagaaactatggccgggcgtggtggttcatgcctgtaagcccagcactttgggaggcctaggtgggtggatcacttgaggtcaggagtttgagaccagcctggccaacatgatgaaaccccatctctactgaaaatacaaaaattagccgggcatggtagcacacacctgtaatcccagctactcgggaggctgaggcaggagactcgcttgaacctgggaggcagaggctgcagtgagccaagatcatgctactgcactccagcctgggtgatagagtgagactctgtctgaaaaaaacagaacaaaccccccgccccaaaacagaaattacagcgtatatgaaagcccaaagtcttatacacatgatttacaacacttattgaacattgaccaagtggttggcactattttaagcacttcagatgcattttattttatagtaaatgaggaatttgtggtaaaagtgattaagtaatttcaaggtcacacagtgtaaataatggaggcttgatgtaaacccaggcagtctggttccaagaaacgggatagcagagagtgactgggaaaagtggtgtgaggtgaagacgaagaggaaggcaggaaccaggtatgcagaccatgttaaagattttgaaaatagtatgcaaatttaaggattttaaggagagaattggcagggtcacatttacatttttcaaagctctcctcttgctgcactgtggagaactgatcacagatcctgggcagttggggaggagtggaggcagggagaccagttaggacaatattgcaatgagcagcccacgtgatagttgatggaaacaataagcctgggctaggtaggagtggctgtgggctggagggcatggcagatgttccaaagattttattgagctaaaattcctaattaaagaacaatgtggaaggaattcaatcaggtgaattggcggagaacaatctccttttagaatattgttctcatcttgcaccacagtgatcgtagccatatttattcagaagagaaagatctttatagtctcatttcatgatgggtactctataaggggggtaacagagcctgtttcctggattacaattcagggcttggggaaataagtcacactacagcacactcaggtgtttccaaaaattaaaattgccgaagcacttgactttccaaggcatcagagaatgatgaactctcagaattattaaattagctgcttccaagatgccagttgacacctgaactggagaagcattgagaaagccgttgtactcaactcgttgaggctcatttccggcctctcttcctggaaacctcagacacccagcctcccacactaagtgacattcagagaaactgggtatcctgctataatgcgagttctgaaaatcaataggtcacaccacaacaaaggaaaatttgactacttagaccaatatgaggtcccttcagggagtgtctgtatactccctgaactctgcaggtaagtgtactccttacctttattttagaaaggaaagattagatgatgatggagaaaacatttgtttttcactttttcctcttcatgatacatgaattgaaacatagatctgacttgttttcaggtgataattcaactacgaaaatcatagaataatctctgtggtagttctgctaacaactataaagtgtttcttttatagttactgttttgtgttctagcaaattagattaactatttaatactgctggagcctctggatattaaaatttaaaaagtatttctctcttgagaaataaacttacactgggaaaatttcccagtaactgttacttcctctcatatgtatccattaatttgttaagccaaagacagtcaacaatttaagccaaagacagtcaacaatttaaactaaggagtttttttaattaatggggttggatttttacaagctgcttgttggttatgaatttctcttcacacaaaccaaacaattttactgccaagtgaactaaatatatcatcacggtataaaatcaatttttgtaacagtaaattttaaaattttattcaccaagacttagaacatagaactgtattcacatttatactgtctttaatatttgtcttcagtttccaccttcagatactattttcattttatttatattcttagttgcatgaatttttttgtgatggcttatcataaagttaatatgttcattctatttttattttttaagaagtcatatatgcataggaaaagagacttagaaaagaggttcttctctgttgagaaagtttgttaaaaatccgtagtagctcctgaacaaataagaaagaaccattatagcaaaaggattcttctttgtttaaaagaagaatttgatcataataaatgccttcatgcacccataaaggaattagctttttttccaatcctaacttccatctactttctgttcagatgtgttcctgtttggtagacagtgtggccagttaagttgtactgtgagttcaatgatcttctataaatattttctcactgtttaaataatccaagattagggaattcttactgactagaacctttttataattcaaatggctcacccatgtataagttattgctttaacaccatgtcctcaaccatctcttagaaatgagccagtttcacatctccatcccgggatgtctctctcaggaaagcatatgtgcctttgatagtccactccatgtaaacaggcagagggaatgggagtaagtgtgtcagcttggtgcaatcaaagtcagtttccttagagaaaattagagtggccatatttcatactgctagaacctcttacatggttagatagtgaagaactatgtctataaaaatgaatcctgatactcctgaatgttagccaatatgtagaaaactcaatcgtttcatttatgtaatttccatttcttcacactttatactctcaagtctgtgattttactcagcttagattacattagatcatgtgattctaaaactataaaattgtatagcctcaactttctatcatttttatcttatgatactcttaaagacctcagagcagtatttttgtacatgagattaggagaacagcttctgcccttttgaggcctggtgtagtcccagaggccatgttttagagaggatagtcaaaataggaaaccttaactgtgggcctaggtcatccagacgctgcctgctctgttgtttcagtcagattggcattggggaaagaagaggaagcataaaatgtgagtttacatggcagcaccaattcagcagaccagtgcaagtgaggtatataggtaagatgtggcatcttaggaatgttctttgtcggtcttctgagaagctgcaagggctcttagtttggtgttcctagaagcagaccccgaaatgatcatgtgtgtgaaagtgacttgttagaaagtgtttccaggaaagatcagtgggggagcaggcagtgggatagagaaggaaaggaagcccagcaaaggtgctgtatgaagcaggtcctgaagagagtaactttgacttagtcctgcaggaaagtcctggagccagtgcagatcatacttcagagtgctcctgatggatggggcaggaagcattctcacacctgtcactcactgttaagggccacatccagaaggacgtaaattcccaggaacttctggctttccttgctcaggtagctggaaggcagtcctctgtcagagagacccaggtattgattgtaggcagggaaagcacactggtatccaaggtgtacaaaaatgacaaagggggccgggcacagtggcttatgcctgtaatcccagcactttgggaggccgaggcaggtggatcacctgaggtcaggagttcgagaccaacctggccaacatagtgaaaccccgtctctactaaaaatacaaaaaaaattggttgggtgtggtggcaggtgcctgtaatcccagctacttgggaggcttaggcaggagaatcacttgaacctggtaggcggaggttgcagtgagccgagtccgtgccattgcactccagcctgggcaacaagaatgaaactccgtctaaaaagaaaaaaaaagagagaaaggggtctaaggagataaggaggaagcactgacagtgtccactataaggcccaagaagcaatttatgtgttggttttatgaaacgtatagccaaaaacattccactgcagtaaaatgctccaaaggagctgattttaaaaaaactcaatcctgtaaaacacttcaatagttataaaacaagggattacttctttcaggtatatagcaaaaatatattctccttgaatgacatacattttgttatatcttgaaaaggtgaaatgttaaccctaattctctgttagggaattgaatgttgacagataaaccaactttgagttgaaacctaaaccagccaatggtacgtagattcaccttctctccagatctgcattttctgatatgagatgatataagaacaaaccaaaaaaaatgagatttcaagacaaaactgttaagtgtatatatcaaaatacaaagttaactcccacctacccactctgcaggaaaatactaagtagctaaagagaagcactgaaaactcctgaaacatgcttacctgatgattcttcccttgagcacttcagttctagttctaaataggggatatttaggggagggtatgagaggctttaggggatgatggtggtggtagactttcagcataatttctaaaatgtgttatttccttcacagagtttactatttgtcttctaatttctaaaaatgttttgtgttccttgatggaaatggtagcatattagactgtgtgcaagtatgtgtgtgaatgttcaatattataataagatgtattatatttgtgtaatttatgcaatatctttattctaaaatgccaaagcatgttattgaaataatctttttcatgcttagctaatttttgatgcaatttctaaattttatagatttatagaaattgaaaacagttacacagcttatcttcatcactaaaatgttgtattaactacattaattgtgtagtatggactagataatcatttaaaagaaaaatatacttgtctattgctttttagtgatttttactcttgaaattttatcttttagtaataaaagttaaatttttctttttaaaaaaattttagttatacatggaatatcccagttaaatggactgaagataatataacaagcagtgtgttatttaataggtcagaaaaagaaggtaaatattattaattgatttatttcttctttgaattgatgtaccacattaaactaatataagtataaagatgcaacagtaaagctggaacttatgtaaacttcagctaagtgatctcttaaataatttattgatgattccaaatcttcatctacaatcagaactgttataccttgagatattcttttcaatgatttatcttgactgactgatttatcataaatacccatatccaaaggagaagggtcgcatgcccaacaattggaagatcaatgtgtaagtttccttccttccttccttcctttttgttttttcttttatcagataagccattgaatttctttaactgttatatgacaagcctgaggatttttttaatgctcccattaaattagaccattttttggaaatatatttgtgttctatctgcactgatttattttttccttacttgaaaaatgttagggttgtataaaaacaagtaaaccttctcacgaaattccagattgatgaaaaaaataatagataaggcaagctttagctgcaatcttggaaagaatccttctttttatattttttccattgtatttgttttggtgtttcaaaactatttcttttctaagacaaaccagactcatctttgccccatttcatgaggacttgatttagaatagtatttggtatggactttcacttgtgtcttcttgaagataaaagtagatcactcattctttatttacatatgcctagttgctcatgtaaaatattttaaaatattaatgaggtatgatttctcctggccaataaatttttactctgtttccagtagattgccttttaagaacagctttactgagatataattcacataccataaaattcacctatttaaagtgtacaatccagtgttttttagtgtattcacagatgtgtaatcatcaccacagtcagttttagaaaccccataccctttagctgtcatgcctgcagcctcccatatgcccagccctaagcaaccactaatgtattccctacctctatagatttgtctcttctggtcatttcacataaataaaagtgtatatgcagtattttgtgacttttcaattagcataacgatttcaaggctcatccatgatatagcatgtaactctacttcattcctttttattgccaaatcatatcccattatatggatataccaccatttgtttatccatttatcagttgatagatatttggatcatttccaccttttgtctgttatgaataatgctgctataaacatttgtgtataagtttttctgtggatccagcatgttttttccacctttgggccttttaaaaaaaaacgtttattgttaacagtttttgtgatttttttttactattactacaaactaccagctttgtcattatagaggtgaaatccttctgaagcccttctgcacagggattgctattacaacaaaactctctcttgcttatttatgttaataattattgtaatatcgtgatcaaaaaaaattctaaatttttgcagaattcccagatcaatgccactttgttttagtattttatgctgtgtttcaatgcgaggctctatcttttgtggtcttctgaccattttcttattcataagtacacttgccagaggaaaagggagaagacagaaaaaaaaaagacattttcaacaatgtgtaacagcactggtaaaaggcataataagaacgttagaattccactggaaggttttcagtggatttggtttaactattactaaatattttccccattggtcaccatagttaattgaggattggaagaatatctcggcagctgtttgatttactgtttacaagtttgaaagcgtgaataattcatctaccctagtacaattcacccagcactttcatggaatgaagtttccatacaagtgaattttccagataactaaagcttactcaagtgctttgtaaaatgcatttcaagagttcacaatagacattgttctaatatgtgttatgtactccttagaatatttggaataataaatttaatccttaattactagattaattctttcaagcacgtattgcttatgtgcaaaacacagagataagaatgggggcagtgctggagcaaaaaaaaaaaaaaaaagcaatcctaacccttgtgtagatggttgtctagggataggtttgcaggcagacataatgctgtgtcctaagtgcctctgtggcaatgcagatcaccaaaagcactcatagaagcatcagcccaggtttgggggttcaggaagcattcctaaaaaatatctaggctgagagttcagaggctaaagatagagtataaatgggtgataaaaattgaatgtagaggagacgtgtgctctggacagaagcatgactgtgaaagtgaaagagcagggagttctcacactccttcgtatccctttgtcaatacatttcacacatttttttgttctaactattgacctatctatgtctcccctccccacagaatattcttagaggaaatggagcttatttgttattgttgttctggatctacagcaggcatctaataattgtttattgaataaatgaatgaataaacaaataaatgaagaggctgatagttacagagctttgatgacaaatctgcctttatctgaaacttcagaatcatgtctggtcactgagccagaagcaaactagaggtctttttctacttcaaagtgtctgctccatttttaggctgtacaataagttcctgtttcctgtttgaggacatcttcagctctcagcttagagcacggatgacgaacatgtcctgagtgtactaaatgggcaaccagctcatgttaccagtcctacctccctcctcttggtttctttgatgattcattagttagaaattcttcaggcaatagtggactctccccaaggtcttttatttacatttctattgtatgtgctattttaggcgttaaaacaacaactaaactcataatttctaacgaaagaagagaacctctattataaaacattttctggctactccagttaccctgaataatctctcctgtcatcatctcctgtcataaaatatagtatattttatcctgtcactttcatcagcccttattcctagtattattactttatattttaaacaaaatcattgttattaagcttcatatgttctctcttttcgttctttcttttttttttttttttttttttgggacagagttttgttcttgttgcccaggccggagtgcagtggagcgatctcagctcattgcaacgtccgccccctgggttcaagtgattctcctgcctcagcctcccatgtagctgggattacaggtgcctgccacctcagctggatatttttttgtatttttagtaaggatggggtttcacaatgttggccaggctggtcttgaactccagacctcaggtgatctacctgcctcagcctcccaaagtgctgggattataggcgtgagccaccgcgcctggcctctcttttttttttctcaactaaattataagcttcttgatgacacaaactacacatatttcttgtctcctgtccaccctattatcaacaaggtgctacgtacattctgagttcagaaagtcctagtttaatgaagggttgtttgccccagaatgctgtacttttagaggttaactgcatatattttagttatgtctccatcttttagtatcagctgctattttggctattgttaatgcatccacatttagtagcataccacctgtttgcatttaatttactgctttctaacatttagaaggattgaaggttgttatatggtgtcaggtaaccaatcttgctaaaacataatattttaaaagagacatttctaagtgcataggatctgggctgggtctaagttctaggaggtggtgcggactctacaatagctgtttttgcaactcttacttccagatttgagggtgtcctctggatggtttggactatccagactgtccagtcagtttctatagaaatagatttactaaacatctgtgataattatacataaatatttaataccaaaataatgatgggcatgtatttttgtatttgatgacaaagagggaagcactttcttcattttttcaagctaagcctcatggaatgtgcaagctttgattggatgattatgggttcagttttgctggtttagaaactcaatttgtcagttcagccctagtcaaccaagtcttggaagatctacttatctaaaccaaacatacaagagattaactaagaatgctaacttgttaatttacacagttaaaatatactagttagtgaatctgaatactcatgtcacctaattaggtatctctttccaggaagcaagttacttagtaagaattaaagggctgggcgcggtggctcacgcctgtaatcccaacactttgggaggccaaggcaggtggatcgcctgaggtcgggagttcgagaccagcctgaccaacatagagaaacaccgtctctactgaaaaaatacaaagttagccaggcatagccatcaacactgaggcaagaccctctatcagtaaaaaagattacaactggctgaaggctcagatgattgttagcatttttagtaataaattattttagttaacatatatacttttttatacatagctgcctgtaatgccagctactcgggaggctgaagcaggagaattgcttgaacccgggaggcggaggttgtagtgagccgagattgcaccattgcactccaacttgggcaacaagagtgaaactctgtctcaaaaaaaaaaaaaaaaaaaaaaaaaagaattaaggaagagttaaggtagattaattattttacagatgtctttaaattgtgatagtgtgatatattgcattagccaggtgagtctaattattgcactttagaaacaatcaatagtggtttggtgcaataaaagtttcttgttcatgcaacagtctaaaggagatattcctgactgtcatctttcctaggtggctctccaccaaataatgacttggaaatcctgtcttcttccttcttatggctttaccatcccctgcatcttggaatccctcactggttcttttgcatctagctcaaagacaggggaagataatgaaggaatcaggcctagaagtgcatctattacttctgcccacattttatagccagttctcaaatcatgtcctgcaaggaaggctaacatagtccaattctgtacccaggaagaaaagggaactgtgtggtaaacaactagtaggtctctgtcacatacactgttttctgtaggaccagacctgtcaaatagcctgaaacacatgttccagctcaatttggcacctacttccatgggcacactggagacacattgacagatcttcactacccaactctcctttgcagttattttttttcaactaccaaaattattgctaattgtaatctttcctcatgataattgggttgcatttttccagtttcctattcattgcatgttacatattaaagccacaggcatacctgagagatactgcagttttggtgccaagccacgcaataaagcaaatatcacaattaagtgagtccatgagttttttggtttcccagtgcatatacaagtgatgtttacactatactgcagtctactaagtgtgcaattgccttatgtgtaaaaaagtatatatgttaactaaaataatttattgctaaaaatgctaacaatcatctaagtcttcagcgagttgtaatcttttttactgataaagggtcttgcctcagtgttgatggctgctagctaattagggtggtggttgctaaagacttgggtggctgtggcaatttcttaaaataagacaacactgaagtttggtgcattaattgacccttcctttcacaaaaggtttctttgaagcatgcgatgctgtttaatagaattttacccacagtagaacttctccaaaaccctggtgctgctttctcaattaagtttatggaatatttttaatccttttttgtcatttcaagatgctcacagcatcttcaccaggagtagattccatctcaagaaaccgctttctttgctcacccataagaagcaactcctcacctattcaagttttatcatgagatagcaacaattcagatacatcttcagggttcacttctaattctagctctcttgctattttcaccactctgcagttacatcctccatataggtcttgaacacctcaaagtcattcctgacggttgcaatcaatttcttccaaactcctgttaatgttgatattttgacctcctcttatgaatcatgaatgttcttaatgccttctagaatggtgaatgctttccagaaggtttctaatgtaccttgtccagatccatcaaaggaatcattatctatgacagctatcaccttacaaaatgtatttcttaaataacaagacttgaaagtcattccttgatccatgggcttcagaatagatactgtgttagcagctgtgaaaacattaatctgcttgtacatttccataagagctcatggatgaccaggcacactgtcaataagcagtactattttgaaaggaatcttttttggtgagcagcaggtctcaacaatgggcataaaatattcagtaaaccattctattaacagacgtgccgtcacccaggctttgttgttccatttatagagcacatgcagagtagatttagcataattcttaagggccttaggatttttggaatggtaaatgagtattggctttaatttaaagttaccagctgcatccacccctaatgagagagtcaacctgtcctttgaagatttaaagccaggcattgacttctctctagctgtgaaagtccttgatggcatcttcttctaatataaagctgtttcatctacactgaaaatgttttttagtgtagctgccttcaaaaatgatcttagttagatcttcttattaacttgctttaacttctatatcaacacttgctgcttcaccttgaacttttatgtttggagatggcttctttccttaaacctcaagaaccaacctttgctagcttccagcttttcttctgtagcttcctcacctctctcaggcttcacagaattgaagagagttagggtccttctctggattaggctttggattaagggaatgttgtggttagtttggccatctatccggagagctagaactttctccatatcagcaatacagatgtttctctttcttatcattcatgtgttcactggagtaggacttttaatttccttcaaggactttttctttatgtttagaacttggctaactgtgtggtacaagaggcctggctttcagcctgtctcagcttttgacatacttaccttactaagcttaatcatttctatattttaatttaaagtgagagatgtttaactcttactttcatctgaacacttgaggccattgaagaatgattgattgggctaatatcgatatggctgtgtctaaaagaatagggagtcccaaggggaaggagagagaaagagagagagagagagagaaagagaaagataaaaagagagacaggggaatggccagctggtggagcagtcataacacacacaacacttaccgattaagttctcacctatatgggtgtggttcgtggctccccaaaacaattgcaatagtaaaatcaaaaatctctgatcacagatcaccctaacagatataataataatgaaaaagtttgaaatattgcaagaatgatcaaaatgtaacctagagacatgaagtgagcacatgttgttcgaaaaatggtgctgatagactggctttgctacaaaccttcaatttgtaaaaaatgcagtatctgcaaagtgcaataaagtgacttctctctagcgcaataaagtaaggtatgcttgtacacctttctttacaggcagattctctaggccacttgctgagatttagaatggaccctgtaattattactaaaacaatgactaatactttcttgaatgggtaatttgttgaaagcattaccataaatggataaccaatccattttattatggatcatgttagctttagtttcagaaattaaaattttcttctatgaccccaaagtctaataatgcattctacttgaaacttttagctcttcaaatatattttgcatgtcattagttaaaaagcattactcgtgtctttcagttgttttttttgctttcttaaataaattgagatgggggtcttgctatgttgaccaggctggtctcaaactggtctcaagcagtcctcctatcttggcctcccaaagtgctgggattacaagtgtgagtcaccgtgcccggcctcagctcttttactatcaaatgatacacaaaatttaataagaggtaaactctgtaattttacattgaaaaataattcacttaaaggattagtgcaacacagcattcatatcacctaagaaaaatgtttttttctctaggaatctcaggctatcataagctgtctacttgtctaaaattttttataattatttataatagatagtaacattaaagaactgttacctgtgctctgttactgaaatctatcagggttgaaattaaagaggctctcgatgaaattttgaaaaggtaattatcgcttttctctatcatctaggcaaataataaaagaaaaaagtaagaattttctagaaagagctcctactcagaaataactcattcaatactttttggcatagatagaactaataagaaacagaataaaacaatttttaagttgatacagcatgatatgtccattaaacttagatttccaaatatataaaatgaaattgcaaggtgtttaaaatataatttcaaatgaaaaaggattgctaatcataaaaacagtagggtcccattatatttgttgtgtgtttgtgcatgtgtgcatatagaagatacacacacacacacaacaggtaaaaaacatgttaactgtggtgggtaatttttatattcttctttatacttttttgcattttccaagtgctccataaagaatacatactattgttataatcagaaaaaaaatagtaaatggagtaacagaaggaaacatacagtatattagtcctgtattttaatcttactagagtattttagttctactcattatgtaactaaacaactgaacagtattttgctattgacaactgttccaaaagtagcatgaacttggaaagtccttaactactgacttcctggatctcagcttcctcatctataaagtgagaaaaatcacagtaactctagacaggcttaactaggtacatataaagcacactaaaatatggcagtatttagatggattgccaggaacttctcaacgttatttatatttgcttcgctatttatagaactggcagcatatcccctttcattataatggggatagctaccatctgttggatacgtagcacataactatgtgaccaacactttacctatgttatcttatttaatcttcacaacagccctgtgagggatttttgtccctgtcttccttggggtgaactgggacacagaggggtcaagtgatctggccaaggtcacacagctagtaagtcacagagcaaggtttttatcctaggtctgtgagactcaaaagttcatgctctttctcctgtaacatatggctttatgcttagcaagcaactctccttctgatacaaacattcaaaatgtacagatgccaaaagattagcttcctttcaacaacttgtccatgggaggatgacaaagaaagagaaattctacatgagtgaggtaagggtttataatttatcaattacctactccgaaagttcctaaagaaacttattgtcttgttggagaggttactcatatattatgaaaaactactgtgtcctggatatcttccagaccttgcaaacacttccaaaatttaaatcatatttcctcccaaactgactcaccttcctctattctctactggcagcaccattattcatccagttgtgcaatccattttcccctcctctgactgtccacatcaagtcagaaaaaggattttattgattttacctgtgataagtctcttgaatgcatcaacttctttctagtttcatcatctccacattagtgtaagccctcatcctctattgccctacatgactacagtggactctaaattagtcttcttgtcgctagaatcgcctccaaaatatctcccataccactattgaaatctttccagaaaatagacttgagcatgctatttttctgcttaaaactcttttcccctctcataagatggattcttaacatggcatgtggctcttcatactggaggccaggcttttatttccagcatcatctcctatttttcaatatcacaacctacattgttggtaccttaaaatatttgaaacttctcaactatactatgttcctataccattatttaaattgtatattgttcatgtaaacaaaagagtgtatgatgtatgaactgaaaaatataggagtaacgctaacgaacatggttatatcaaagcatagctattattttaagtacatatcttttacctaaaacataagtctctgctccttcagccttgggcttctaaaatctatacaatagagcctcacatatatatggatgttgttttagaaagaatgctaatttgataaatccattgatggaaaagtattgttgtaaccaactgaaataggaagtagacggctttacaaagataaataaatcggaagaacaagtgtgaagtcgattacaaaatcaagaacgtttcattcagatctcaattctattgcaggtcttcttgatacagtaacattttaaaagtgttgctgattatcaatgtattatcctgcttagtgatagccatttccatcaacttcaatgttgattttaataaacaaagtattattttgagtatttacatttgtatcccctccccaggctgccctggtgaatattgtttgtgtaatcaatccattatgattagggatctatggactacccctgaaggcatggacttctctgtctcgaggcactgttttcttttattgatggattgaccagcacgaaattatttcgcccatttgacaagcttctgccagtaaaaactatccatcataaattacagtataattatttatattacttatttcttttttagctcactcattatagtggtattctaaagttagacaactaagtaaaaattaggctttgggttttggatccaaatcaaacctgcctccttgagctaatatttcttttcttttattttctttttgccctctgggtctaatttctctgtgttgacagtgcatgcaaacatgttgctcattagtgtttatttactactacaggaatcactttgaactcctctaatcctagtggaaatgcttttctcaaaataaacccagatcatattgggttttatcgtgtaaattatgaagtagcaacttgggactcgatagctacagcgctctccttgaaccacaaggtaagagatagcaatggttggaaacttttatttttgttctaagaacagcatcttaatgatattaatttttttcaacatgctttgccttaagaattgtgtttttatctctctttctccctcttcccagacattttcttcagcagatcgtgcaagtcttattgatgatgcttttgccttggcaaggtgcgttttagaatgagactaaattacttaaaatactgtgggttttctcataaatcttttaaaaatgaattaaacattgcagtattaatcaattttagcttaaaatatccaaagccactatttaaaacattattgttttccttaactctcttttcaaaagttcacatgagcctaatagtcaaaatactgacattagcccttaaggtatacacaaaaacaaacctaacttattgactttgagtatggtttgtctatatcaggatccttgagctaattagaagtgacatttgcaaatgatcaaaaatgtaccttcataatttgatttaatataaagacaaacaatgtattttattaattcagttctgtgagcccgagcccagtgtaagattttatggctagaattgtcaaatcttgttcaggtcactggggtaagaagaatgagctatggtgctttagaactgatcagaattaggggaccatttggaaaatttgactctttttctcatagtctgaaggtaacctgctctttagaaaaagtgtagattggaagaactaagtagtatccatggtacctctattttttttttaattcacatagtctaacaccagtaatttaacaagcatttattgagttcctggcactttgcagaagctgaggacacagccaattttatttctctggctttgtagtcgcctcattctagatatgagcaatgtgctaagaatgaggagccacttccctcagtagcctcccatggcctctttctctgggttgggtatccttcttatgggaccctatatttcctcataatattttattgttattgtttattaattgtgcatttcacccatcaaactgaaggttcatgagggtaggcacccaaacccagctcctgactgtacgttgccaataacagttgataataaatactgactaaatagagaggtggaagaatagtatagtagtactaaaggcatggggaaactattttacacagagttcctagatagtatattaaaagtcagaaaaccttgacatatttcaaggaaggaattatggggttcgaaaacaggctcttgaaccccattaaaatcctggttccatatagtcttaagtaagtctcttaacttctctctggctcaattttcttatcaccaaggtagagatgaccttataagacttctgtgaggaataaatgagataatggacataaaacacttaaaagattatctggcatgtagaaactcaatacattgtattacatgaccaaaatgcatccaccgttaattagtagtgaagatgcgtttagaagagctcttctgaatttgtaatctacactcgttttgtagctaatagaaaatatgatgttctagtgaatctccaagtttaacctcctggatatgtaatagattattttcactatattacagtataccactcactcatttaataaataaacattggcgacttactatgtgccaggcactgtgtagaatagaatctgggaaattaaatgatgaaataagatgatcaataagtatttttaaacagaatcatttagtttttatttttaaattgtcctgttccaaagctcagcttcttcactgttagaaattacaaagaactgtactatctctacagtttaatttgcaccacaatgtaggaggtcctttctattccaagatgaagtgaaagaaagcctcttgaacagctctctctgaggaactgagtataaagcaaataacttacactactgaaagacttgctcacatttgctcagctccttggccacagccccataaaattgtgaagagctgtggagaggaagaaaatgaaacaaatttgaaattcaaaacatatgtaggatcacacaagagagctagaaaatacctgtgctatcacctggctcaatgaggttctgcagcacatgaggaaaatgggactcggagagaaacagattcaacgagcattggttagagccaagagggcagcttcaaagaccacataagctaagaccattatgaaactttggtggagggggtggaagagagaagaaatgcgtagttaaataggtgagcaactgtggcaggattagaatttaaacaagtctactgaggtattcaaaggaatgtagtaaccattatatttaataatcagaactaaatgatacatctgaaaataaatgaattttttattcccctgtctcttccaacttgatgtgaagaggtagtactcctactgccctggctgggcatatgactcttttcaaggtaagaaatttacccatcaccactagttcatccaaaccctctcaattccataattttctcagtcaagtaaaatcatcaaagctttctacttcatttaaagcttctccctgcccccagcttaggccaggttcaggccagtcacctgcaatgggaatggggtgattgatttcctcttcgtttctctgcttggaacttctatgtctcccgagtcaccgtgctgcctctggtttctccaaagttaaggcaaagagaacagggtgggagagtaggtgagagggagaaaaatcctgatgtgctgcctacttttggtcctctctgaactttgttgatgtttaatgctgatttttttccttgtgttgtgtttttatgggatttttgttacccatatccattccattgagaaggatctttctcctgcagtttccttgaggtgggcaggtggacacttctgacccacttctggtccataggaggttgtcatgtatgctttgtcctgacaatatttggaagaacaggccaccccatgcagtcccatctcttcactctgaggccagagcagcagccaaatagcctctcatcttttagatttctcagggtgtcagacaccaagccacggtgcctccaagttccaggagacacaggtaaacctcttcaagtggtcccactgaaacctctctcctgagtcttaattagacagaaaaacatctggtgccctagcccttggaggggagagcatttacagtgtactcagtatactgacagcactctttgaaaggcctccactaaaatgtctcaccttagtttctccaacctcttttataggctggtggtgggctatcagcaaagagccacacagtcttgttcttgaccatgttagtcctgctttggggtcctgcgtctttctttggagcattggagcataggacttagtcttggggccttgccaaaacagacacagaaacaattcttccccccaccccgccccctgcttgttacaatagtttttgttgttttttgttttctgtttgcaattactttatattgtcctcttcagcccacttcttgctacagccaggagagggtgggtaataacataagggaaagcagagtatgctggctgacaaggctgcgtgggggcaggagtcactaggtaagggacgaatggcaaagagaacagctgaaaggaccacctaagctaatgatctaagcagaatttcagccaggtttcaaggaccactggctccaaggatatgcaaggtaatggccacgttagcaaataagaaccagcaggtgaacatcagtcaagccaaaatcatggaccttagatacaaacatttttgtaagtgtttgcagagatgaccagagaacaacacagaactctataagcaacttttcccatcctctcatggacttcccttaaaggaagtgagaagatggggaatgggaaaagaatccaaaggtgatttagttaattgcaaaatgactgttttaagccagaaacctgaatttaattggcaagttcagttgagtgactagacagctgggaactttatgcccttcacaccacctgaaaaactagccaaagaacccaagcacatggggtcagttttactcccccaggtacctctcaacaatttttattgtccctttagggagccatgtttgacaagacactatacttaactacttaactcaggcttctctaagcaggactgtgcagtctttccaaattacactcaggaaaacaaaaaacaaaccttctgctgtaagagtcccccaaccttcctaggtgccttagctcaatatagaagagcaagaatgctctcatatgacctttgtcctcttcttcattttatttggtggaaattttaagctatagcttccaacctctctacactatagaatatagtaaacttctataatttaagtcccccaggctgggctctcactatataaacagaatatttttgaacaaagaaaattctcaatcaagtctggccttcagaattgctgtttgtctatggacttaaatggagtttgagacccaaagttgagtaagaatgctagcagtcttgagttgagttccctagacgtagagtcagaaatagaggttcttgtactagtggtttcttgagagagtaatttcatgagacagggaatacaaaaaacaggacagggaagtggggaaagctgagctgatttcaaaaggttctaaaattcttttgaaaggggaagaaagtggattctttaacctttaaaatatcaacagtgtcttcaaattttctagaagagaaaaatttacttttttaatgaatattactgggaaatgtgtaagaagatgttataaaggacaataaaagttcaatttgaatgttttaagcattcaggattaataagaactgttacttatatttcttcttcataagcaaatgtaaataatttcaacaaaatacatttatagtagtgcctttatgtgttaaaatccacttgggaacctaaaatttaaaagtttctatttgtcaatattaactgtacagctaaatggcttttgttttatttgaaattttgctgttgtgctttttcaaatgtacatcttaatgcctttcttcctccttactattgaatgtatgaaagccctactgtataatttcggacaaaactttttgattgggcttcaaccaataaatgcaatttcttgattgttgaatggaagaatcctcattaacatggaatgctttgatcgccaaaactttcagttaaatggaaactaaagtctgtggtttttaattaactgtgagtttttttttttttttttttttttgtctttctcagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggtgacgttaatgctatggtatcttatgaaagtaaatgtttagccattagtagaataggatgctttctgagagaaggagctcttggggacctaaaccatgtttgcttgccaggtggaatcaaaagaaagtgcaatgacttgactaatcaaagcaaagctatgccgtctattctttttcaatttgaagtacatcagaatttgttgttctgcatacataccacttaggtgcattttagtgttagaagaaatacaacaattaatattttacttaaaatatacaacattttaaacaataaatactaattagatcttttttaaaatggactttatctatgttaaagtgaattattcttctaaaatataatattatatcttcttattcttactgctggtatttccacattgagattttatcatatgtagtcattctaaataccgtttctttgctttgtgatttctgtagcacgtaagtaggacacttgtaattttagacaaattctggattcaaatctctagctcttctatttacaaaatgaaagatcttgaacaaatgatttaacatttgtgagtcttaatttcctttgtacattaggaatgccagcacttgcctgcttacggtaatgggattgtgaggatcaaataatatgaaagtgctttgtaaaacctaaagcaatatcagttatttttattatttcatatatgcttaaacaatcttagtgcagaaagtaggttgagtgttttcctatttattacatatgttaactaagaaataggggttaaaagggccttacccaaagttttataaaacattacaggaaggtccgggatggtttatattttcaggattgaaaaaaattgcaatgtgataaaaattaaatacattgtttttctaaggacaagcgcaaagttctctgaattagtaggaaaacagattataacaggggctgctgagtataataattgggatactactgatatgtagtaaattgttacttattgtacataatacttttatttcaggaatacttccaaggtcaagtgaagcctattgcagattctctgggatggaatgatgctggagaccatgtcacaaagttattctcactttttaacaactaaaattcatttaacatttgttttttgttttaagacttgttgaaaagtgcttaaggccctggatttgtgtttgtttgttttttaaggttactccgttcctccgtgttagggtttgcgtgcaagatgggagacagagaagccttgaacaatgcttcctcgttatttgagcagtggctaaatgggactgtaaggtgattactcacattgttatgcttagaagacacatttgagaaaagagtagttgaaatctctgaaacactgtttcttcttctagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtaagttgggcttttatttcacatatataaatagtatttaatagtttatgtgtcacagtctctttaagagtctgattaaagtatgatgttttgtttccaaaaaaatccattaaaagttattttccctgcaagaaacaaaatatccatgtaagactggcctaaacaataaggaaatgtaatctcatatgaacacattctggaggtaggtagcttccagttgtgtgcagcggctcaacattttcacccaggacccaggctcttctctttctgattttcaatgatcgacatgttggatgtctcatgacttccagagcttgaaacattttgtttttacacaaacatgtgtaatggaggtaggacaggagcaaaagagtttcctgacaaggctctgtctcttatgccaacaggacaattgtctccaattctcctcataatccagaactgggtcacccttcatcattgtgagtcacactctgggtctgctacttgatcctttgctcactagggtgaacttgaattcctttggctgatttgagccaattagaattatctgggactggggtagaagtctgttttacctaagatcaaggatatctaatggtatcagagcaaaactgggctctgtgagtagagaaagaggagtgtctgccgcaaatgcatttacactttactcagaaggcacaaagctcatctatgactcatttcccactctgcatttatacttgaaatcaacaggcttcttccttaattcattttttgcttagttatagtgtctgagttatttacttcatttatttaaccaacacttatggtgtcctttctatgtatagatatatagattgtggaaataaaaatgaataaaacatgaataaaaatgacatctatccttgagatacttacagcttcatgggagaggcagaatgtaaacagtaaattacaatgcaataccaatttaaaaggacgaccagaagcagtttgcttttaccaggtagagccaataatataccttcagcctctttcctcagggctatatattaattctcctgctctctgccatgacagttcatcaagaactcgatcatcttggctgggcacagtggctcatgcctataatcccagcactttgggaggccgaggcaggaggttttcttgagcccaggagttcaagaccaacctgggcaacatagtgagacctcgtatctatttaaaaaaaaaaaaaaaaaaagaacttgatcattttcacatttcacaaaacatcactaattcattactttgatggcattgtgctgattgtatctggtaagaaaattagcaagaactttagatgccttagtaagaaccttgtgaactaggggatgaaataaattcaggatcccacgactttagtgcaatttctggaagttcaatagtttaaagcatatcacaacattccctccaaaggaaaagaaatttgttgcaccttgactgacatgccacagaaaaagattattttagtggacttagtaaactttttttaaattttggaagcaacatatctcacatttgagtgtgttactttaaccatttacagagtcttccagtttcaaataatgactggagtaaaagaagattctgcagcaagtccaggctgcagtacgagcttccttggaatccctttcttatttgaaacatgtgattgatatgttgtattttcataaaagtagatttacccacacaactgcaagtgcaaagaaaatgtaggaccttgattttctatctgattattcccaagagttctcacactgctgagtgatgagccagtgagagggagaacaactgatgttgactatctttgtctgccagtctagtttttaaatgagttgttaaactagaattctcattgaaatagtctcttggagtaaatgttcagtcttctagagttccttcccttcctcatggtccttctgcacagggagacatgccacccttgtggtgatggagaaagagacctctgatttttgctgctttggccttaaggtgtttacctattttggtctgggacagagtctgctgagttttcattgatcatattttaccttctggtgcactatctgtcatccagagatgaaagcagtggtcccagtcacttgcttctgttcatgaagtacctgtgctgtatgtatggtatttttgttttcccatcaggtcttccagtgtccctgcctcttattgctaggctgaagaaactgatagcttcccataaacaggacccacaagtcgaaggaaccaggatcattaccttaaactcagtcatatattcacctcaccttgcctacgatgtactatcactctcccatgccattttggcatagcacaaaagtacatgctgaactatagacctgttcttaaggggttgtgttttccagtttcacatgtggcatggactttatttaagcttgagttttctccagtctcatttagggtaaatttctacttcaagtatgctaagggtcttgatatattaataaaagcatacataatttagaaataccttttctgtttgacaaaggctgactctcaaaggctcacaactcaagttgaacagtgatccctttgttgtagttattatctcaatatcttcctaaagatataaatgaattaagccaatgggtaggatgccatggggcagcaagacttgagtaacatgaaaatacatctaatctatcagtagtagacatctatttttgaggttcccttgtcacagtgaacaaaatgtgtgctgaccttttttggaaacactttttcaatacaatatacacttgtaagatcttgggctagaaacgctactctaggtatagccatggcatacaattaaacctatccatttagtcatttaatttatcttgtacttatttgtattcttaattattgccaactaatataaccatataggttacattataggattatttcttacaatctagggaagagcaaacaactgctttcctatagaatataagagcatagatacattctcttaatttactggcttcttttaaaaatccagtgggataatgggaaagtgtgtgaagtactctattcaataaatgctgttttaaaatattaatggttaaaattaacattttaatttttaaattaaaaacaatgtgttttaaaattgtttttggtgcttctaaaataatttaattttaaatgttttatagtttacattccactagtctttaaaatcataggttggtcttttaaaacagttaaacatatcagaaaattttaagttgtctttcatcatttgtcatatttaattaactttgtcagttgatacctcaagaattgaattgctggcatgaaaactattttgtattggaatttagctaagggtgaacattaaaagttcactttgaattgtttttctgtttggcttctcttaggtatttggatttgctcaaggacacgaaccttattaaaactcaggatgtgtttacagtcattcgatatatctcatataacagctatgggaagaacatggcctggaattggatacaactcaactgggactatctagtcaacaggtgggatgatctgatgatggtctgctgttttctttgtttcatactatctactggttccttcatttttctttgggccactgtctctgacatctatacaatatctaaaatggcattattagaggtaaaggatcatggtattatccttccagggaagcaatgtactagttaattttaagaacaatttttttctggaaattattgtttcaactgacctataggattctgagatctggaagactaaattgcattatttttagtttggttaaaacaagttaatacaattctgcctgttgtgctagtacctagcataatgccaggcacatatttagttctcaattaatgtttgattaaagctaggtaaaaattattggacctgggttcaaattagagttctatatcatactgagcttatgtgggtgataactattacctatcctgaccagataatgaaatttcaagtattttgaatgtttcttaaaagggaattatatttcctaggcaatagaacttttaaaatgggaaatagcaaggacaagagcaaaatcagttaaagagatgcctttccaaacttcgtatttcctcaggcccgtgcagaagaaagattgctgctcttggttctgatactctaaatataatgcacaatttccatccaaaaggcagttctttgatagagtacaaaatagaatatagaataaacgtatgtcccaaataaacatataaacattgatgaaaagacctttaccatctgtaatccctacattaggaaatagcctgtgttatctcctcttaatctctcctgtcaatccagcggcactgtctcattgataatgactgccttgtgagaaataccaactctaattataacttttaattattttctcttttctaccccacagctcaccagagtgctattatgtccatttacatttcttttcctgctgagattcagattctacctctagctcccaaccaaaatacactacattgcttctgcctgcttgtgataaatttttaccttttctattcttgtaactattgagtgtcactgttcacccatctctatgaagattggttggtgtgcatgtgagtgtgtgtgtgtgtgtgcatgcacatatgtgcattgttcatcttttatgattgtttaaatgaaatgcttaatttagaatgaatgaatatacctattaagaatatgttattatctagatgtaacagtttatatcatgcaaggtaataccctccattttgaaaaatatatggctagtgataaatactgcatattttgttttagttgaaaagaccatacaactatctctttttctgtggtgtatggtgcaggaaacctatgtagatgaagcataaaagttacttttgagttactatgaaaagacaagtaaataatggtttattttgcataaaatggccattaacttattgtttattgaataaatatttctcaaggcctatttgagtagctatgctgtgatttatttcaaataatgcatttttcatttttaaaaattagttgtttcacttcaggaaaattaagaagtagaaaaaaataggttttgccttgtcataaaattcataagtgtctggccttaaaataaatgtattaggcctggtaaattgattatttttcaagataaaaaaagaagataaactatttccagaagtactccaaaactcttgcccaaggctttagcatttcttcataatctaatgatctaattctcatgagacattatttcaaatggccccaaatgtaaaattgctaataaccacatgtctaatacacacaaacacccaatattaattgtacttggcttgaataaacagaacttccctatgaaaattggataataaaaattaaacaaaaatgagccaaactttatccaaataatcccaaacacttgaacattttccaaatttcaggatgaatagttttactatctccatttctgaacaatttatggtcatcctgaaataaataatcttctatttaaataaagcttttgtcatgtgatttttatgacaactgatggccacactgctaatgtccttgccagtttgagacttagccacaaagtcccaaagatacttcagaaattattctttgcttttgtttcttccaataaactcttagatgaaactgtgaagttgagttgacccaataataaggtggtgtgattttagtttatgacagtagatgaaaaactaagtcattaggacatgattgaaacccttcaaatactacctcataaaccaaacaatttaataagcacttaaaagttttgtgtgtattaaaattatttctttggataacataataatacttgtataaatattgaatccaagaagacaatatttgtaaatttttttcaaattatttaaaatataattaaatccttattttagtttttaaaaataaccaatatgataagcatgcagtatattttcccttattttctatactttatatgatattagtttcctggggtgtacatattttgttctggcatttctggtatttaaacaagtagttgcagttttcactcagcatattcattgctagtttctaaatatgtcctttagacaaaacagaaataaatattacagaaattatagaaggtcactgaaaacattgttttattagctgcaattagcagactttctttgaatctatagaatctcatcaaagcaactcagtgtgatttgcttttttaaattcctgttttcttattgtgaaactggtatgtgttttttgcacaaaatgcatacaaacaaaaataagagtacaaaaattacctgtaatgcaaccaccaagaaataactcctattgtcatattactgtttctccttgagtttttccatggctgtttacttaatttacagaaatggaaacatattataaatatggtttataacttgctttttttcctcatcatcctatattgtgggtgtcttttcatgtctttaagtgtgcatcttcaatattattttgaatggcttaataatgtttcaatgtgtacatacatcttagtttatttagccaatccctatatgttggacaatagaattgtttccctacaactatacgtagtgtattgatgaacagtcttgtacactgaatcctttgttgttttttttaatgtccttgacaatttctttagaatacaagtagtggtagaagtaatgctactgggtgaaaagatgtgtttatttttagggtttctgataaatgttgcagaattgccattctaaaaactgttgctagtaactgcctatgttcccaacctttttcaatgctcagtgttgttatttttatgtatctttgttagttgaatatatgaaaactgatatctcattttaaattacatttcttccatccagtaaatattgtggagcacctactctgtgctaggcattatgactggcattggggatgcagtagtaaggagaagcagacctggttctctgtcgtcatgaagctttgagtagagacaaattttaagtaaagagtcacacaaatacatgtatactttattatacgtaaattattaaagtataaaaaagttcaggtcttaggcaaaaatgttattcaaaatggtagaccatggaatctaaactacataaagaaataaatgcaagaataggaagatctgatggtttaagtgatagaggggtgggaatagtcaaagggccagaagtccaggtaaagtgaaagaacagtcacagtggaaactgaaagacataacatgtcatagagggtgaataaattagcaattttagaggcagatgacttacggatgatcacaaagtatcttaggaatttggtggctgaagtcgagtgaagaaaatatcatcggaaataaggttaaggaactaagagaagagatgttatatcattcatctgtatggatctggaaattacctagaatgatggcatggcttggaggagtcaggtaccagaatgtatcattaaatgcgagggactaacataagggaacagaggtttttaaagaggctggaggaatgctggtctggaagcagcaatggggagcatgagcacactgactatttcctgacctgatgctacaaaggatgtgggaatataaacattctcttaagtgagaatgagaagtagtgttccctgtaaagggacagttccagagggctaggtgaaagggttcaagagcctggggagatctaggaaatgtgtcagaggccagaaagtacacacttttaggggcagcattactaatgcctcagaatcacattttagataatgactgatgacattagggatgaaaaaacatattggctttaaattcagtggcgtctgtgataagagtgggcactggatctggtacactgaaatcatgcttgattactagaacattttattcttttcccattggtacattttcattcctttgctaaattcatgctggcatatttctccctgttaccaatttgtaagggttctttatatggcaaaaatatttgctctttatcatatatattacaacgatttgttctcgattagtatttggcttctaattttgtatatggtaggatttttttttttttttgtataaaactcttttgttacccagactagccttgaactcctgggctcagtggatcctctcatctcagcttcccaagtcacagggattacaagggcaaaccatcacctcccagctcagtataaaagtttttaatttgcataaaacaaactatcagcttttatcttcatgatttctgcttttgcatatatatataggaatggaaacatttaatatttataaaaattatatatatatatatatatatataaattgttttttgagacaaggtctcactctgtcacccaggctggagtgcagtggcacaatcttggttcactgcagcctcgacctccccagttcaagcgatcctcccgcctcagcccctaaagtagctgggactacttgtggggcgcacaccaccacgtgcccagctactttttgtatttttgttagatatggggtttcaccatgttgcccagggtggtcttgagctcctgacctcaagccatctgtccaccttgagatcgcaaagtgctgggattacaggcgtgagccaccgcagccagcctgtaataatttttaaatgtaaaatttatcctattgctgtgtacatattttcttgtatccctcctcaacattccaggggtttaaggtttatacataattttgtgggtttcttgcactgtgattagttgtgatgagattttttttacctctatcacaaccatttgtggtctatgaggaaacttctggttcttgctttttatgaaagaaaatgcaaagagaacaggggtagaatatcatctttaaaattctgtcttggaatttagctttaggtttctctgcttaggcagactgatatagatcataacccccacatgccagcaactaataaagctttttgaaagcagaataaatagcctatatttaaatttctgtaccagtaggaagatgcatagagtattaggataacgatgctggaggtgttctgccgtaacggaaacacagaaaggcagccgctgaaagggcatgtgtgggtaattagttctcactatggttagactcctgaagtgagtggtccaagttgttagcgtgcttctgctctgtgaggccaggccagtatcctgtctgcatggctgaagacgaatcactggtatgtacatgttctagcttgggggaagaggagagaaaaaccaggaagtctaggcaagcaatttccctttatttaagcaaggaagctgcagctgaacattgtgctaatgttctgttggtaagaattgggttacctgtggacatctagctatgagagagcctgagaaacagtctctagcagggcgctcatgtgtgcagaaaaaaaaaaaacagatttggggactacaacaagcagtcttccatatctcagagggtcgtgtcaatttgtctaccaaaagaagtgcagagtgtactaagaatttatcttgaatagaatgattttaagtaaaatgggttttcttactgtgttttgcttactttgaaagttacttttaaaaactatgaaataaaaaggaaacatctgcatttagagaaaatatgtaacattctgagcacttacacttccttttactctaaatttctctccagatatacactcaataacagaaaccttggccgaattgtcacaatagcagagccattcaacactgaactgcaactgtggcaggtatgaagataaattcctctgcatttgtccaagaaggagcagaatgaaacttttttaaaaaaaattttactttaagttctggaatacatgtgcagaatgtgcaggtttgttacgtaggtatacacgtgccatggtggtttgctgcacctatcaacccgccatctaggttttaagccccgcatgtgttaggtatttgtcctaatgctctccctcccctttctccccaccccctgacaggccctggtgtgtgatgttcccctccctgtgtccatgtgttctcattgttcagctcccacttatgagagagaacatgcggtgtttggttttctgttcctgtattagtttgctgagaatgatggtttccagcttcatccatgtccctgcaaaggacatgaacttattctttttatggctgcctagtattccatggtgtatatgtgccacattttctttatccagtccatcattgatgggcatttaggttggttccaagtctttgatattgtaaacagtgctgcaataaacctacatgtgcatgtgtctttatagtagaatgatttataatcctttgggtatatacccagtaacgggatagaatgaaactattttttcaaatagaaatgatattttctcaattcaaatcacagaagacaatgagaaagaaaattctttttggttttgtatttttaaattgtatatatttaaggtgtaaaacatgtctttatttatcttgataagtatacacagtgaattgagaaataattcttgtatctaataaaatgtacacctattttttttctaaacataaaacaattcaaagagcctctaagaaagtttaaaagctgcaaaagttgaggtggcggggggctgagaaggccacaccagacagttcagctcatgaaatcatgggcagaaagtctcgcctctcctgtaaatgtaactctggaacaagttggtcaagatttgattccattcagaattcatagttttgcaatttcaaaactaatctcaaatctttccggtttcaaatatctcaagtccaaaggaggagaaatgtctattaatgttgaacaggtagagattgtatgaagtttcaatatctgtgtgttagatattgaatgctaagagttttctgtatgttaaaaagccaaattattcttatttttatagcaaataatcctagtatggttgagtttggggtagggctttggaggtcagagggagtacagcactaattttaagaaagatttgttttatgagtccttaataagtgaactgaaagtacattaaaatactccagactcctggagtgaaaggctaaggaaaaccatcactccataggtgagattttccagggaacaccttggggaattcagagaaaatagagaaagcagcagaaacagaaatgggcatgctagcgactgacatgctgccatccttctccaaaatgtcagagcctattttggcttgacatgctgtggggatccaaaagccatgggtaactattgctaatctgagagatgggttcagtctgaatgatgcgccagaggtgtagctcaacgttgtgcagtgatactgaatttctaggtaagaagaaagcaaatccagtttgtgaatgaaattcttgaagactaatttggctataaatgacaatcctaattactcccctctcttttctagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattctatttcatgccttttccttttgttgttctatttcattctattttaagcattaaaactgagaacaaattgtttacttcttttcactccacacgcgaaagagttgtatgtactttgtcagaataagtcttctagaccatcaggtccttctcaaacaacacctgttttttaaaaggctgatgcctaatagatagatctatgccaagcacagtttattactttgcttgcttggttttgcacagtattcacaggggacaaaa

SEQ ID NO: 12026 - DNA, 168104 bp, Human
  misc_feature (1)...(168104): n = A,T,C or G
aaagcgatttgctccatgattttcagatttcataatttgtgtagctacaagtttaggcacttttgtatatgtcatctcattcatcctcacaacaaccctaagggcatacaactagtgaatgggagagccaggaatggaacctggatattcctaatgtctgagtcctatttatttcactatactatgctgctttgtctatcagttgtataaccctgggcaaatcacttagcctctgtgaccctgcattacctcatttgtaaagtgagtatgacgattacttccttttagagttgtgaagctcaaatgtgctaatataaagtagaaaacaccggtagaaacaccggttgtggttatggctgataagtgtaccaaagtgaagtaatgtaaaacagtatctcttattctctcttcagttaaagagattagcagcaaaaaagaagccaaggaagatgctcttgaataagtggttactcaccagacctatatggcttgctcttgttagctggcctttgccagaaggagtctgagtagaattaggagttccttgggaaatttctggaatggtttgcttgtggaggcaatagtctaaaaacttaggtggggctaactccatcctgggtcttgttcagttgtccctcctaccacggggactgctatgataatggtaatgggtgtaggcctgatagagttgtggtttgttgtaatgggaagccatcgtgactaagaaattaagaccaattcgggcaaatacatttattgaggcctctgtggtaggctaaactatgagggagataaagcagtgagtcagccccttgtcctcaaggattttacagtgcagtgaggtggagacaaaccctcaactaacgcttacagataaggcagagtataaaaacggtcacatcagaacaacttagaggtggggtgtggagttcctagaaggcttcttgaagtaggtggtatatactctgagactttgaagatgaatttcaagtaactgggtattccaactgaaggttggcagcatcagaaggtgtaggatgtgttatgtttaatataggcaggaacgaaggcctttactgagcatgcactgtaatgctagggtctgacgatatagaaatatattgaaaacagttcttgccattgaggagctcttaatctagagggatagataggtgtaaactgtcattagggtgatgacttcacaaggtagagaagaaaggttataaaggagagtgtgtaactctgacataaggaagagaaaaagatactttgcaaaggaggtgaaacttgaattatgtcctgagaaagaaggaggagtttgctaagtggatgatgggagaagctaggagtgctacaggcaccagcgttcccttgttaaacaatctaaatgtgacaggcaccaggcaaatacatttttgcttcccctttccaaatggattttggctgtgggagggaatgacttaatgtcttcttttccaatatactagcagatggttaaatatttacagttagacttggattctaattcagctatataattagctgtatgaccttagtaagacacttatttgtgtttcagttccttcattcatacaattcaaaaaataagagtctagtacagagcctggcatatataaagtgccattattattttctatcattatctcatttagtctttgtaagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacaggtaacgccacacgcccgtccgccgggcttggccggccggtgccccctcccccaccgccctcagcttcgccgacttcttggcttgtgggccaagcaggcagcttcttggcttgtgggccgggcggccggtgtgtgtgagggaaagcgggtgcgactgcgggagggcgccctccggagccggagcccccctgcggccgccgcgacctcgcccagggtcgtcgggcgcctcctgccccgccccgcgcggccctcgccgccctccgcgccgctgccgagtggactgtgacccggccgcgctctgccggtgccgggccggctcccgcggggcagctttcacctacccaggaagtttcctcccacagggccgcacgcatcccaggtgagctcctgttgagctcgcgcgggccggccgcacccccgggccgcacgaggctcgcccgccaggccggctgcgcgccgcccccagtaggagttgccttccagagccggacgcgcaggccccccaagccagtctttcctctccagacctgcctttctcccagggtccgacggaagccctcccttcccagagtttaatgtagttagcctcgcctccaaagaagtctcatcctactcaactacccactctgccggccccttcctccgttcagcctctcccccctcctgatcaggtttccttctgggtcagacccccaatgcagccttttgccacccacgtctgcttccacttcaacttcccctcggggggctcacgcctgatcgctgtccaggtggatccctttaacgggtgtggtggctccgccagtcttggtgccaggaacggcctcccggggagcacttttcttggggggaatcctcagcaaaacctgttctcgagcttccctcttgcctcgttgcttcctgtcaaagtccagtccttgtgcttctcagaaaacctctaaacatcactcacactgggaacctggtccctccctctctgtaaagaagccaattacaatgtaaacatggtgtccgggatgataaggtgacagacacctgccagttccttcctgctcctgtgacccaaactctcccccgcgtctcctcagacggttctctccagagctggtggcgcgtgcttcccgattggggcccatcccgtcttccttgcctgcattgtggtatctcactgccatcttgtactccttggcctagattcgtcggtgcttctaaggctttagcgctgggatagggcaaacatttcggcagtggagttttctgtgtttaaaatcaagaggctttggggtgctttgcctagcactgtaggatagagagaaaaaaatgttttctcagaaaccaggagtcacgtacatgcttcatgtaaaataactaacccgtgtttgcaggaattctaagtgtcataaggaaagtctatttcccagtttttttgatggtggtggtggttgtcctgttctgacaagcagagaaccctttaacatggaatgtggtggtttagtcttggttatgtatgtttggaagggtcctcccaaaactcaaatttgaacaactacagcactgacttttaggtattcactttctgtgagtctagttagtgacttgcattaaacaagatccctgttggcaggctgttgttttctggctctgttggccaattctggcaggagttttcccttgaagattttgtgctcttaaagacttccgtaaaattgcttctcagttgtgtgcatactttattctctccctgggtaataccatgtttttagcttctatttacatcattcatctctggagaattgcttcaagctctgtcagttttatagccatttaaaaaatttacatatgttcttgggttatatatttaggtattaatgtgtacacagtaagtacggaatcagtagtagctattatccttcagtgcctcacatatgagataatatacattggtggttaatttttattgataattcaaataagtaaattcagaatattctgattttaaaacatgaagaggcaataagagggattacgaaggcacacgaaaaaataacatttccagttgctagtataccctaatgtgcctccttgttacttcaaaactttgcagatttgtggtttttaaatttaatttaatttttttataactgcctgagcccaatacactaagataacaatgcagcctggtttcacattcattactgacccgtttgtcatcctctgttccccccaccctgcccactctcccagcacacacatttagacataggcatactcaagtgagagctcattcagggcagggacatcttttaatccatctttctcccatggtacctatctggaagaaagtaattaataactgttgtaggaatgactgaaagctctaaagggttctataacagttatggagattaaacatgctcaagttaatttctgcttctgttcatatgttgatgattttcattcagcaaatatttttatagtacctattatgtactagacattgtactgggattatcgtgtttataatttcttgcctttaccaattaagcaaaactgagtttggggaaaaaatgtgaaaaatgttttagcttatgccttccttcctttttccaagcttgccaaccaacccttcaactccccagccaccaaaataaattatctaaattattatagtctagcttctagagatgatagaatgctagagtaccaaaatgttagttccagttctgctttggccacagctaactgtatgggtttgggttaaatatccaggcctcagttttcttaactttaaaagagactcaacaaacatttgctgagcattcagtatgtgctaggaattactctaggtactgaggatatatatactcatgaacaaaaatagttaacaattctttgaccttggagacaaaacctggaacttatttctgctagaggagtttgaattagctgatctaaggacctttccaacttttaagatcctgttttatagacagtgttctatgatttatagacctagtggactttctctgggttctttagtgctttacagccttaaatgttttctaattcagttgtctttactaggtgttctgtttacttcttgtcaatgagaagtaaaacctgagggagaaagatcttgatttttgcttctgttggtagattagaaaaaaagcatgtaatacttaaaaaaaaaaagtttccaatagtcagttttactccctaacgcccatatccctaataataataatactgttaacttccctttgggaattactatatgccaggaattttactacacttagaatctaacgatatgttttacaaattagagaagctagtaagtaagctagtaagtggtgaatctacgatttgaaccaaggtctgtaggacttcaaaagctatttcactgttcttctctatgtactagatgcttggcctatccaacgctcccttacattttttgttcttttttttcggcatatgccattgtcttaagtagtaagcctcttgaggatataagccatggtttttgcctctgaatctctagtgcctttgataatatcttggatgatacaattgtgtgttcaaagttagtgctattgatgataaaggttttattttactgagataggatttgaatatttaaaatagtcttttagcaattcagctttatactggttttcttgctttagtttagcaagaatttttttttttttttgttttgttttgagacaggatcacactctgtcacccatgttggagtacagtggcatgatcaggctcactgcatcctcaaccttgtgggctcaagggatcctcccatttcagcctcctgagtagctgggactacaagtgtgcatcgccatgcccagctaatttttaaaatttttttgtagagacagggactcactcactatgttgtcagattcttttttttttttaaagtaataaaaaagcccttaagtagggacttaattttaaaaatcctagtatataaatggtataacaacagttctaatgctttttttgttaaattacaagagtgatataactgtattacagaaaacttggaaattagaggaaaacatctcccataatttcacagtttgtagtgtttattttcagtttcattttttaaacaagtacgcagtacaagtgctaataaacatatcatcttagtagtctggtttaacaattatgacagtaaatacaggttagtttgaaaatgacaacatgttctcagaagcagaaaagtgatattgttctcaacatgacagatatttgagttcctacaatgggaaaggcacattaatgatgtttttctttattgcctataattatggttcgatatactcaggaaatctcttgagagagatatctaacccttctcaaagatggcttgaaatgttcagcacttgggagaggttgtcatagttaaaattaattaggaacaagttcatccaatagcaagtctctcaggaataatctaagagtgcattcctttgttttcactctatttgcagacagaatgctagtaacagactaacgtgtaatagaaaaagattgagtatcattagcaacgaatcatagttcagaatctctgcaatctctaatagtgtgattttaaaggcctaatctaagatattttacttgttctttagggaattacaaaaagcactttatatacttgtttgtgagtttggggcttaataaaattgggagcagaaaagataactattgggtactgggcttaatacctatgacacaagtccactgatgtaataaaccttcacatgtacccttgaacctaaaataaaagtttttaaaaaaaaaatcagtactctggaaaccaaaaccaagtaaatggcctgagagagatctggttagttggagaactggtagaaataataaacgaaaagttactccaggcagagttcattaggcaaattcatatgctggagtttcatttttaaagcagttgaatcaacaaggtatgccttcattaattatatttattaggtgtttttaataatctgaggaatcttgtaaattgaatgctgtattacagtaaagtgaactttttttatttagacaaatgatctaacccagttaagcatgcgtagaagaaagcctggaagaaaaaaaacactaaaattttatagtagcatggttgtagtttttatctaccttgttttcaacagtgagaatgtattccttctgtaatcaactgatttagcttttctctatggcatttttgagaatttattcatttaaattgaatacacaataactacgtgtaaagtaaagctttgtgttctaagattgtgtctacacttagttttcatcctaaacatttagagaaattgattagaggaatgataataattatattaattgatttggacaattcagttagaggactaatttataattttttgtgctgctttataacttaacaaagcgtaacctatgaactaagctattattatcatcatttcaaattggaggatactgaggctcagaatttgggacttaggttttatagttagtaaattaaaaaaccaatataaattcatggttaaaaaaattcatacaatgctagtgaagtcttctttctgctttaggccctcatttgctttcccagaggcagccattcttgccagtttcttgtgtgaatttccagtaatagtctgtgtatatgcgaataaatatatatgtatactgtatatgtatattcttttgtgtaagctgtttattgtttcacagtttgttgttatattatttttagcttaactgatttaggagattgctctataacatcacatatagatctcccttattgttttcaaaacctcagggtatttctatatgtgaacttactgttatttattttactggccacctaatgctggacatttattttgttttcaatcttttgttacaactatgctgcagtggatactcttttacatgtttttgtgcacatgtgtgagcatatggattaatttctagtaggtgtaatttttgggccagaggatacttttaatctgcatagatactgctaatttggggtaggcatagtggctcaggcctataattccagtgctttgggaggctgaggcggaaggattgattgaagccaagagttcaaggcctgggtaacatagtgaaatccatctgggacaaaaaaaaaattttttttaattagctgggcatggtggtgtgtgcccgtagtcctagcaggctacaggtgagctatgattagcaggttacagtgagctataattgcaccactgcactccagcctaggtgacagagctaagaccctgtctccaaaaaaaaaaaaaaaaaaaaaagatattgctcatttacattcagaaacactgtagcagcacacatgtttgagagtgtcatttcctccacagcttgatcaacatgtatattattgtcagtccagtaatcagaaagatttcaaacaatttcattgttttagtttgttatttctttatgggtaaggctgaacttatttttttttcctttgaaaccatttgtatttctttttttataaactgctttagtcttttacctgttctcttgatgggctgtttgtcttctttctcactgatttgtaagaactcttcttatatttaggaaatttgcccttctttgcaaaatcctttgcaaaatttttttctctgaatttttttttgtttttggcattttttgattatgtagaaatatttgttttatatgtttaatttgtcagtcttttctcttagagcttctgcaaaatctagatttttaaacttcaggagcagaggcagactaatataactgcaagagcacacctgttctgcccctgagtagttctgtgatcttgggcaaattacttaacctcttaagtgcactcatttgcatattagaaataaactactgagacttcttgggtattattgagacctcttaagcatgttgtgattacaaaatgaactggtgacttattttctttagctactcctgtagtttcccaatttgttaaaagctggccttgtaccctgcctcatatactctgctttcctatcacataaatgtgaacttctgaatattttgtgcaaaagtaggatagaaatgaggtagaagaaactcatttttgtgatataaataaggctttcaaatgaatcagaggtgcaattaaaaaataaaagttgggctctttttaaaacttgtttttatgtggtaaaaatatacaaagaaaagtaagcctcacttcctccctcctttaaactggggattattacaatgggaatataacagtaccaggagtttttcatctgaaataatcaaactgcttattccttactaaatctgcaataagaatacaaatttgaccaagaatgctaggataagaacatattttttggaggaagacgtttatattacagtactttatagttttttagatcatggtttctcagccttggcactttgagattttgggctggagaatttcttgttgtgggaggctgttctgtgcattgtagggtgttttgcagcatccttatccattagacgtaacaccttcaccagttgcagcaatcagaaatatctccagacactgacaaatatttcctagaggattaaattgcctctggtttagaatcactggtttatttatttatttttattttaaagttttagtacttttgagagagagtctcgctctgtcgtccaggctggagtgcagtggtgtgatcttggctcactgcaacctccacccctgggttcaagcaattctcgtgcctcagcctcccgagtagctgggattacaggcgtgcatcaccacgcctggctaattttttttgtatttttagtacagatggatttcaccatgttttccaggctggtctctatctcccgacctcaagtgatcctcctgccttggcctcccaaagtattgagattatagtgtgagccactgcgcccggccaaatcactggtttagatatatacttatttatttattattattttttgaggcggaggtctggctctgtcgctcaggctggagtgcagtggtgtgatctcggctcactgtaacctctgcctcccgagttcaaatgattctcctgcctcagcctcccaagtagctgggattataggcgcccaccgccacacctggctaatttttgtgtttttagtagagacggggtttcaccatgttggccaggctggtctcgaactcctgacctcaggtgatcctccctcctcagcctcccaaattgcttgggattacaggcgtgagccatcgtgcccggcctagatacatactttctgtggtccattaggacatacaagatatactttctaggggtgaggacaggggaaagagtttatcttcatatttttattcttaagcctgccatgagccatgattgactccttgtgcataaatattgagcttaaaaaacttaaatgagaaggcaacctgaaattgtgaacttaattttatgtgtgatttctgtgccttttttagtgtgatctcctccctcttccggctccactgtagtttggaaacttagtgtggtcttcttttagttgtggaacagttctatctagtgggctaagtatcaatacagagatcctggaaggaaaacattcttatgccactgttgagaaggaagaggactgatgcttctagaacacctaataaatactaaatacttttagatgatctacatacattatttcacttaatcttcatagcctttctacaagtaggcattaatcttctgtattacttgctcacggttgtattttaagtgggagagttgagacttgaacccaggcacatctgttctccaagtacatttgctatgctgcttcctatagtcattgatgatatttcagtcaaattttgggataagaatgaacattcatgtgatcttacattcctctattgttatgtaaaagaaattatccagtggtgtgtgtgtgcgtgtgtttgtgtgtattggggaggaggtcaatagtgggataataacaataatacttactgagcacacttacgtgtcatgtgctattttcaataatctttacaacctgatgaacctttcagtattctttacaacttggtaatccttatatccctgttttacaaaaacaaaacaaaataaaaaactgggacacagaggtgaagtaatttgttcaaggtcaaactgctgctaagtggtagagccagaattgtaacccagtagtctaagcaactcggatattgattgaatgagtctgcatttttaagggcaaaatggctctgacagagcttattgtggtaccattccttggttatagctgaacatatgttgtaggctactacatcttcctatgtgaaaatcaacttatcattgcatacaccacatctctagaaagtgattgttgcacgaagttatagtggaaagtttttgtagacatagtagaaggtagtttttcattttgcaacctccagatttattgctcatgaaaatctaagcttgtctaggttagtgtacatcataccaatatttacttttaagctaatattctctcagacatggttatttggacttggagtttctacagtattgtattgctaaagataaaatgtatcagagactccctataaaatagacttttattgactaaaacctggaaccattagctgtaatgatttctgatcctcagatgaacatttttgagaactagcataaaataatgagagagatcttgggctctgaagttagaatgtcttaggtaaattgatagattttagttatatgagccattaatttttatgaaatgttgcacttaattagaattttgatggatcatttatactaaggattattgataacttcattccatcttttgttctgtaggtacaacatagatatagcattatgcatatataaaaaatatgaaattatatgcattaaaggtgcttccagtattgatggttgatcctctgtttcagaaaacatttactagatgcctcctgtgtgtcactactctagtaagccttggacatacagaataagaccatgacatttgctctgaagtagcttttggttttttagggagataaacactgactttcttgtgtgacaagtactgtgataaaggatgatagaagtaaggcaagggggtgccatgagagaatactgtgattatgatgaaacttttggtggtaatatagtttttaattatttaatggttttataggatccagggttgttactgtagaggatatttaaactgtacttgaaaggataacataaatctataggaacatttgattcaagttaaattgtattttggtgcatagagttcatattgtgggatataacatcaattttcttatgagattccttgttttatcttttttttgtaataaaggaagaatttttaactttgaccatagagcataggaaggggactcaaggatagacttcaaaagatctgtgatctactccaaaacagtaggtaaaatattttatatatatattttaacagagtgtcaagattctcatcccagggacactgagagaagttttacgtagtgggaagaacactggatatagtacaagacaaacctggattgaattgtagctctgccatttgtgacatctctgagtgatcatggcaaattacttaaaccctttcatttgcttatgtatgatgtatacacattgttgagatataggagacatttgataaatagaattgcttgtattattattaatacttacctgcagaatttatatgtatttgtttaaattttctctttctttctttctttctttctttctttctttctttctttctctctttctctttctctctttctctctttctctctttctctctctctctttctctctttctctctttctttctctctctctctctctctctctttctctctttcttttcttttcttttcttttcttttcttttcttttcttttctctttttgtgactgagtcttgctctgttgccaggctggagtgcaatggtgcgatctcagctcactgcaacctccacctctcgggttcaagcaattctcctgcctcagcctcctgagtagctgggactacaggtgcacaccaccatgcccagccaatttttgtattttgtatttttagtagagagggctttcaccatgttggccaggatggtctcgatcttctgacctcgtgatccacctgcctcggcctcccaaagtgctggaaatacaggcgtgagccaccgcgttgggcctaaatgttttttcatttccagtattcttcactcactaaagaaaacttggaacatgcatgtcgaaaagtagaagatagatcaccatccacaccattctttaaattttagtcttttacatcgtttcttttttttccaaatgtagttattatctctctttcatacacacacacacatatatatgtgtgtatatatatgtatgtaacattttttattctgttctcctttttttttttctgagatggagtcttcctctgtcacccagactggagtacagtgacgtgatctcagcccactgcaacttccatctcccaggttcaagcagttctcctgcctcagtatcccaagtagctgggattacaggtgtgtgccaccatacctgcccaatttttgtatttttggtagagatggggtttcaccatgttggccaggctagtcttgaactcctgatcttgtgatctacccgcctcagcctcccaaagtgctgggattacaggtgtgagccactgcacctggcctattctgttttctttaagtgttttcctatgtggtctgcttagcatctttttaatgtctttggagcatattaattgattgtgtgctttatagtttaagccctaatgtgtacagatattttatatatgtccactataatttatgctgttgcaaataacctttgctctaccatttgataaatttttttctgtagagttatatgtggtacttattatattattgaattatttttctatgtatacatttgagttttgaaatcaaatgagtgaatttttagtttatattttaagatcttgaatggtaaagcagacagcagcaagggttaactcgagcaataatctgaaaaatgctattctgaagggattaaaccgagcatatttaatttggttgcaagggccatttatagtttgtcagagttcacttagcataggaaattggcattaaaagttgtgagcttgaagaagattgaaatatttcagtttgtatatacagttttcacccttctctgcagtctgtattgctttcattcttagtttgttctctacattcttagtttgttctctacattctgttctgttctgtttttttttttttttctggcacacttttatgcggcgccttgtaagatctgggggtggattctggaccatctggcacttcagaatagctcaaaaccttaactctcttgactctactttgagccatacttgcttgaaatgtcctggtttgtctctctgcttggcacgttttctgctttataccctcagagctttttatgactaatttcttccttaggacaggaattttaagagtaccagtattcataagttaaagtggacaagacttatttcactgtaaaattcaccaaaaaaaccctcataaactttgcaatctgtttttaaatgtataattgacatgagcacttatgtctgtttgataaatatttaaaatattcaaaaatggaattttttaaggtactgcttatagtttttctttgattatgaggccagttaggaaagtgtaattctgcaaattgtaaatctactgagttgatttctagtcctagctttaaaatacttcatatgtccaaattaataataagttaaaaagatatacctgcatttaaaaatatgagccatctaccaattccaaaaagctgtggaggtagttaatgtataaaatatttaaacattgttggctgggcacggtggctgacgcctgtaatcccagcactttcggaggctgaggtgggaggatcacctgaggtcaggagtttgagaccagcctggccaaagtggtgaaactccgcctctgctaaaaatacaaaaatcagccgggtgtggtggcaggcacctgtaattctagctactcgggaggccaaggcaggagaattgcttgaacctaggaggcagaggttgtagtgagccaagattgcgccattgtaatccagcctgggtgacagagcaagactccatctcaaaacaaaccaacaaataaataaataaataaattgtagtgagccaagattgcgccattgcactccagcctggatgacagagactccatctcaaaaaataaataaataaataaaaataaaataaaatatttaaacattgtttacttttattaagagactttttttgtagctttatgctccattgttcttttctaaaatttttattttttactttttaaacagtttaattgagatgtaattcacataccatacaacttaccctataaagtgtacaattcagtggtttttagtctcttcacagatacgtgcaaacatcaattttagaacaattttatcacctcagaaagaaacttgtacccctcagctatcaccctcccatattgcatgcttcccccagcctaagcaactattaatctactttctgtctctatagagtttgttattctggactttgtatgaatggaataatataatacatatactcttatgactgccttctatcactttttgtggtttatctatgttgcagcaagtatcagtaattcattcctttttttggttgaaaaatattccatcgtatggttataccacattttgtttttccatttgttcattggtggatatttgggtggtttccaccttttggctgttatgaataatgcttttataagcattcatatacaaggttttgtgtaaatatatgttttcacttctcctgggcacatatctggtcatgtggaaattctgtgtttaatcatttgaagagctgcagatttttttttttttgagacacagtctcactctttcacccaggctggagtgcagtggcgcaatcatggctcactgcaacctctgcctcctcggttaagcgattctcctgcctcaccctcccgagtagctgggactacaggtatataccaccacacccggctaatttttgtatttttagtagagacagggttttaccatgttgtctgggctggtctcaaactcttggcctcaagtgatccacccgcttcggccgcccaaagcactgggattataggtgtgagccaccacgctcggctgctgactgttttagagcagctgcaccatttatatttgtaccagcagtgtaccgggatgaggatttctccacatcctctccagtaattgttattagctgattctttgattttggcttactttttttagtatctcattgtgttttcgattttcatttctctgatgattaatgatgtcaagcatctttttatgtgcttattagccatttgtatgtcttctttagagaaatgtctatttatattctttgcctgttttaaaattgagttgtctttttattattgagttgtaagaattctttatgtattctagatagaagtccttattagatacgtggtttgcatatattttctcccatttcatggattattttcttgatggtgttctttgaagtactttgaagtttttaatttaattttaatttattttgttttcagacagggtcttgctctgttgcccaggctggagtgcagtggtacaatcacagttcattgcaacctcgacctccagggctcaagtgatcctcccacctcagcctccccagtagctgggactacaagtgcacgccaccttgcccagctaattgtttttatattttttgtagagatggggtttcaccatgttgcccaggctggtcttgaactcctgggcaacatgctcgctttcgcctcccagagtgctgggattacaggctgacataagccaccttgcctggcctgaagtttataatttttataaagtctaatttatatatatttttcttttgttgcttgtgcttttggtgacatagctgagtcttttggcaaatctaaggtcatgaagatttatccctgtgttttcttttaagagttttatagttttagctattatatctaggtccttgatctatttcaagttgatttttatatatggtgtgaggtaaaggtccaacttcatttttttgctagtggatatcttttgcttgtgacatggtattccagcatcatttgttgaaaaggctattctttccacattgaatgatcttggcactcttgtcaataatcagttaaccatagatgtatgatttagttctgacttaattctgttccattgatctatatgtcctgtgcagtacaacactgtcttgagtattgttgttttgtaatacattttgaaattgggatgtgttagtcctctaactttgcttttttattttttattttttgttgttgttcacttctgttgctcaggctggagtgctgtggtgcaaactcggctcattgcaacctctgcctcctgggttcaagcgattctcctgcctcagcctcctgagtaactgggattacaggcgcatgccaccattcctggttaatttttgtatttttagtagagatgtttagtagagtagaccatgttggctaggctggtctcaaactcccgactttaggtaatccacccgcctcagcctcccaaagtgctgggattacaggcatgacccaccgcgcccagcctactttgcttttttctttcaagattgtttcggctattccggattccttgcaattctatctgaatttcagaatcagcttgccagtttctacaaaacagtcagttggaattctcatataaattgcattgaatctatagattagtttggggagtattatcttaacaaggtcttctgatctatgaacgtgggatgtttttcctttttatttttaacttctttaattttgttcagtgtcttgtagtttttagagtatagtaagtcttgtacttttgttaaagctataacaaataaattgataagaaaactgtttgatgctattgtgaatggaattcttttttttttttttttgagacagagtctcactctgtcgcccagactggagttcagtggcatggatcttggctcactgcaacctccacctcccagattcaagtgattctgctgcatcagcctcccgagtagttggaattataggcaagcccccaccacgcccagctaatttttgtatttttagtagagatgcggtttcaccatgttggccaggttgctttcggactcctgacctcaggtgatccacccaacttagcctcccaaagtgctgtgattacaggcgtgagccaccgtgcccagcctggaattgatttcttaatttcatttacagattcttcgttggaagtgtataaaaacaaaaatttttttatactgatcttgtatcctgtaaccatctgaacatatttattacctttagtagtttttagtggataccttaggattttctgtatataagttcatgtcctctgcaaatacagatttacttcctcccccaatctagatgctatttcttattcttgtctgattttcctggttagaacctccagtataataatgattagaagtggcaagagtggacatccttttcttgtacctgaagcatacgtatgtataatcaatacctcaaaagtgcctagttcagctatgaaataaaactagtgttatttgaaagggtttttttaaaagtatttatttatttttatttgccactatactaatgaggaagaaggggtttctaaattttgtcatttatttatttgtttgagacaaggtctttattgctcaggctggagtgcagtggtgagatggtggcttactgcagccttgacctcctgggcttaagtaattctgcctcagcctcccaagtaactggggcaacaggcatgcaccaccacatctggctaatttgtttgctttttgtaaagatggagtctcactatgttgcccagggtggtctcaaactcctaaggtgcaagtgattctcacatccttcgcctcccaaagtgttgggagtataggcatgagccacctcacttggccagagggttgttttaaattcacattttaattatgttgcttcagaggggttcttgagggtggtccttatactatcagcacctgaaaacttgtttgagatgtaggttattattagactctcccctgcaactctgaaaagaaccagggggtgggaagttcacttagccttttgcatggtaaatgtagtttatcttaaaattaataatgtggcagggtgcagccgctctcacctgtaatcccagcactttgggaggccgaggagggtggatcacctgagatcaggagtttgagagcagcctgggcaacgaggcgaagccgcatctctactaaaaacacaaaaattagctgggcgtggtggcagacacctgtaatcccagctacctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttcgcttttgttacccaggctgacaatggtgccatctcggctcactgcaacctccacctcccgggttcaagcaattctccttcctcagcctcctgggtagctgggattacaggggcctgccaccatgcctggctaattttttgtatttttagtggagacgggtttccccatgttggccaggctggtctcccactcctgaactcaggtgatctgcccgcctcgggctctcaaagtgctgggattacaggcgtgagccaccacacccagccaatacaaggttttacatttatggaacatgtaattttcacaaagactatttatagtacgttttttctttcttttgtgttttttaatatatgaggaaacaccccagagagattgtcaattttctttctttattttttttttttgagatggagttttactcttgttgcccaggctggagtgcagtggctcgatcttggctcacttcagcctccacctcccgggttcaagtgattctcctccctcagcctcccaagtagctgggattacaggtgtgtgccaccatgccctgctaatatttgtgtttttagtagagatggggtttcaccatgttggccaggctggttctgaaactcctgacctcgtgatcctcccacctcagcctcccaaagtgctgggattacagacgtgagccactgcacccgacctacagattttcttttaaaaattagctgggtgtgatggtgcacacctttaggtgcagctacttgggaggctgaggcaggaggattgcttgagcttgggaggtcgaggctgcagtgagctgtgattatgccactgctctctagagttgagaaaggcaagaccctttctcaaaaaacaaaacaaacaaaaaccacaatgaaataccacttcatacccattaggatggctatgataaaaaaaccagtaactagcaaatattgatgaagacgtggagaaatgtactactgatgagattataaaattgtgcagccactgtggaaaacagtatggcagttcctcaaaatattaaacattgaattaccgcataatcaccatataatccagcaatttcatgtctgagtatatatccaaaagaattgaaagcagtgacttgaacacatttgtataccagtgtttatagcagcattatccacagtgaccaaaaggtagaaataactcaagtatcctttgacagatgaatgagtaaacaaaatgtggtatctacatgcaacggagtatttttgactcttaagaagggatgaaattctgatatatgctacaagaaggaaaaatcttaaagacgttatgctaaatgaaataagccaaatgcagaaagacaaatattgtacgattacatgtatatgtggtaactagcatagtcaaattcatagagacagaaagtagaataattggtaacaaggggttgaaggggagttaagtgtttaacatgtacagatttccagtttgggatgatgaaaaagttgtggaaatggatagtggaaatagttgcacaataatgtgaatatacttagtgccactgaattctgtacttgaaaatgtacaattttatgttatgtgtattttaccataataaaaaagtagaacaaaaatgagaaaaggacttgaatagagatttctctaaagaagatatgcaaattgccagtaagttcacaagaaaattttcaacatcattagtcattagggaaatgcaaattataatcacaatgagaagccatttcatacccattagggtggcttttatcaaagaaaaagaaggaatttggagatactggaacccttgtgcatggctcatgggaatgtaaaatgagctgatggaaaacagcatggcagttcctgaaaaaaattcaaaataaatggttcagcaattccactcccagctgtctactcagaagaattgaaagcaaggatccaaacacatacttgtacagtaatgtttatagcagcattattcacaagaattaaaaggtagaaataacccaagtgtccgtgaagagctaaatgaattaaaaaaaaatgtggtgcatgcataaaagaaaaggattaaaattatcatacatgctacaacatgaagaaaccttgaagacttgaaatgaaataagccaaacacaaagggacaaatattatgtttgtttttatatgtgtcttagtctgtttttgctgctataacaaaataccaaaaactgggcaatttagaaagaacagaaatttatttcttccagttctggaggccaggaagtctaggatcaaggtgctagcagattcagtgtctgatgtggactgctttgtccttccaagataatgcttcttgctgcatcctcatatggtagaagggcgtaaaagggatgaatgctgtgcctcacatggcagaagagaaggaagggcaaaaaaaggcaagtgctgggaggactctttgatacgtacctaaattgcattcacaagggaggagcccttatgactttatcaccccttaatggccccacctcttaatactattgcattggagattaagtttcaacatgaatattttggggacacaaacattcaaactgtggcaataaggtattcaaaacaggcaaattcataaagacagaaatagaaatgtatttaccaggtgactgggggagagaggagtgagaagcttttgtataatgagtacaaagatgaaaaaaatctggaaataaatacagatgcttctcaacttacaatagggttgcatcctgataaacccatagtaagtggaaaatatcatatgtcagaaatgcattcaacatgcctaacttaccaaacatcatagcttagtctagcctaccctaaatgtgcttagaacacttacattagcctacaattgggcaaaatcatctaatacaaagcatgttttataataaaattttgaacatctcatataatttattgaatactgaaagtgaaaaacaatggttgtatgggtactcgaagtatggtttctactgaatgcttactgcttttgtactgttgtaaagttaaaaaattgttaagttgaaccattgtaaattggggaccaactggtgatggttatacaacattgataccactgagcaccgtacctaagatcatatcatcaatgaaaatttatgaaccatttgaaatatatgggtatgtgggtgtttctttaggtctctttgttccattgtaccttttatgagttggataagtgaatttatcaatggtcaggcagaattttttgaggataaaagcataaaatccaaatatagagaagtgacattgttatcttatcgactagttggaaaaggggggtttaagttttttttcctaattatgaatctgtatgtcattatttgaatctatcacctttatacttcacaatacacactagttttttttttttttttgagacggggtcttgctctgtcgccaggctggagtgcagtggcacaatctcgcctcactgcaacctctgcctcctgcgttcaagcgattctcctgtctcagcctcccaagtagctgggactacaggcgcgcaccaccatgcccagcgaatttttgtatttttagtagagatggtgtttcaccatgttggccaggacggtctccatctgttgacctcgtgatccgcccgccttgacctcccaaagtgctggaattacaggcatgagccacggtacctcacactaaaattttaagtggctgatttaagtgatatttttcgctgctgccagaggactgttgcaaagatatgtgtgatttaacgaatatttatatgtcatgatacttctaagatgcgtgaattgggtgtgggcctattcaagctgccttgcttggctgattaatgagtatttctcaccctttgttgtatgcttataaataaaatgtgcatcatagtcaccatatccatgtatcatttcgagggcattaggtcatattgagctttttctttgcatttgtcatgattaacttttttgtgactttggacaagttatctttttccttgtaagtttatctcatctgagaaggggattttcccctcaattttagtataaccctgttttatttttctgcttcttaaaatggatgagaatgacaaaagaaatttgctagctgactggttagaggagttagttgtgatggcagtcatcattgctctgtatgtatgtacttggtagtacatagaaatattcatcaaatgattacttcagttgagttgcatttgtagaactacatgaagttgaattttaacttaaatttgaactcctaagtgtcttctaaaaaatattctatatgtaacattgaatagcttttttctgtatgcagaatgcagaagatttcttgttattcagttactcatttcattctttcatttttgttcacttataaaatatttattatcttctatgtgtcaagcaccattcagggtacagggcactgaaaaaaattctagaactcagaatcgaagtgtccactgtcatatgtcacatagtagacattagatagtagtaattgttaaactcttggagaacattgtagaattttaaaagctaaatgagaagttgatatgttatccagtgactgttactcaagttctgactataatggagtgaattttaaaaattaacagtttaaaaaaatagaaaaaaggaaatgtaacagaaaactgcagtattttaaaatatttctttatactgaagagatcagtgttagaagtgaggcctaaattatatgaagcagcaagtctgtctgattctgggcataattgccgaaagcaattcagaagaatcttcagattttgaatgtgaagaaagctttgacttaatgtttgtttatgatactaggggaaaatgatgaataaatgtatgcaattgtaggtgaataaaaagtatgcttttaaattatctattcattttggtaatgcttttgttaaatggaaggtggcacttacaactaaaggtttcttagaattgggggaatatggtatacttctctgagtgttatcaagttcaaatgttacaattcatatgaaagagcttagtacgataatggggaaaataatagtaacattgattataaaggcaacaaacttaatgattaagagtgaaagtcctggaatcagacttcttggattttaatcctgttaccaacacttaactaggtgtgtaactttgagtcagttactcagttaatgtcttattttcctcatttgttaaatgggtataatagtatgtgcctcaggttaaatgggcttaatgtgtaagtgcctagactagtacttggagtataggaaatgcttaatgagattcaatgtatgttatttgttatgaagctgtgaaacactgtgtatatgattttaaaatgtgctatttaaattcatactttacagtttaacttgccattttaaaaagcaacatttgattactgattgaaaaaattttttggtctcatttgtgcagagcttatatttttctccttgcctaagctgttcttcatttgtttgtataaatattggcatgtttatttaccttggactagtccatgtcacctttcactaatcaaagctgttatttctgggttattaatcatcccacccaattgggtggcagcagtaaaccctgagggcttgccatctctcccactttataagttattactgtcattattgtttaaataattaaggagaggttttttttttgccaaattctttgctgtttggaaataaggaatggaacaagtaataaatatgctgaaaatatatgttttcttagttcactttaagaaattgatttatttaggaaatggtgtttgttttaaattacacttgatttttttgaaaaatttgtatgggcatatttcttaaaatgttaggtctatagtataaaaagaattaaaacaccaaagatttctattgatttatattctttggttattcttttatatttcttgactggtattctgtatggttcccaaaaccagtcaagaactgtaaaactcttactctacatacttgccagcaaaaaaaaaaataaaaataaaaataaataaaactcactttgtcagttttatccattctcatatcagaacctttttgtttgcatgtgacaggaaacatcaattctaacagtcttaagcagaaaacattagtttatataaatggtaggtccattagtagacctggcttctggtgtgtcagggtcacagtgatgtcactacttagtttttctttttttgtaccttggctccattctaaggcaaattattctgttgtagaactaagatgattataaagcttcaggcttgcatactttataattacaagtccagtggacccctttctaataggtcccactaaggttacatttctgccctgacatagttgctgtggagaatgagtttaaaagtaggtttgccagaaagaattgaggttactgattgttatgagttgaattgtgtcccttcaaaatttgccagtactggagaatgtgaccttacttggatataacattgatgcagatataattagctaaggttatatgaagtagagtggggcacagatccagtatgactggcatccttataaaaagggaaatttgaacgcagacatacagggagaatggcatgggaagattggaggtaggctgccacaagccaaagaactaccaagagtaggagagaggcctggaacagatccttccctaatgccttctggcttccagattgtgagacagtaagtttctgttctgagccatctagtttatggtactttgttatggcccttgtgaactgatacagtgatcatgaatttataatagtggtctaccttgttgagtgactttctcagctgcagcatcaaagaaaagtttttagatggtttcattcaggtttgggattttgctatattggtgtcataagacaagaggagcaagggaatttaggttattggcaggagaattattgaaatgatgaattgtagaatctaaactgaataaggtggaagagaaagtaaaatagagagggcctgagggatcaaagtctattgggcccatggataagaggttttatagaggtcaaaggattataatctggaagaagaggttgtggttggaggacaaggtgcttgaaatagtgattaaggaggtggagcacttttggttgaagatagaagggcaaggaaggattttactatgggacaaggagggtgactgggacataatatatgtgttcactgttgatcctgtgttttggagaggttcttgaagttaaagagatcaaggaagtaagaagccaggctgtggatgggttgtgcaaattgataattgaaattactaaatttgatgtagggttggggtagagaagatgacagtgagccatcaaagccttaggtaaatgaggtagagaccaggagcttgaaagttaacatgaaaaggaagaggagagagtaatttagttgaaagttaagagcctcagctgggcaccgtggctcatgcctgtaatcccagcactttgggaggccgaggctggtggatcacctgaggtcaggagttcatgaccagcctggccaacatagtaaaaccccgtctctactaaaaaaaatacaaaaattagccaggcgtgacgcctgtaatcccagctactcgggaggctgaggcaggagaatcgcttgaacccagaaggcggaggttgcagtgagccgagatcgtgccattgcactccagcctgggcgacagagggagactctgtcctcccatccaccccccaaaaaaagaaagttaagagcctcaaaagaatagagctttatttttatttatttatttatttatttatttatttatttatttatttatttatttaatttgagactgagtcttgctctgtcgcccaggctggagtgcagtggtgcgatctcggctcactgcaagctccgcctcctggagttcatgccattctcctgcctcagcctccagagtagctgggactacaggcgcccaccaccacgcctggctaatttttatttttttggaggatggagtctcgctctgtcatccaggctggagtgcagtggcgcgatcttggctcactgcaagctccgcctcccgggttcacgccattctcctgcctcagcctcccgagtagctgggactacaggcgcccaccaccacgtctggctaattttttgtatttttagtagagatggggtttcaccatgttagccaggatggtttcaatctcctgacctcatgattcgcccgccttggcctcccaaagtgctgggattacaggcgtgagccactgtgcctggccttttttttgtatttttagtagagacggggtttcactgtgttaggcaggatggtctcgaactcctgatcttgtgatccgcccgccttggcctcccaaagtgctgggattacaggcgtgagccaccgcgcccggctgttgtttttgttttttaaaacaagaagttaaatagtgtaatgtggacaagctgctggtgagcaaagaggagtttattcacatttctaaaacctgagataggcaggtcgttaaaacctgacagctgccatttgaggggctacaaaggaggtgagaggatttttataaattcgtatattagtcattcatgcttaaagatcatgcttcttccactgatctgttttttttgtttgtttgtttgtttttttggcctacctagaatgatgtatatagggctcactaagtcttctgatgaaagacccaagctatactttgctttcattctgtctctatgtcacctagatttttgatcaaattgagttgtattcaattaaaaactggcccattactggtttgagttggtgatatggtctttacatccatcgtttttcagtagtattttctgtactatctctttgaaattcttttgtctattctaaagtccctttcttctttcatttttgaaagaagtgaatctccagagcaaatatatttttttatctggattttgaaaactttctttagaatactgtatttacagtattcctaggtctttgcctgctaagtcaatttgtaatgttttgttatggaacaaacatgagatgttagcgtgtttgcagaaggtagcattacaatttttactagaatttaagcccttgaaggcaggagccctatctgattattttaactccagacaccttaacctattgtcttgtacctagaaagcatccagtttatgtctattaaattattaaatgagggccaggcacagcggctcatgcctgtaatctcagcactttgggaggccgaggcaggtggatcacttaaatccaggagtttgagaccagcctaggcaacatggtgaaaacccatctctacaaaaaatacaaaaattagctgggtgtggtcccatctgcttaggaggctgagggaagaatcacttgagccccggaggtggaggctgcggtgagtggagattgtgccactgcactccagcctgggcaacagactgggcaacactctgtctcaaaaaaaaaaaaaaaaaaaaattaaatgagttgggaattacagagctgaggaatatgtgcactgtgcattctgtaagggaactgctcaagtggctgcttgtgtttccttgactccccaccctctccagttctaaaggtgaggactgcccaggtgatttgcctttctctgccccaccacgccctccaccctagctttagagttgttctcctttctcaaatttctcttattactagcttctgtaataagcaaacagcttccggtttctattttccttgtcactttggattgctgttaatcactattgctccttactatttttcattcttctgtttactcttagttttcatcctgttttcttttacattgtaaaatatacaagccttttctagatatggatagcctatcaaaagcttctaaatgttctgtcttgcaaactataaacctatgtgtataaaaacatagactcttggtgtattcatttagtactttggccttaggagttgctattctatctttaaagggtggtggtggtggttgaggtgggagttgaaaggctgtggtggctagtccccattctgatttctcagccctcttgaaaatggagtaatagaaggtggaattctaagtagttgaatttttatgtgttaatatgtcagaaataattttatggcaaattacagaaaattgtgtgcattaagagactaaaaaattttttaaagagcaaaactaaaaagagtggtttatttgaagggataaaatctattccattgtcttccttttactacctggccctgatttgccatcgcacagtgttcttactgcctgatttgccaccttctctctacttcacattggtcttcaatactgccttttcatgggaagttgcaaaaagtagtaccgagaggctctatgcacccttcatccaattttccctaattgtaacatcttacataactacagcaatagcaaaaacaggaaattgacattggtataacccacagaccttatttaaattttgccggttttatagatactcattagtgtgtttgcatatatagttctatccatatgcagttttattatgtgtgggttcatgtaactgtaagcgtaatcaaaataaagacttgctctgtcacaaagatcctttgtgttaccctctataatcatacccactcccctctccattttattaatttatttactgacgactccctagtatctgaccttgtgattaactgagaaaagattggcattatgttttagaggttgtctctttattttactttcacttctgttttttttttttttttttttgagatggagtctcgcactgttgcccaggcgggagtgcaatggcatgatctcggctcactgcaacctctgcctcccgggttcaagcgattctcctgcctcagcctcccgagtagctgggattacaggcacccgccaccacgcccagctaattttttgtatttttagtagagatggggtttcaccatgatggtcaggctggtcttgaactcctgacctcgtgatttgcccgctttggccgcccagagtgctgggattataggtgtgagccaccatgcctggccttccacattgtactgtaaccatttataataagactaaatcatttaaaatttcagtttattttgtgtgttagagaatcttgtactctcaaagtcatgtactctaatatctcctcccacataaccctcccctaaaaatgacaccagaaattccatatgagacaattcttgacatttaattattaacctataaatttccttagtaactgggatcttttttattactacttgatacactttggtgttgatttacttatgtgttaacatttgctagattatgctgcactaagaaacaagccaaaatatgagtagcttacaataagaagggtttatttgtttttcacgttataggcttcctaggaatcagctatggttctgctctgtgattctttctcatttgaggatccgggctggaggagcagtccctatttgtgacatattgttctcttggtagagagaaaacagtaagacctgtcagaaacacacaatagctgttgaagcttctacttggaactggaactttctcccagattcagtggccaaaacaagttatatggccaaacccacccttggaacacccacggagagacaccacaagtcacatggcaacaggcagggatattaatactactcttaaagagagagaggctatatactctgtgtatacaagagggaaacagacgactgggaattataataccacctaaacaccttaagatgctgtactagtcacctgaggccaggagtttgagaccagcctgcaaaacatggtgaaaccctgtctctactaaaaataaaatagtctggcgtggtggtgtgcacctgtagtcccagctacttgggaggctaaggctggagaattgctggaacccgggaggcggagattgcagtgagccgagatcacgtgattgcactctaacctgggtgacggagggagacgccatctccaaaaaaaaaaaaatacatacatacatacatacatatatatatatatatatatggtatactaggctatactttgtaaaaatttttttcttagtaaagtttattatatttacatttctatagctatatatgtaattataataacatattttttccttaacaaaaatagcagttcctccttttgttttgttttttttttttacattagttaggatattggtttaaaccaaaatcacaaatttcaagtaacaagtaacaatccaagtggggtaggtggtgtagagtgctgtaggagcttcatgatggtgtcagggactcaggctttttttctcgtgttgctgtatttttcccatgttttccgtcgcaatccaagatagcttctctagattctgtcactatatctgtattctagccagctatgagaagggttaggagtcagaaggcatttcctttctctttagatgcacatcctcggagttggacacatttcttttatcattccattgatgaataactgaaattgcaagagaggttgggaaatgtaggttttagctaggtgtgtgtatgtaaagcttaggggtactattactaaagaaaggaggagaggctgggtgtagtggctcatgcctataattccagctacttgggaagattgtttaagctcagaggtttgaggcagcagtgtgattgtatcactgcacttcagccaggactgagtgggatcctgtctcaaaaccaaccagatcaggaaacaggcttttcaaggaggtaaaataagctactaaagatcatacctaagaagtagtagaatgggctttgaatacctttctgatacaaagtctgagttttttttttttttttttttttttacaaaactttattggctttctagcatctcttgtttacaggtactttacatttttcagactagtaagaaatagcaatggactctttcaaaagaattctgacatttatgaatatttaactttgtgacagctggtaagaatttatgatataggtaatgaatatataattgcttttaaattgtaataacagaattgtaaaaggtcagattttgattttgacagttggagttaaagttttcctttagaaattaatttgattgttaaaaattcatatgcagttttatatactgatcacatttggggatttttatatttttctctagattgaaaatagccttattgtttcattcttattatataattaggatgtgtttattctcagagtttccagagactgcagagtagtatgaagaagaatgtaaaaatcatttatgatcttgctatccagagataatcattgttaccatttaataagctatgcctttcaattttttcctctgttcattcattatatgtgatttttttttccctgcctaaaaagtgatcatgttcatagtccgacaataacaacaaaagccaattttactgagacacaccagaaacactctttgatcatcttgcttgatgagtgacttggcactttggatggctttttccattctcacttagctgtatcacattagtgtagttatcagcacagggtgtactttagaacactttggtgagctaatatcttctcctatgtgtttaggtagtaaccaatgaacctgtaatgtgaggattattaaggcacaggttggagatcaggatttcttactgtgtatgaggttttttttccctgtattcaaaaaatccaattaaaattaactttttattattgagggaacatatttaatttgctgtctttggcaaagtatttatactgttgtcataactaagtagatgactatataatttttcattcaaactggtacatttttgagaatgaaagggggtactacaaatatttaaaattctatatatttttggaatatttacttttttcaaccattaaaatagtttttattgcattagtagatcaataaaatagctccatttaaagtctgttttcaaaaacaatttctaaaacattttgttgtacattataacaaagtttttaacatggacttcagttgaatatttaaaaacaaactatttttggtaataaatatttttatcagtttctcggtcaaatctgtcactaatactgtgtcactgatacttttctgaatatgattttccatctggttttactagttttaattttttcataaaattgcagtattttgcagagttacattttatacttgtggttgttaacttctacagttgatgcttcactataaccaataatgtttttagttgctaacatactttatatgtgctgctgtccccagttagctcaggaaaaattttgctagatggagaatattcttaattctaatttttttcttattgaaaattataggctgggcgcagtggcttatgcctgtaatcccagcattttcggaggccgaggcagatggatcacctgaggtcaggagttcaagactagcctggccaacgtgatgaagcccccgtctctactaaaaatacacacacacacacacaaaaattagccaggtgtggtggcgggaggctgagggaggagaatcacttgaccctgggaggcagaggttgcagtgagtggagatcatgccactgtactccagcctgggtaacaagagcaaaactctgtctcaaaaaagaaaaaaaagaaaagaaaattataaatatatcagtctcagtattttcacaggcagtgtccttttgcctgtattaaaggtaatctctgtttttacttttcattttttatagagacaggatctccctatattgtccaatctagtcacaaggtactgtctttgatacaaataagttgtccctatttatgattattttatatgttccaccagatttaagtgttgcaaaattgtaggccttctctaattttttttttttttttttttgagatgcagtctcgctcttgtagcccaggctggagtgcaatggcacagtctcagctcactgcaacctctgcctcctggcttaaagcaattctgctgcctcagccttcctagtagctgggattacaggtgcccgccaccatgtccagctatttttttttttttgtatttttagtagagacgaggtgttgccatattggccaggctggtctcgaactcctgacctcaggtgatccacccgccttggcctcccaaagtgttgagattacaggcatgagccactgtgcctggcctgtaattttctttcacctacttaaaaatagaaagactctttttttcatggcggctcacatttgttgtgccagcgctttgacaggctgtggtggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtaatcccagcactttgggaggctgaggtgggtggatcacctgaggtcagtagttcaagaccaacctggccaacatggcgaaaccccatctctactaaaaatacaaaaattagctggatgtggtggcgggcacctgtaatcccagctacttgggaggctgaggcatgagaatcgcttgaacctgggaggcagaggttgcagtgggccaagaaagtgccattgcactccaccctgggcgacaagagcgaactccatctcaaaaaaaagaccctcgatggaacttctaaaattcattccaaaatataatgataaaatttcaaaatgaaatctcgtgtactatttgaactctcatttaatttgttcggttcttccttgcttttgaaggatatatttcagtgtcttggcaaactttgttgataataattggtatttgctaaaagcttcaaaagctgaaggttttctggagctttattcattaaacttgtttttgtttgtttgtttgtttttttaaggagatgatgtctcactgtgttgcccaggttggtcatgaattcctgggctcaagtgatcctcccatcccagcctcccaaatagctgggactacaggtgtgcgccatcatgcccagctcactaaactttacttttgattaaaggtttccaactgattttgaacagtatgcaaccaatttctagaggacttatttttaaaaagactcactattgagacattgattggatttataaagtagttttttgaaagtactagcctcggaagtccgatgacaggttgcaaggagaatacacatattgctctgttgcactattttattgtattcagtatcagtcttatccttaaaaatttaacagtgggaatatgaaaacatttataaatgttgacgtttgaagctgactcattaatagtgatgtcactagagctccatgataaatagaaactgcctcagtggttctctgcaaattgtctgcccatctattttctggagaaatgaaaatttagagcttagtttttattggatacagtgatgtctttatagctcattgctcctgaaaaggcttatgaaataataaaatggttaccaaacaacaaaataaataaacagttgtagacttgtacaatacaataaatgacaaaaccatctaagagttttcatactattgactttgcacatacttcatttgcacccaacctgcaatttcccactgacatagccagctggtggcctagtgtgtcttgtggtcactgtacatgccactgcactgcctggcataccaggtaaccaacaggagcaccagtgtcaaatatttctcctaatattttgcaagaccatacagagttaattgcccatggttgcttaagtctgaggatacttttcagtaagtctatgcactccccttgcaaagaagttgttttgttgaatctgtaaagaatcagaacaagaaagatggaattatcactagttctcttccagatttcatcacttgtttatgtggtgaaagcacttatagactactagttgataacttggccagaaactagatatacacagtagagatacaaaatccattctggttttagtgtattttgatataatgattgataatagtttttttaaaatttaaaatttaatttaattttttatttaaaaaatttttttaaatggagacaagatctcgctgtgttgcctagattggtctcaaactcctggtttcaagcagtcctcctgcctcggcctcccaaagtgctgagattacaggcgcgagcgactacacctggcccaataatagtttctttttaaaaatgggaaatcggagacatatgttaagctgaatgggatgctgggacaatgacggtaaatcaagattttcctgggcataccagggcatatgggaagcaacacagagctgggagcaggacacctaagtcctgactctgacttttttttaagagacagggtctcactctgttgcccaggctagagtgcagtggcacaatcacaggtcactgtagctttgacctccgtggctcaaccaatcctcctgcctcagcctcctgagtagctgacactatagatgcatgccactatgcccggctaatttttgcatttttggtggagatggtgtttctctacattgcccaggctgatctcaaactcttagattgaagcaatcctcccccaatagcttcccaaatcccctcctgggattacaggcatgaaccaccacatccgtctgactctgccttttttttttttaggtggagtcttgctcttttgctaggctggagtgcagtggcgtgatttcagctcactgcaacctccacctcccgggttcaagcaattcccctgcctcagccttccacgtagctgggattataggcatgcaccaccctgtccagctaattttttgtatttttgtagagacgggctttcaccatgttggccaagatggtcttgatctcctgacctcgtgatccgcccaccttggcctcccaaagtgctgggattacaggcacatgccaccgtgcctggctgactctgccttttaaaggcctggagaggtaacctctctgagactggatgtattagggttctccagaaaaactgaaccagtatgagacacacacacacacacacacacacacacacacacacacacacacttgcagtcttgagttcgaatatatatatctgtgtgtatgtcatacctgtgataaagtttaatttataaattaggcacagtaagattaacaacaaaactaatagtgaaatagtacaattataacaatatgctgtaataaaatttatgtgaatgtggtttctctctctctcaacatatcttattgtattatactcatcctttttgtgatctgtcagcctgataactgagtcggctactaagtgactaatgggcaggtaccatatacagagtagatgccctggacaaagggattcacgtcctgggtgggatggcatgagatttcatcatgctacttggaatggtttacaatttaaaagttatgaaatgtttatttctggaatttttcatttaatactctgacggcgagcaactgagggtaactaaaactgtggaaagtgaaactgtggataaggggaaactactgtgtgtgtgtgtacacattttatgtatttttaaaattatgctttccttccccctcacccacttaataagtcctgtcaaatctatgttacaaactttttttcaagccatacccttctcttctgccattgtcaatgttcagcccctcaaccagaccattaaaattacttcctaaggccgggtgtggtggctcatgcttgtaatcccagcactttgggaagccacaacgggtggatcacttgagatcaggagttcgagaccagcctagacaacatggcgaaaccccatctctactaaaaatacaaaaattagccaggcatggtggtgcacgcctgtaatgctgctacttgggaggctgaggcaggagaatcacttgaacctgggaggcggaggttgcagtgagcctagatcgtgccacgccactgtactccagcctgggcgacttcatttttttttactctacaatggcagatgaaacccttcataagttgtcttctacaaaattttataatcttatctccctatccctcttatcgttcagaacttcttgctgttctttttagacataactgagttttctgttgatcgcatgcctttgtgcatactgctatctctgtgtagaatcaccctctccccatcttccccatacctcaagttcctgctctgatgtcaccccatgaagccttcctggattcccatcctgatcccagaacactcttacacattcatatggaggcaaacttgatccttcaaaccttttttttcttttttgagacagggtctcagtctgttaaccagacttgagtacagtcacagagtcacagctcaccgcagccacaactgcctgggctgaggcagttctcccacctcagcctcccaagtagctgggactacaggcatgtgccaccacacctggccaatttttaaattatttgtaaagacgaggtctcactgtgatgcccaggctggtctcaaactcttgggttcaagcagtcctcctgcctcagcctcccaaagtgctgagattactggtgtgagccactgcacccagtcgatccttcaaacattgaatttcagatgagtctgttcataagctgaccaaggaactctttgaactgtagtgtgaatttaatggaactgcctttctgcaagcagtttatatctgatgacatcactacctttctgtatgtcagtttgtatattcatttaattgttttattgaagtggtttttgaaatgtattcataggtactttgggtacttgggtagaggatgaattcttggggatttgggcctctcaactggctttagagaaagcatttcattctcaatttgttacatattgggtttctgggtaaaatattagatgaagaggagttttgatgtcaaaaacaaaatttaagattcttgtttcatttcttgtctacctgattcttagtaacccatgtgactatctttatctattctctgtctcacgctccccaagaagaaacaaaatctaacccctgaaatcaaggatattttatcttattcatctttgtttctcaaatatctgttgaatgaatgccaaatatgttaatagaagttaatgaatagcatctaatttttattaatgtgtttatttcagttatcaagtgggaatcctgtatatgaaaaatactatagacaggtaagatttttgtttcattgtttgcctggattgaacattaaatgtactgtcaactcttgattgtatgcctgtagattaccagctagctcgataaatttgatgtgtcttgttttcaacatcttgtttacagcctccactttgagtacttaatgcatttgacaatcccagagaaatgaaggaaagataattaagtccaagtacttagttgtcttaaatatctatgttgaaaatgtatacatttgatagatttatccagatataaatattccaaattcttaagacaaatacaaataacttctatgttgtttttaagacttattaaagtataattttcacaaagtgaaaaacatgacttttatacaaatacataatgagcatgtatcagattttattcaactcattaattactggttaattagtacagatatacagcctctggtcagatataaaaatgggaatatggccgggtgtggtggctcacacctgtaatcccagccctttgggaggctgaggcaggcggattacctgaggtcaggagttcaagaccaggctggccaacatggtgaaaccctgtctctactaaaatacaaaattagctgggtttggtggtgcatgcctctaatcccacctactcgggaggctaaggcaggagaatcacttgaacctgggaggcgaggttacagtgagccaagatcgtgccattgcactccagcttgtgcaaaaagagtgaaactccatctcaaaaacaaacaaacaacaacaaaaaaatgggaatatgagttacagagatttacatacttcaccagacaatattcatttgtgttggtatggacaggagtcacttgcatcgctatcagtttctattaacctctacctctacgagtataaagtagtctagacagaagaaagtcatcaagggtgcataccatagatcagacgataatttcttgaaggtgtagacaatcttatttgcccattttcaagtgtcagattattttttctaacagtctcactaccttatgattatgatcacagaaaaggctggtttcattatttttggcctggctatttacatagttgcagcaagtattaattaaacattataggcctctttggttttgacttgcaaatcaggagctataaactatatagcaacttctaaggtcagagaataatttctgcctgaaaaatatcaagaatctcagactgtactttttaattcccctgttacatttgttcttctatcttaaggctgtgctccaaaccttagaaattctctccaccatatttcaccttcactacatataaatatgagtgaatttatctcatcttgaggtttcccagatttgctaaggttcctagcctgctggtaagtgaccttactttactacccgtgaggctaggatcttgtaaaccaggtagcagcccagttttcttgggagatctttgtgatgttcgtgccacataaagtcagtgcttgttctttaatctttgttttgtttgaataaaagaagtcattctcaaataatggccttgttttacacaattggcttatccagttacatcctaagaagaaaaacaaattgctattgaacccatgtaataactatattgctataaagagtaaaaacattccatacaagtatttgtttttgaattctgaggagtcagtgagaatcagatactattgatggggagaaaccagagcagaaaagctgaaaattctaaaaatcagagcacctcttctcctccaaaggaacagagctcctcgccagcaatggaacaaagctggatggagaatgactttgacaagctgacagaactaggcttcagacgatcagtaataacaaacttctctgagctaaaggaggatgttcgaacccattgcaaagaagctaaaatccttgaaaaaagattagacgaatggctaattagaataaacagcgtagagaagaccttacatgacctgatggagctgaaaaccatggcacgagaactacgtgacgcaagcacaagcttcagtagccaattcgatcaagtggaagaaaaggtatcagtggttgaagctcgaatgaaatgaagcgagaagagaagtttagagaaaaaagagtaaaaggaaacgaacaaagcctccaagaaatatgggactatgtaaaaagaccaaatctacgtctgattggtgtacctgaaagtgatggggagaacggaaccaagttggaaaacactcttcaggatattatccaggagaacttacccaacctagcaaggcaggccaacattcaaattcaggaaatatagagaatgccacaaagatactcctcgagaagagcaactccaagaccacataattgtcagattcaccaaagttgaaatgaaggaaaaaatgttaagagcagccagagagaaaggtcggtttacccacatagagaagcccatcagactaacagtggatctcttggcagaaactctacaagccagaagagagtgggggccaatgttcaacattcttaaagaaaagaattttcaacccagaatttcatatccagccaaactaagcttcataagtgaaggagaaataaaatactttacagacaagcaaacactgagagattttgtcaccatcagacttgccttacaagagctcctgaaggaagcactaaacatggaaaggaacaaccggtaccagccactgcaaaaacatgccaaattgtaaggaccatcaaggttaggaagaaactgcatcaactaacggagtaaaataaccagctaacatcataacgacaggatcatattcacacataacaatattaaccttaaatgtaaatgggctaaatgctccaattaaaagacacagactggcaaactggataaagaggcaagacccatcagtgtgctgtattcaggagacccatctcatgtgcagagacacacataggctcaaaataaagggatggatgaagatctaccaagcaaatggaaaacaaaaaaaaagcaggggttgcaatcctagtgtctgataaaacagactttaaaccaacaaagatcaaaagagacaaagaaggccattacataatggtaaagggatcaattcaacaaggagagctaactatcctaaatatatatacacccaatacaggagcacccagattcataaagcaagtccttagagacctacaaagagacttagactcccacacagtaataatgggagactttaacaccacactgtcaacattagtcagatcagtgagacagacagttaacaaggatatccaggaattgaactcagctctgcaccaaccggacctaatagacctctacagaactctccaccccaaatcaacagaatatacattattttcagcaccacaccacacctattccaaaattgaccacatagttggaagtaaagcactcctcagcaaatgtaaaagaacagaaattataacaaactgtctctcagaccacagtgcaatcaaactagaattcaggattaagaaactcactcaaaaccactcaactacatggcaactgaacaacctgctcctgaatgactactgggtacataatgaaatgaaggcagaaataaagatgttctttgaaaccaacgagaacaaagacacaacataccagaacctctgggacacattcaaagcagtgtgtagaggaaagtttatagcactaaatgcccacaagagaaagcaggaaagatctaaaattgacaacctaacatcacaattaaaagaactagagaagcaagagccagcacattcaaaagctagcagaaggcaagaaataactaagatgagagcagaactgaaggaaatagagacacaaaaaacccttcaaaaaatcagggaatccagaagctggttttttgaaaagatcaacaaaattgatagaccactagcaaaactaataaagaagcagagagagaagaatcaaatagacacaataaaaaatgataaaggggataccaccaccgatcccacagaaatacaaactaccatcagagactactataaacacctctatgcaaataaactagaaaatctagaagaaatggataaattcctggacactacaccctcccaagactaaaccaggaagaagttgtatctctgaatagaccaataacaggctctgaaattgaggcgataattaatagcttaccaaccaaaaaaagtccaggaccagatggattcacaaccgaattctaccagaggtacaaagaggagctggtaccattctttctgaaactattccaatcaatagaaaaagagggaatcctccctaactcattttatgaggccagcatcatcctgataccaaaacctggcagagacacaacaaaaaaagagaattttagaccaatatccctgatgaacatccatgcaaaaatcctcaataaaatactggcaaaccgaatccagcagcacatcataaagcttatccaccatgatcaaatgggtttcatccctgggatgcaaggctggttcaacatatgcaatcaataaacataatccagcatataaatggaaccaatgagaaataactaagatcagagcagaactgaagaaaatagagacacaaaaaacccttcaaaaaatcaatgaatccaggagctggttttttgaaaagatcaacaaaattgatagaccgctagcaagactaataaagaagaaaagagagaaggatcaaatagacgcaataaaaaatgataaagggaatatcaccactgatcccacagaaatacaaaataccatcagagactactataaacacctctatgcaaataaactagaaaatctagaagaaatgggtaaattcctcaacacatacacgctcccaagagggtgaaggacctcttcaaggagaagtataagccactgctcagcgaaataaaagaggacacaaacaaatggaagaacattccatactcatggataggaagaatcaatatcatgaaaatggccatactgcccaaggtaatttagattcagtgccatccccatcaagctaccaatgactttcttcacagaattggaaaaaaactactttaaagttcatatggaaccaaaaatggttccacattggctcaaaaatgagcccacattgccaagacaatcctaagcaaaaagaacaaagctggaggcattacactacctgacttcaaactatgctacaaggctgcagtaaccaaaacagcatgggactagtaccaaaacagagatatagaccaatggaacagagcagagccctcagaaataataccacacatctacagtcatctgatctttgacaaacctgacaaaaacaagaaatggggaaaggattccctatttaataaatggtgctgggaaaactggctagccatatgtagaaagctgaaactggatccgttccttacaccttctacaaaaattatttcaagatggattaaagacttaaatgttagacctaaaacccataaaaaccctagaagaaaacctaggcaataccattcaggccataggcatgggcaagaacttcatgactaaaacaccaacagcaatggcaacaaaagtcaaaattgataaatggtatctaattaaactagagagcttccacacagcaaaagaaactacaatcagagtgaacaggcaacctacaggatgggagaaaatttttacaatctacccatctgacaaagggctaatatccagaatctacaaagaacttagacaaatttaccagaagaaatcaaacaaccccatcaaaaagtaggcgaaggatatgaacagacacttctcaaaagaagatatttatgcagccaacaggcacgtgaaaaaatgcttgtcatcactggtcatcagagaaatgcaaataaaacccacagtgagataccatctcacaccagttagaatggcgatcattaaaaagtcaggaaacagatgttagagaggatgtggagaaataggaacacttttacactgttgatgggagtgtaaactaattcaaccattgtggaagacagtgtggcgattcctcaaggatctagaactagaaataccatttgacccagccgtcccattactgagtatatacccaaaggattataaatcatgctgctataaagacacatgcacacatatgtttattgcggcactattcacagtagcaaagacttggaaccaacccaaatgtccatcaatgatagactggattaagaaaatgtggcacttatacaacatggaatactatgcagccataaagaaggatgagttcatgtcctttgtagggatgtggatgaagctggaaaccatcattctgagcaaactatcgcaaggacaaaaaaccaaacaccgcatgttctcactcataggtgggaattgaacaatgaaaacacttggacacagggtggggaacatcacacaccgtggccttttgtgggttggggggaggggggagggatagcattaggagatatacctaatgtaaatgacgagttaatgggtgcagcacaccagcatggcacatgtatacatatgtaacaaacctgcatgttgtgcacatgtaccctagaacttaaagtataataataataataataataaaagaaaactatttcatttggtttacaaaagcagaggctactaagttgagggtctcagaaagggcttatgcacatagctattagaaaatagaacattaaaataataccaacagtattccaagtaaataactataattaaattttcctcaacagttcattcagtcctgtgtaattcttgttcagctgaatctcggattagaagtctgcttttatgaagtacatcttctttcagactgaaaagagtcctggaaatcctgacttcatctaccaatatggtctgaaagtagtgtgatgtcagctgagtagtctttatccaaaaatccactttttgaaatgttaataattcagactatgtatgtcttatagatacagactatatcaaaagtatagtcattttcatgaggctctaagactctttgttgaagatatatcagcttctggcctatagcttctggctttgcctatggcagagcctttaggcaagcagcagaatacctcagaaactgcctgtagatgacaaagactaaatgtttatattattagggtaaccaaaagaatggaagatagtaaaattcttaattgggatacagtacataatgatttcataagagtttgatcaatgtttcccctgaatgcttctatatttagtaggctgtgttgggtatggatatttgttttgtatgctgatcaggaagtaggcaaagaaaaggagttctgaagaattctacaggcaggtttcccaatccttatacttcctcttattccaaatttgaaggattaggccatgtttttcttttttgctgagtgcatgatttttcccatgttgtaccacttgaaagaaaggttttcccttttgcttctttgctaggattggactgtctagaatgctttgtacagtatatgtttacagtaaacttaatcttttaactaaactggaaaaacagatatctcacaaatatactattatcctgttacctttcccatgactttttaaaatgtacttttcatttttacaaatggaactttaggaaatctttacaaaaatgagtcttttttttcctgtttttgttgttgttgttgtttgtttgtttgtttgtttctgttcttgtgacctcattctgtcttaaaggaaagtccctggtcagttaaaatggtatgttccctaatatgttttaggaacttaacagctttaaaaaggtttcttcaagtttattttggaatcactgctggttttagagctgctattgctttgatttgttttaaagtgctgcagttcctaagagtaggtataaaagtgaaagttgatgattgaaagatgtttgaagaggcacataacatgtgcaactattcccatttgtcagaagacctctgtaggaaatgctgctcctttcttcctagtgccatttaattggaatttaaatgacagctatagaagatatgtgttgatgttacaaccccacgaatttgctttgacaatcctctgagcttcacttttctcatttgtatggtagggcatgataaaacaaaaaccactttgtaaattgccagtgctgtctagatagtactactcatatgtctgtccacatattctttggcccatggtagtcaaaggattctcattcctttcttgcaaaagccaggtcccaaatcacagggatggaaggcaggtaaatggtgataattttgccttttgtattttgttgtcaacttacggatttgtatcttttcaggttgatacaggcaatactggaagggtgttggcttctgatgctgctgctttcctgaaaaaatcagggcttccagacttgatacttggaaaggtagtattcgttcattataactagattataagtttgtaaggaatgtgtactatagatgaactggatgcaaatttagaaagatgccatcaagaaatttagaagttagaaccgagtcatagaagccattttaatagtaggatgaagggaatttgtagcgtagtgatttaccctcttgaaaagtaaggtgtttttcagatttttagaaacaaactactttttaataggataaaatgaggaagtaataagtacatttggtggggagaaacagtgaagactgggaatcttgccacacactcaaagacttggctctatccctacttcctctgttataactgtctctgtttaatgtgtggtaaatagactgggggatgagaggctttttaaaaagagcacaaagaggtggaaagcccctcccctgtctactccttatatgtgatattgatatatattcagaatcctgaaaaataatcacaataatttaattattcacaaatatcaatcatctcaacttgcacatagaaaagaatatcttaaggatccaaaatcaagaatagtatgtacattctagtagaaagagcattggtctcagagttagaacttggattaatgaaaaaggcatgtgactggaagttagaacttaggcttcacttctttccctggtgccttgaatgttcttgagctaagtcacttaccctcattgggccttagtatctttgtgaagggttgcactaaatcaggggtgcccaatcttttggcttccgtgggccacattgaaagaagaagaattgtcttgggccacacataaaatacattaacactaatgatagctgatgatcaaaaaaaaaaaaaatcataaaagaaccctcataatttcttaaagaaagtttatggatttgtgttgggccacgtgcaaagctgtcctgggctgcatgtggcctgtgggctgcaagttggacaagtttgcactaaatgatctttaagggttctttccactcttaattctatgattcttagatctgattaccagagagcctgaggttgtaaatagcagagatttaatttatcattcagatgacttttgtttaaaatatacattgatattttttccccctaaatttcagatttgggatttagccgacacagatggcaaaggtatcctgaacaaacaagtaagtttcagatattcatatgattttttttttgagtgattcaaaataaaaaatagccagcagggttttcttgtattttgaagccaagaattggtttttaccaacattagagttttgcctagggcaagtgtgtaacaaagtatttccaatcactagatgttaatataagtcttaacagttagtgtgagtttggtgacattgttctcctggagtttatttttctgtctttcagagagactttgctctttaattaattttcctagttacatagggttataagtaaaagtgaatgttattaagtaagtgttaagatggtattgtctagtagatttgaagatttgaaaggaaactcttggttaatcacatgtgagatgtgagtattctggtctagatcttactcctgatatataaaccaaaaaatgatttataaaccagaagtaaattcttgaccagaatacataaaagtggttatggccaagggtgttgaacaccatcagtgtactctgaagttctgattgttggggatggatttcagagttgtataaggattgaattccaagtttgctgagtgccactactcaaagttaggcttcctccccacccccggcatagctaaagcaggatcaaagccagatattggagaaatttgatgagagggtcagaatatccagtcttttaattaagatttcggggctagattgtagtccctgttcatgtctctgggtagaagggctactttggtgtattggaggtataggaaaacaaaattcataggggcccacctaggtgccatgtagtcagtcagcaaatatttgttgagtacctatgatgagccaggctttagaaatacagaggttaacatgatagatgtggtcactgtcttaaggttttacagtataataaattttttacttataattgtttgattttggatattgagtttgagttgccttagtacttccaggtggctggatttatgagtctgcagttaaactttgaagttcctttggaagcatagatttttttttttttttttttttttgagacagagccctgatctgttacccaggctggagtacagtggcgtgatcttggctcactgcaacctctgcctccgggattcaagcaattctcccatctcagcctctggagtagctgggattacaggcatatgcctccgcacctggctagtttttttgtatttttagtagagatggggtttcactatattggccaggctggtcttgaactcctgacctcgagtgatccacccacctcggcctcccaaagtgctgggattacaggcgtgagccaccgtgcctggcccagatttttaagttagcatatgaatgaaagaaaagaaaccaatacttaatgaatttccatgtgacaaaaatgacagtaggcactttcctcctgcagcatggtttttattttgttgctcataatacattgcaaggtaggtattagcccccctattatggaagggttttaacttgcccttggcctcacaactataagtagcagaaatagaatttaatgcagaattatttcacttcatagcccatccatactgtggtaatagacttgattacctaagagtaattgaatctcaaatagagtgagaaaagaaagagggtcatgttagaatacttagaatactagcagttagggaagacattgactccaacagaagagacctaaaaggtcagaagagaactaggagggttttgtgaagctgtttggtggaggagagcttccaggaagatactttcccaggctgcaaaaagaataagcagtatgaggcttttttttttttaaggctattctatttggtagctaggagattatctgtgacataggcggtagtttttctagctaatcatgggagttgaagtcacattgcacagaaggttgtggaatgaatgagaagaaaatgggatatcttgaaatagcattttttcaagaaatgagtgaaggcaagggattgtataaagcagacagtctgcaaggtgataagaatgggttatgaattgggtatgaagggtatgggggagagtacgggatttcagagaagtagtgaagggttgattacatcagcgactatactagggtattgacaggttggacaaattgtagctggagtaaaggcttttgttatcatgtctatgacactaactcaaaacagctgaaaaccagttgcttcagcttctttgcatttatttattaagttttggactaagacttcaactgctaaaaatccaaggacttttgggagagatttataattattttgaagttaaaccgttacataattttttttgatgttgcacagttattttctgtagtttttctggaattgcagtcattaagtcatttgaattactgttccagtttcaaaatttataatctcacaatccagagatgacttttcataacattttaggtattattttcttttgggatttttctctaattctttttttctcatttaaatgataaaatacatctcttaatatcattaaatattatttgtttttttttggtttgtctgtttttttgagacagtctcgctctgtcacccaggctagagcgcagtagcccgatctcggctcactgcaacctctgccttccatgttcaagtgattctgctgcctcagcctcctgagtagttgggactacaggtgcacgccaccacacctggctaatttttgtgtttttagtagagagacggggtttctccgtgttggccaggttggtctcatactcctgacctcaagtgatctgcccgtctcggcctcccaaaatgttgagcttacaggtgtgagccactgtgcctggccctaagtattattttaaacatgagtattctgtatgatttccactatctgtatgtattttcccatttatgttattattagcgattcataaatactaggaacatctttctacataggatttttctgcaagatatttttgaagcaaatatgctacttgttgctacataagacctctgtagtaattatgaattgttttatatttttagattgtaagtatttgtgcaggtaggtaagttggtagagggagaatgctcttaacattcatacttttctttcttaggaattctttgttgctttgcgtcttgtggcatgtgcccagaatggattggaagtttcactaagtagtttgaacctggctgttcctccaccaagatttgtaagaaatgcttttagatttaaattgtatttaatttttaaaaagtgacaccacgttatttgaaaattaaaagtaatatattaaaaggaattctccctttggccctttcactcagctacttggcttttttccccctactggctcctgctgtttttagttaatttcttgtgtatccttccagagtgattatatatgtatatgtgagaaactataggctgggtgaggttgctcacgcctgtaatcccaacactttgggaggcagaagtgggaggatcatttgaacccaggagttcaagactggctgggaaacaaagcgagacccccatctctacaaaaaaatctaaaatttagccgagtgtgttggtgtgcacgtctggtcccagctacttgggaggctgagatgggaggatcatttgagcctgggagctcaaggctgcaatgagccgtgatcacaccgttgctctccagcttggttgatggtttaagaccctgtcttaaaaaaatatatatatataaatacttattttcttattttactttaattgtagcatgctatatattaacggtccccaacctttttggcaccagggaccggtttcatggaagacaatttttccatggacctgggagggatggatggtttcagaacgaaactgttccacatcatcaggcattagattcttataagtagcatgcaacctagatccctcacatgcgcagttcatgatagggttcgtgctcccatgagaatctaatgccaccgctgatctggcaaaagttggagctcaggccataatgcttgcctgccagctgctcacctcctgctatacagctcagttcctaacaggccatggatgggtaccagtttgtggcccagggattggggactcctgctatgcacataattctataccttttataagtagcttattaagttttagaggtatttatatatcattacatagaagcttccactttgttttttatagctgtgtagtatttctttgcttatgtttatgataattaactttctattgataggcttttagtttattttgaatctttcattattaaaaaaatgctgcaatgaataataaacttggacatatgttattttgcatgtgcaggaatgtatttatatgtgttaatttccaaaagtagaaatgctgttcaaaagtttttgcctttgtaatttctatgtattttgtcaacttgctttccatagtggttgtactagttcaccctccctccagcaattgtttgagtgcctgtttctgtacactttggctagcatactttggttaaacttttagatctttgcggtttgataggtgacagtatgtaattttaaatttatccttttggttttatggagtgaggttgaatagcttttcttgtgctaataagaatagctttcttataagcttttcttatgtttacattgcctttatgtgaatgtctgtttatagcttttgcccatttttcttggttgttgctcttttacttattgaattctagggcctctttaattattaggacattaactctttgtctgtatgagttgcaagtctttttttcctattttgtcatttgtcttattttttttgaagagacagaatcttgctatgttgccaaggctagccttgaattcctgggcacaagtgatacttctgccttagcctcccaaatagctgggacaattggcatgtactactgagcctggcttattattgtcttttgtgtaaataaattgtcaggttaaattttttttaattttttacatttaagttagtattgatctaggatgtgagtacagattttatttttatttatttatttatttttttttgagagggagtttcgctcttgtcaaccaggctggagtgtagtggtgcaatctcagctctctgcaacctccaccccctaggttcaagtgattctcctgccttagcctcctgagtagctgggattacaggcacccaccaccacacccggctaaattttttttttggtggtagagatggtttttcaccatgttggccaggctggtctcgaactcctgacctcaggtgatctgcccaccttgacctcccaaagttctgggattacagacgtgagccaccacacctagcctagattcaactttatattttttcaagatggctaccctacagaaagtatagtcaatacagtttattaaataatccatccttcacttcctgtctcttcattccctttgaaatgccatctcagttgtgtgctaaattctcatatgtattttgattgcttactcgattttttttgttcttacctattgatctatttatccataccatatgctgatgttacattgttttaattatcatatttggtgacatgttttttaaatctagtatgctagtcctccccacctcactcctttttttccccagatattttatggctcctcttgttttttgtttttttaaattttaagagatggcctcattctgtttcccaggttggaatacagtgctgcgatcatagctcactgtcaccttgaactgggctcaagtgatcctccccagtaactagttgcttgtttttaaactcaacattttagaagtttttggtctgcatactaataatttaatttcttaagtttagagaatttctgcacttttatgtttaggcatgtagtcagaaggttaatttagggatttgttgcctacgtgcattacagtcatgcattgcttaacatggtgaaatcccatctcaactaaaaatacaaaaattagctgggtgtggtggtgcattcctgtaatcccagctactcggaggctgaggcaggagaatcgcttgaacccaggagatggaggttgcagtgagccgaaatcatgccactgcactccagcctgggcgacagagcaagactccatctcaaaaacaaaataaaacaaaaaccagaaaaggtacagtaaaaatatggtattataatcactttgtttcattgttatttagatggtctagtaaatgtaaaatagtgtcctgtgtgcattgagatccagcattttgtgtgaacatatttaaatccaaaaaccattttttcttcattgcttcttgatgtgagaatttcaactcttgttgtgctttactttcttctatagcatgataccagtagtcctttgctaatcagtggaacctctgcagctgagctcccatgggctgtaaaagtaagtaaactttgtaactattctctcaccccttcattgcttcctatctactctctctctacctctgaaatatattgctatcttcattagactttcatacatgtttagggaaaggtaggggagaagctgttactggtgtttctgagggatctttcggctctgtcagttgttttgtgacagtatcggtctacttgtatatctgttataatgtaaagaaaaatggtgatgtcataatcttgtattaactaaaatatttgattaaaagatagtttaccccactggtgttatctcttacttgaaaattctggttaactatgtattttctagatgactctaaaacaaacaattctttatgaaatctttttagaaataggtattttgcattatagtttttcagagccacatcatatcgtactataaaacttgtaatttaaaaatgcttagactatagcagatcaaatgagctttgataaatgtgtacagtttttttgaaaaccatttttatttgtatgtctttgtatgctgtggactgggcactaagttttaaaagtgtgggaatatggccttgactgggcaaataatgaacaatagtttttcatgttacactaataacttttaaaaatttaggagatatcttgttattgacaagaaaaagaaatattgctttgggaaaaatggagaaatcttgatgtttattcctttagtaattattttatttttaaaaatttatttgtggctcatgcctgtaatcccagcactttgggagggtgaggcgggcagatcatgaggtcaggagttcgagaccagcctggccaacatagtgaaaccccgtgtctactaaaagtacaagaaaattagctgggtgtggtggcaggcgcctataatcccagctactcgggaggctgaggcaggagaatcgcttgaacccgggaggtggaggctacagtgagctgagattgtgccactgcactccagcctgggcgacagtgcaagactccgtctcaaaaaaaaaaaaaaaattttatttatttgaactgcacctcataccatctttagagagtcatggaatgtcactaattagctgtgtgttcttataaaagttacttttttgctctgggtctatttaagtgagagggttggactagatgttcttcaaagcccttctacctctgaaatattttgattctaacccaatagttggaaaataaagatggtgttccagctacaaaaagaatgggcaacaccagactcttgggtaaagtcactttgaaattattatttcctatgtatttttttcttgcgtatctttacaatgaatattatattttgatgaaagtgaaaaatgttttttaaatgatagtttaaaaacatatgtagtctattctttaaggacttgatttttataactgcagttaaatccttttctcttattatttaacttgtgattttgttttttattgtagcctgaagataaggccaaatatgatgcaatatttgatagtttaagcccagtgaatggatttctgtctggtgataaagtgaaaccagtgttgctcaactctaagttacctgtggatatccttggaagagtaagatattatttactccgaaatgtaatttttatgtattttaattttatatctattatgccaggagcatgtataactctttgttaaaaatatacaaatcttattttaaagttgtatcattataggattttttgttttctgacttaatgtataaaattattgccagcatatttctgtatttggttattccctgtaaaaatgagtggttgaaatgaattacatatgtaagccccttaagtaggtccttttttagtttgtgctgtacactcttgacctcctatttgcttgagttaatttctagagaccatcagtattttatgtctgccacttactctgtggctgtatcatggtgtcttgttgtaaggaatagttttatctctgaaatcataaattcttctctctaacttgtacttcctgtctttatagagctcttttccagaaactagcaagactaattctttgactggttttactaagacctttaaatctgacttcttggctgggcatggtggctcacacctataatcccagcactttcggaggctgaggcgggtggatcacgaggtcaggagttcgagaccagcctggccaatatggtgaaaccccatctctactaaaaatacaaaaattagccgggcgtggtggtgcgcagtctgtggtcccagctactcaggaggctgaggcagaagaatcgcgtgaacccaggaggcagtggttgcagtgagccgagatcgcaccactacactccagcctaggcgacaagcaagactgtcttagaaaaaaaaaaaaaaaaaaaaaaaatctgacttttttacttttcctctttttttcaatttttttactgtgataaatatgcatatcatgaaatttaacatcttaaccaattttaagtgtacaattcagtggtattaactacatttacattattatgcaactatccccaatatccatcgccatgaattcttttcctcctgtaaaagtaaaactttattccctgtcttttggtctacagcttcatatctatccttagccccctttgccatgttatttttctatctctcctgcctgatggaaaaaacatgaagtaaattatctgccttctctgtggtgcatgtggactactgagcaggtgtagtaagattgctgtcactttaaatttatcatcaccagcttcagctgggcttctccgtactgccagtcactcttgtgctgtttccatagtgatttctccataatcctcttcatatttcaaatcttaactactctctttaaacctcttgccctttctttttttttttttctttttttgagatggattttagcatttgttacccaggctggagtgcaatggcgcaatcttggctcaccacaacctctgcctcccgggttcaagcaattctcctgcctcagtctcctgagtggctgggattacaggcgtgtgccaccacgcccagctgatttttatatttttagtagagatggggtttctccatgttgttcaggctggtcttgaactcctgacctcaggtgatccacctgcttcagcctcccaaagtgttgagattacagcgtgagccaccagcacccggctgccctttctttaattacctgcttcagcagattacatagggtcaaatcctggctgcaccacttcttagctgtgtgaccttgggcaagtcattagaaagccatgtctcagttttctaatctttaaaagggacataattcccagcttatagaattgtagtgattgaatgtgataatgaatgttaagtcctgcttattaccatgattgctacatactctttgaatgctagctgctatgatgatgacaaccaccataccaccatattattactactactggatcaatgttatatagattttagatgctcaataaatatttatttaaatgccattttttagtattgtttcccactaattatttctcccctgtgtgatcagtgtgaaatttctaaactataaatacactgttgttattttattacttaaacctaactttttagtagctttccattgcacttagaataaagcccaaactcctttcaaggcaattataaccagacacttgcttatctccatttttaactctcaacagtacacttttttttttttttttttttttttttaagaaacagtgtctagctccgttgcccaggctggagtgcagtggcatatcatagtgcactgcagccttgatctcctaggcttaagggatcctcctacctcagcctcctgagtagcttggcctacaggtggatgccaccatgcccagctaattttttatttttatcttttgtagagatgggatctcgttatgtttcctaggctgtctcaaactcctgggctgaagtgatcctcctgccttggcctctcaaagtgctgggaggccatatgggcatgagccaccattcctagctcataaactttcttttcttgccctcgagtagaacatgaactgaaagaacattaatcttttttcaattattctctttttaaggtttgggagttgagtgatattgaccatgatggaatgcttgacagagatgagtttgcagttgtaagtaatctaatgttcttaacatcttcattatcttaatgattttctcatgtgcaaatttcctcttttagttcatccttagaggaaaactatattctcatcagattattgggtgaactttttttttttttctttttgagacagagtctcactctgtcacccaggctggagtgcagtggcacaatcttggctcaccacaacctctacctcccaggttcaagtaattctcgtgcctcagcctcccaagtatctgggattgcaggcacatgccaccacgcccagctaattttggtatcttttgaagagatggggttttgccgtgttggctaggctggtcttgaactcctgacctcaagtgatctgcccacctcagcctcccaaagtgctgggattacaggcatgaaccactgtgcccggctggttgaacattcttatatagaatttatatttattttctaaacaaatggataacagaaaatgtgtgttctgccatcttcattttatttggctttaaggtacataggaacgtatactttgtataattactgtaaagatagtatcttttgtatcacaacctgaccaggtatcttagtacctgcttctaatatggaataattttgcttcaaatgtatctcccaaatttcacatttccttttatttcatttaaaggaaacatgaataacacttgagtttcacttcatttatgaaggcagaaaagttttgacattttatctgaagacatgtcatcttagtaattgaatagttaattccaaatatggttgtattcacctcttccttaaaggtttgataaaactttgctgtgaattcatcagtggtaaatttctaatttcccttttactctcagattttctctttttattttggtaaggaattactaatttcttttactttcaaacttgttgctacaaatttgtgatactctctttcgtggttgttctctttactcactccaagtcttgggagtactcccacttgtatttttacttaatctgattttgtctagtttattgatctgttagaagaaccatcttttgaatttacttatcctttctattatattttgacttttaatttaatgatgtttaacatttaattccctgttacattttcttattctttttattttaaatttctcggagatgagtattatgtttcttcagttctctttatctttaatattgaaatcatttaaaggatatattcacccttgaatacaggtttagtgggattccatagatattggtacaaagttttctcctttatacagctttttagataatttttagttttattatctggttaggaatatgtttcctaattttaaagtggttaagtttggttggtttttgttactttgatgtatactttcaacctgattggattataactagaaaaatatagtctataaaatgtctaattaaaaaaattagttaaggctttctttgttgccaagtttatgacctgcttttacatatattccatggatatggcagtatttctgtttggaggatattagagttttataaattcattatatcaaatttattttattttattttattatttttatttttgagacagagtcttgctctgttgcccagtatggagtgcagtggcgcaatcttggctcactgcaaccaccgcctcccaagttcgacgattctcccgcctcagcctcacaagtagctgggattacagaagtgcaccaccacatctggctaacttttgtatttttagtagagacagggtttcaccatgttggccaggctgctcttgaactcctgacctcaggtgatcctcccgcctcagcctcccaaagtgctgggattacaggcgtgagccactgcacccagcctcaaatgtattgattatttagtttctctttgtccttatttttcttttgtttttggcccttccttagattttcctcattttccacaagagccagatgaaataggcagaatacatattaccacattttaaaaatgcagaaagagaaacttaaagtgacttgaattcttgttcacaggtacctaatctttttaattttaatttgaataatagttgggaaatggtaaaggatactccctcgcggtggtgacaaaagttatctcagtcgcatttcaggggttgagccattgtttgtgggatgcttttgggaatggggccgtgctgaagagatttcggtgatgatatactttgaaacatcgtcaaaccctacacataaacttctcataaatggtttttgtggtaagaatattggtgcaaaatctttgcatggtacgatgtaatgagggattttttttctcataaagacaaattttttttttttttagacggagtctcactctgtcactcaggctggagtgcagtggcgggatctcagctcactgcagcctcggcctcctggattcaagttattcttccacctcagcctcctgaggagctgggattacaggcatgcaccaccacccccggctaatttttatatttttagtagagacagcgtttcgccgtgtttgccagactggtctcgagctcctgataataggtgatccactcgcctcggcctcccaaagtgccgggattacaggcatgagccacctcttcaggcccaagacaaaaatatagttagagtagatggggaatagtagtgtcatcatttgataaacagtagtgcatgctaaggtaaatgaataaacacaatttatcttatatgcctggagcctattcccaggtaactggccttttttttttttaataaaaagctttattaaaaataatttttgaataataaatacatttgtaggaaattactaccttgaattttgttttaaatagtagacacccctttatcttctcctagatttacttgttaaccattttgtcacatttgctttctccctgtatccatattcttcagaattttttcctagttttaaactctagcttgtgtgattttaatactgcttctcctgttccctctttttttgaattacctgatatttcttatgtttgttgtgtatgtctcttgaaaatggcagatttctgtattttaatgctttacctaattggatagtttttaagataatagcacttatattgatttgattttcccttctttaccgatttattttacatttttattttctctgtttcttactgttgcttattatcaacttgtgattcattcccttaccccgcctcccagttaatgtggaaattttgttataatgtcttgtttcattaatatagttaatacaggttgagcatccctaatctgaaaatccaaaacttgaaatgcttcaaaatctgaaacttttgagtactgacatgacccacaaagtggaaaattccactcctggtctcatgtgataagttacagtcaaaacttttgtttcatgcacaaaattattaaaaagattgtataaaattatcttagattatgtgtataaagtttatatgaaacataaatgaatttcatgtttagacttgggtcccatccccaagataggataatattccagaatctggaaaaaaaaaaaaaaaaaaaaaaaagataatattccaaaatccgaaaaaatccaaaacacttctggtcccaagcattttgggtaggggattcgcaccttgtgccccttttcctgtactagtacttatttctcctatgttgaaaacaagattttcaaccattactctagcaaaatgagtcctttagattatttttatttattttcttccccatcatgttcttttttttagttttaatttttattttttttgagatggagtctcactttgttgcccaggctggagtgcagtggcgcgatctcagctcactgcaagctccgcctcctgggttcacgccattctcctgcctcagcctcctgagtagctgggactacaggcgcccgccaccacgcctggctaattttttttgtatttttagtagagacggggtttcactgtgtttgccaggatggtacttgatctccctgacctcgtgatctgcccgcctcggcctccaaaagtgctgggattacaggcttgagccactgtgcctggccccccctcatgttctaattccagaagaccttagaacattttttgtgactcaaattctagattttgctcagttaatttatttcttttggttttggtatttttcttccagttttgttcaatattaataactagtattcttttggttagaatttgtctgataaatctttctttatccttttactttaataaatagagcaacataatctgtactctttttaaaaattataattactgcaagatagcctgtgtaactacagctgcaagtcattgatttgtttttatttacaagcatcaatattttacaaaactgaattttgagagctgatatcattcttccttgaaaattgaagtaatttaaaaaatacttttgcagtagtgacgtagctaagatctgaacattttaaattatcctcctaaataataaaatataatgttcttatttatatgatcagtccttttggcctatggcagtttatactctgccaggattttggtttgttgaagtataatacaagtttaggtcttattttactagataatcaaaactgacttgaacataggaatctttttgttcaagacttacctttaaaattcttgcccatttccccttgggttaaatgctttttgtttgtttgttttaaagaccccgtgtctgctttgtgtttatttttttgaatgggaaaaaatgaaaatgaagttaaagagaggactctaacttggggtgttgaatttcagtatagattttttaaaagagtaacttagtaattaaccaaaacttgcttgaacttgagtctttatgtttagacttacttttaaaattcttaacccgtttcttttattttatagcataaatgagatttttggttggtttatctttttagttagaataaatgaagttaaagattctaacctgtataacttctgttgccatgtgaacctttgatgaatggcccttgtttcttttcaaatgtaaatgcttgttcatattctcagaagcccagtagtttaattaaaaatccagaatctagaatatcttttagttttttggttttttttttttaaaagtaaatttgtaaaagttaggccttggcatgaccatgggtattctggccacaactaaaatgacttcagagagttttgtgtacgtggaatgtataatgtatatatgtatgtacatacacaaaaatagatttaaaaaatcatatctaccccctcaaatctggatttttaaaatatctgtgattgtgtatcagtattctgtttactcatggatgaattatctgactagattgtaaggatattggaaatatatttccgagtttaacttctggcccatttggctttgtagaaagtctctgatggagcattaaggcgacattttgtaaaaggagcaaatttttctttttctttcttttcttttttttttgagagtctgtcacccaggctggagtatggtagtgtgatttcggctcaccgcaacctccacctcccaggttcaatctgttcttgtgcctcagcctcctgagtagctgggattacaggtgcccgccaccacgcctggctaatttttgtattttttgtagagatggggtttcgccgtgttggccaggctggtctcaaactcctgatctcaggtaatccacctgccttagcctcccaaagtgctgggattacaggtgtgagtcaccgtgcccaaagggccaaatttttctgttatgatttgaaaactagaaatgtatctaaaattatgctactgccagtgaaccaagggaagtgactgataattatgttaaagtttattctctttgtggggtaagttctgcaagtgtatagtcctattctgtgaaatagttctttgttttattagggctgaaactactgctttttattttaaagaaaaggcccgtaaatctaggaatctagtatttggtgaatgagcctatgctcatgatttttgtagatttagagtttgacaagatcctgtaatttagcttctttaagcacagcagttcctggcttacaacccaggctaacctgagccttctagagtcatgctcttttttttttttttcctaatgaactttaaattttggagtgattttagatttatagaaaagttgcagagagcacagttttccattccccttcgctgttttccctttttaccatattacattaccatggtacatctgtcaaaactaaaaaaccaacattggtgcattattaactccagactttatttgggtttcgccagtttttcctttctgtcacaggatccaatctagggtatcacgttgcatttagttgtcatgttttcagtctctctggtatatgagtttgtcagtcttgccttgctttttatgaccttgacatttttgaagaatactggctagatatcccacagaatgtctcccaacttaggtttgtctgatgctattctcgtgactagactggacaaatgagtttttgcaaagaataacacggaggcgtaatgcttttgtcatcacattatattgggggtacatgatatccatgtgacatcactattgatgttaaccttcacttatttaagataagtgtttgccagatttcaccactgtaaagttactttttcccttttcctactctattctctggaagtatagactcatgccctttttactttgctgtttgtctgcatatctatctattggtttttacattcttactaagccttaaatttttctatcaggtaagttcttagactgaaagtggcttaagcttttgtcagtaatatttgtttgggtcttcattatgtgaagagtttttggcacttagagatgtatagaggagctgtttttgtgtgtattagtgtgtatcacgttgtattaaaattaactgtttacatatttcctcctcctattgggtcgtaaaactgagcacgatcttttccctttttttttttttttttttttttgaaacaaagtctcactctgtcgcccagactggagtgcagtagtgagatcttgactcactgcagcctccacctgctaggttcaaacaattctcctgcctcagcctccagagtagctgggtttataggcacctgccaccacgcccagctaatttttgtatttttagtagagacagggtttcaccaaagtcttgggctttggccaagaattaaaaaccctccaggtgattctcatggtgactaaaatttgagaaatactgcctaaaagcatggaaaatgaaaaaatatcagagaaagtggacagctgttagtaactgattgcaacagtaaaattaaatcccctctttccctcctgtctcaggagtttgatacttttattattcttattaataaaattttttatacttttactttgaaataaaaagacattctaaatgcttcttccttaagtgtctctttctgtgtaaatgcacttgctagtatgtttcagtttgacaactagttactaaccagattttttttggtgtgtgtgtgaatgcatttgatttaattgcttttgtttcagtggcatacttttaataggaataagtacaatataataagaaaacaaaatcacaacccagcagtattaaaagtattctgttcacttttgctcttttatttggaggtataatttttggctttagttttgccagggaaactattttcaaggcaacatgaaattaataatatatatttttaactttcataaaaatgtgttgtctattggcagcagatggctaacgttgctttttcgcttctagtgtccacttttccaggaaatgactcccatctgcagcaagagaagtgctgactgttaatgtgtacactaggcacttctcttagctcagtgccattctgacaatttcacagtacatatattgtgaatttggttggaagtgtatgttagtcagattgttttctttctggagtttcaggcttttggaaataaaaagtttgtgtgtttctaaaactgaaattgaattcttctaggttggctagtgaaaaaggagaggagaattcttggttaagtgtggttcctggacaaacagcatcagcatcattcgggaacttgttaaaaatgcaaattctcaggcccaaccttgctggttagaaaattctgagtgcaggggccagaaatctgtgctttatcatgctgtccaggtaattctgatgcctgctaaaatttgggtaccaatgggttaaggtttagttttatcgcttgtaaaggacagcgtggtattgtaagattacatatgtgctgctaataaagctgatcaaatttggaaaaaacaagagctttgtagccagaagatgttggtttgaaccccactgtatcacttcttaaaaatattatattgggcaagttacttagcatcttagcttcagtgtgttcatttgtaaaatgagattggtaatcctggaaatcagtgatgaatgttgttgcattgagtgctcaataaataaattgaggggttgggtgtggtggcttacttgatcccagaagtttgataccaacctgagcaacgtagtgagacccccatctctgcaaaacataaaaaaattagccaggcatggtgacgtacgcatgtagtcacagctacttgggaagctgaggtgagagactcacttgagcctgggaggttgaggctgcagcaagctgtgttctcgccactgcattccagcctgggcaacagagtgagcctttgtcaataaattattaaataaaataaacaaattaaataaatatataaatatatgtgaaagccccacaaaacttaatatatgattatatgcaaattttctctggaagaaaaaatttaacaagagactgggctcagtggctcacacctgtaatcccagcattttgggaggctggggtgggtggatcgcttgagctcagaagttggagaccaaccagcctgggcaacatggctaatcctcatctctttaaaaaaaaaaaaattagctgggtttggtggcgtttacctgtagacccagctacttgggagactgaggtgggaggaaggcttgagcccaggagacggaggttgtagtgagccaagattgcgtcactgtgctgggcaaaaaacaaaccaaccaaaaaaaaagaaataaaaatttaagaaacatgcaagctttcttttcgtggttgctggactctttctagaggttccaagttagtttgagtgatttcatatgctaaaagatagttatggaaaactttcatgctctgaaagtgttgaaggtaccttgaatgctttaaaatgaagagaatatattctgggacagtctgtatgcaaatttttcccattttgtgcaagtgctttatgtattaaaaatacttgtcatggttcaagaatcaatataagaagatatacagtgaaaaaaatctcatttccacccctgctctcaattgctccatttatccctattctatgcctaattttcttaatttcttatttatcttagaatttctttttttttcttttctttctttctttcttttttttttttttttttgagatggagtctctctctgtttcccaggctggagtgcagtggcacaatctcaggtcattgcagtctccacctcccaaggtcaatcaattctcctgccccagcctcccaagtagctgggattacaggcatgcgccaccacgcctggctaatttttttgtatttttagtagagatggagttttaccatgttggccaggctggtttcgaactcctgacctcaggtgatccacccacctcagcctcccaaagtgctaggattacaggcgtgagccaccacgcccagcctatcttagaatttcttaatgcaaatataaacaaatataactaattatttcctccttaccacaaaagataacccactaaacacactgttcaacactatactttttcatagttaacagtttatcttggataccttttcactatgagagctccatgattctttttttcctggttagcattattcaaggctatccacaacaaactgcatccaatttaagtatataatttgatgagttttggcaattatatgcctgaaggcaccaccacagttaagacacacaatgttctttgtgatttttttaatgctttatagtatttcattatatggatataccatttttaaaaataatttttttaccttaacttcccagtgtagagtataccataattttttaaaccaggttttgtagatgggcatttgggtgctgatacaaacggtgctgcaattaatctttttcatacagcatttcatatggatagattcccagatgtgggattgcagagccgaaggggaaacacatttgcaatttggtagatgttgccagtttgcccttcataggggtggtaccaatttgagcatgttaggggaagaaaaataatttttcctatacccttttaagttcttggctgagaaccctgtaacaaaagataagagaaaaacagaagtttattaacatgtatatttcatatatacatggaagaaactcaggaaaggagtaactgtcaaataggtggcttacaactcaggtttgctcttgctcctgctcttgccatgtgacacgtctgcaccccctttgccttctgccatgattggatgctccctgaggcctcatgagaggcagatgctggagccatcttggtacaccctgcagaactgtgagccagttaagcctgttttctttataaattacccagccttaggtatttatttatagcaatacaaaaacggactaaaatacagccccccccagtgtggcctttccatcctaggagctgcccaggagtgccctggctcctgcagggtagcagttgggagccttatgtcccacgttgtgcccaatccttcaccacagctagctgaagcccaaaaataccagaacacatcctctccaaattctgagctattaggaatacctccttggccatctcttgagtgatccagtaagaaagagaagaagagcagcatctgacatccagccacgggccaggcactcacagcgaggccatgtaattttcctactgaatcttcagtggagcctcccttatgccttttccacaccctggaatcaagctgccctgcacttggagttttttgcaaccatggcttcctcctggacttgttcctgtggtcccacccagaagccattcaatgcacaggaggacaatttcccgtaccccaagattgcaccctcagccagtcagcagcaagcacccattgcctagccacccccaccccttccccaaactgtctgaaaaaccctagcccccaaattcttggggagattgatttgagtaataactctgtcttccgtgtggtgtggccagttttgcatcaattaaactcttcctttactgcaaaagaaacttagcctaatatagcatctttaacaaagaacaatgaatttttttaactcttattttaggttcaggggtacatgtacaggtttgttatataggtaaattgcatgtcacggggtttggtgtgcagattattttgtcattcatttaataaatgataggtagttttttgaacctcttcttccctccaccctcacattggccccatgtctgttgtttccttctttgtgaccccatttactccatgtttagctcccacttagaagcaagaacatatggtatttgtttttctgttcctgtgttagtttgcttaggataatggcctccagctgtatccattttgctgcaaaggacatgatcttgttgttttttgtggctgtgtagtattccatggtgtatatgtaccacatttttttaatccagtctaccattgatgggcatttaggttgattccatgtctttgctattgtgaatagtgctgtgatgaacatatgtgtgcatatgtctttatgataaacaatttatattcctttgggtatatacccagtaataggattgctgagtcattgataattctgctttgagttctttgagaaatcaccagacttttctacaatggctgaactactttacattcccaccagcagcattaagtttgttatgtaattcttctggcgacacctctaggctgataagggtctgaattcattttgggcaggaactgttatccttccttgtagagagggcaagagggatacctttgtaaatttatatcctgcttttaggcatatagaaggagggcagagagcttttatttatttatttatttttttgatgctactacttctcagttgctttcagttcaaaataatccttatgccaaagtggaatgttttggggtagcatgctaccgctcagctcccaccagcagtgtaaaaatttccccacagtttagctaacaaagtatattatgaaactttgagtttttgccaattaggtagaaaatggtatttcagtatagttttaacttacagttttcatctgagattgggcattttttttatgttaaagaatggaccatttaagggatttgcttgtctgtaaaatatctcttcaaactctttttccatttttctattggacttttttttctgttaatttttaggagctctatatattagggagagtacttctttctttgcatatgttgtcttctcaaattgttgtttgcctttgacattgcaagaactttagttgaagggtacgtctctaaatttttactaaggatatcttcctaaaaatttcttagtttttatttctttctttttctccctcctttcatccctccctcattttcctcttctttccctcccagcccaatttcttaaaaaaggatttgagagcctgacgatgatttatcattgaacaataatcaattcagtgggtggatgttaagtgcttttaatatatatgaccctggttcatttattttgaaggccatgtttttggtatactgtgcactggagaaagaacctgtgccaatgtccttgcctccagccttggtgccaccatctaagagaaaaacggtcagtatatcaggctctgtgcggttgatcccctcttcagcatcagccaaggaatcttaccactccttaccatctgtaggcattttacctaccaaagcaccattaagacaggtatagatttatcagtgttaaaggatttttttttaacaaagtacatggcatttaacagtttactatttgacaaagatagagcaattaaaaggataaaaattttagagcaccatctcgttgaacctgcataatgtgatactccagagaagacagatattccttctacattaggccttgggtcatatggatgttttattggttttattttgatctccctggaattaaagttagaaatggaagatgctccatgctaacatggcatgtttgccctggcataattaatagttgtttttatttttgtttaatacctagttaactcttgattctttgggatcaaattattgaattctgggttgtccaaggcttttttttttctgcccccagcctgcctcttgtcagattgagtaaaggaagataatgacaggatatgcaaatcagccagtttggctatggttaacactgctgggtcaaactataaaaaataaagattgagaattatctgagtattttgtttatacagactttcagttacctatattaatgtgggcattagtcaagagttaactatgtttgaatttactcatttcttaaaaaaaagtaaaaatgtgcacctatggataagtcctaactgacctgtattttcttctgttattttctcttccccacagcattttgattgagatgtcatatggaagtgatacattgttgctctgagttagtagggtagaattgttcagaatttgtgatggatattgtaatggattgaaagagtgacacttcaaagtttgtttcattttggcagaaatactgttttttttcctccctgtagtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtaagactttatttgaattgattttttaaaaatatggttttgtatcaattccagtttctgcattttgatttttagtcatttgtaaataggacagtttttgtttcagaattttttatagagaaaatcagaatctgaagaattcttctggctaatggacaaaagcttgagaatgggttacctgaagctttataagattgacagcatccgctgggcatggtggctcacgcctgtaatcccagcactttgggaggccgaggtgggtggatcacctgaggtcgggagtttgagaccagcttggccaacatggtgaaaagctgtctctactaaaaacacaaaaaattagccagacatggtggtgtgcgcctgtagttccagctactcgggagggtgaggcaggagaattgcttgaacctgggaggtggaggttgcagtgagctgagatcacgccattgcactccagcctgggcaacaagaatgaaactccatctcaaaaaaaaaaaaaaaaagaatgacagtgtcagttaattgttattagaatgttaaaatccagcttctgtttatatcaattaaacttaaaattttcagagagaatccagatatctgaaatttaaacaatgtaaaaaacagtatcttcaaggcatacctgcataattttatagtgtatatgtatactttcataccttcacataggaataacatacttggtccttgaaaaggcaaaccctagtgtctttaatgaatttcacagaaaatgagataatgtatatgaaaatgctttatagtttgtctgccgccaatccacctaacgataccagaggttatcttcaggttttcaagaggcagaaacgtcacaagtggggccacatggttgtaaagagaaacttagaaaagaagggaggcagacagtaagtagatctgccttaaaagaaacaagaacccaagactgggaaagattaaatatgcataactagtagtagctgccactattgagtgcctagggtaggcactatactcaataaatggcagttgtcacgggcttaatgttatgcctaagctttttatatatcctgtctttaattctcatagtaatttcgcaagatgggtgttatcatctccactttatagatgaggaaactaagatttggagaggttaaaaaacttagccaaggttataagaagaaataagtagaaaagctggaatttaagatctatgtgacatgtagtctttttacttatgtagtcttttcatcaggccctactggccttcagtgcattaaacagatcaggatttcagaaagctgagctttttttttttttaattacagaaaaagaaagtagagtaaaacctttgcagtttctcttcaagtgattgtgtaaagctttccagattgctgccttttcctcacatgtgatttccatttgcagctgtttattctgctttggcttggtgatccttgtatcctcctactccaagagttgcaggaggcatagcaatatcaaaattgtgcttgttttagaatccttctaatgccaccagtgaatcaaatttgttgagacttagattttatctttaatatcttttaatgttaaaaatgttgggtgtaaggaatgttaggattctttggcccaccacaacttttactgtatagtggttctgaaaattggtaagaaaacacaaagtgtaaacccagattagaggctcctgctcagcaccagggtgaacattctctttttaccatcttagctgatctacctcttcgaacagttgagtgagtttttaataacctgcaagttggtgtgactgtctttttaaattcacctcattattttaaaaaagctgcatagtggtactttttctctggactttttgcagttgtggcacttacataccattcattttgtttatttgtgcaggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaaggtaagaaagcttaaaaggaaacctgaatgtattaatttcaaaggaacaatactatgtcgaattacagattcaatttggatgaaatagaagagaaaatgtatctggctaagagcagaacagtatactgtttgtggtttagtttgtgcctataaatatgctggagtgccttgtataacatccttggccagtagcttgtttaccccattcattaaacatgacaactatatttccagtcttaaaattggaaaatgtgggcttatttttcctttcctggatttgtgaattaagttttatgaatagattataaaaggaaagctataaaaattaaattattgtgtttcacttgatgattcactcttacataaaatgatacagatttgaaaacagaatcttgcatatgatggttgcttggtgtcaattttacatcaaaaaagcctccaaggaaaacattatgttgaggatgtatctgtgcggtttttgctgtaggtgaccttttgttcctgagtataccactgaacttcatatttgaacagctagaagtgggttttacctagttttggtttctggacagcagtgagaattttcaaaacttcattgttttagtcatgccttgatttttctctcctcatgtagaaacccttcctagtatgatgcatttgcaatatcttggcctttaatagacctttgaaaggacttgcataccatagtggctatttgcctttaaaaataaatactttgtatttttaaatctcttatggcctataaagtataaccatggctgtggagatttttcagggttgttatacagtaataagagttgtcaaatgtgtggtatgaggagagctctttaaaatatcatagaatattttgggttttgcattaattttgtcacatggttcttaaaaatcccattttaaaaagattaataaaaaccaaattgggaccaagcacagtggctcacacctgtaaacccagtattttgtgagtccgaggtgggaggatcacttgaggccaggagttcctgggcaacatagcaagaccctgtctctacaaaacaaaaacaaaaaaattagccaggtgcgttggcgtgtacctgtagttctagctactcgggaggctgaggcaggaggatcacttgaacccaggagtttgaggttgcagtgagctaagtaagatccaactgctacactccagccggggcaacagagcaagaccctgtctcttaaaaaaagaaagaaagaaagaaagaaaattggatttttttggtaagctaaatggaatttatagctaccaggtatggagagttacttatagaagtttttgtccttatttgtaataaaataaatattttattatctgctttgtgagttatggggggggcctttttgtgaattttttgattccttatgatgtatgacatgagtcccttaagttgtggaaaaggctgaaagtgatgccacccagaaggataaaggttactgaatatgcatttttgctctttgctatataactgtacctcagttatggaatactgtgttgtttcatgctttctttcacctatgcagactgctttttttttttctgccttcttcattttataacctattcaattgcctaccaacacaaattttagatatgacagaaatttctgaagcaaattaaaagtttgaagtctatgttagtagatgcttgaagttgcatgaggtatagtttttaatttagtagatttgtctgaagttcattcactagatcatagatacgtttgtctatttatgtcagataccagtattattcattgaaatgggaatttatcactgctatcttatctattaacccaaaattttaactttaaaaatgaaaacttgcattgttttatctttcaaataacctcttttctctttaatctggtttttttagtactgcattttttgcagctttgactaatccttttttgaatgttgctttcctttctgtgttttttctagtttggactattttttccattctgcagcactctgcttttcgcctttcttgtactgtcagtttcttaactctactctctctcaaggttagagctttactttatgccttttttagctttgtggtttttggtttacaagatacattttgaaatgagaggttttttattcagcaaaaaaaagaaaattcctaaacagcatgcttttgtcacatgtcacttggtccttgtgtgcattttagtctgccttccctaggctctctgatccacttaacatcaccaaagtagaatttttgtgtaatgcacaagaatagggtaagagaaaacattttgaaagaaggggacatgctacatattttttctcatatacccttcaaatgctacataaaatattaactaaacttttttcagtatctggggtgtcactttctaacttgtttgaggttaaactaatttgtctcactttgtcttcttatttgatgatatttttacaggcaagactataaaatgtgagtcacctttttttgagttagagtgacagaggagatgtggtagtcacaagttctttggtacatttgcacctctgatagcaaatttctgatagcatttaagtgaagtaatttactcttgctgataaaagtgagaccaagtgctaatgtttcattttgtttagctgtctggccaggcctagctcataggtcaagtttagatagagttaaaatactagtgaataattgtcacattcagaaatccactttaaaatatctaatttaatttaacactgataagtttttgtgtatcagtggaacacagaaaataggaggtatatttcatacaaagctgtaattaatataaaattgagattagtattaaacctttgtagatgagttttggtactgatagtcaaaacagctcagtactaaaactgcagtgtggcataaagaaatacagaaggaattacttgccaaattttattgatgtacctgttttatcaaatttacttttagagtaataatttcatttaccgaaatgatcttgatatgcaagtgccactgggggcattgcgtgaaatagcacttaaatcggaagactcttgattaaactacgtattggctgggttcaactttgagcaagttatttaatctgtttcttcagttctaagatggggttaataacaatatctgccctacctactacccacttttcagattagttttgagaattaactagtggaatttaaagtgcttagtgaattgtaaatgagtatataaatatgaggagatgggatattgtgtgcttttaggtttcttctgttgtgcaagttgttgacgtaaattaactatacaacaacataagtattaacacaaagtcttatgttctgttatataaagtcagcagtatatcttagtttttaaatgttcaggcctcagttttaacatttccagatggtaattatcctgttatttgttaatctggttgtagcattgggtgtagatgaaatgtttgaggaagcatttatcttttcgctctgacttcagctagctatctggggcatcagtgatagtttacagaggacattgagccaaggtagaaacaactcaatgggaggccacatcttttaagagcatattctgttgaagagttaattataacaatagcttacatttataaaatatcacagtttgtagactgatgtcacatcacattatttcatttaacttgtaaagtgggcaaggcagagattatttccctattttacaggtgatgataatgcagttagtaaaatagcaggacccagaataaacccagctagattttctgaatacaaggaccattcagagaccaattttgtaaccttcattgttgaaagaaaactgtatggacaggatgtcatatatgaagacagtttcatatatgatggtattaatatttattatggaacatgcttgagcagttggttttactttaaataaaatagacacagtatgtaacaaaagtaaaaattccttgaattaaataaaatcaaccactactgtaggtctgagattcaacaaaaatttgtgtgtttactctcagccagtttatacaaatacaaataaatcaccatcagtttctctgagaaatttacacttcagtggaggaattagtttatgaatctggcatctcttttactgcaaggttctgaacaggctaggatcaagtgacaaagacattcggatcggaggtggggatggggtacatagtatagaataacagttttcggagaatttaagggaaatgtaaatgtcttactatataattaagtataaaattatatataattgtactagatatgattttcttaattaaaaatctcagtaatacagtaaaatatgcaataccttatatctgcgtagagctttaatatttttagtgttttgtcttatattacctaattttatagtaatgtataattgtgaactttttgtttttagaacatcataggatcaagtcctgttgcagatttctctgctattaaggaactagatactcttaacaatgaaatagttgacctacagaggtatgtaaagcaaaattacagcctactcacatacacacacacacacacacacacacacacacacacacagtacatgtatatatgtatacaacttcctccccacacacacctttctgtttctaatgtatattttgataaatgctacctaatatttggttaagtaccacagttctgtttaaacggagtcagtgtacttcatcatatatgaggcaacctttaattgcaggatacactgtttacttatgtaccactgaaaagtcactgccaaataaacaatgacgtgccattaactataaggtactgtttgatttcatttagagaaaaatgcgaaaaaacgtatatcctagaatgactgaaaaatagtttttctccaaccttagatatttgaataacatattagaaaaacattatcatttaatacatttaatagatggaatgttaaattcagacaccatgccaagagctttcataattgttacttgaccctcacacaaaccttgtaatttgagataggtggtggtgtttctgttttacaggtaagaaacttaagatgcttagatattttgcccaaaatgatacaagcttgtcagctgcagagctgatacctgatcccaggactactttattctaagttgaatcttctttcttatacataggtactatgtagaacagactcaaatacaatttgatttgaatctgagtatagcagatattattggtacttccttaatttccgtgttccctggaaactttatagtaatactgattgtaaaaatgactataaaattactttttaaaagtgagataatttttctgtctacagggcactgtatctaaatattcacaccagtctttttctttttttaaccctcacaacactttgaagcagataatggctgatatactttattttactgacagtattgagatataaggagattaaatgagttaactgccttatatggcaataatttggcaatgatcttaaccttatctgtgagactatgttgagatttctgtagaaaaactggttgttagaatttttcagttgtaagaaagaactaaacccaaactaagagtgaaatttattgacttgtgaaactgaaacctttcagaggtagggctggcttaaagcattccttgatattgaggctcagatgatataatcagttctcttgctctccatttcttgtttccatttccactgggttgattccattctcagatagactttctccttattttggcaagagggctatagtacatctagctacatgtacttataatttcaaatttggtgaagagtgcctctcttctggcatttcctggaaaagacctgaaattcagtctgattggattggcttattggccttttcctatgacataaaacttctaatattgaaatctgaccagggcaaaaaacacttcgtggtgattgtatagtttaattttgtccttactcacggaaaaaaaaaaatcaaatccaaagtcacacatcacgttaagagacagtattggtatcaaaaccaggttgtataagttcagcattctttctgttatacaattctgccactcattaggatttttaaatttttgactttgttgcaaaatagaagtagtaaacaattactgaacctataatggtgtttatactgttcattttcatgtggtccataaatggtccataaacatttttgctttccttatatatgtaatatacatgttatagtaggtagatttgaaaatacttatcatctgggcctcttaagcctatgaaaatggatacatacaccaatgttctaggacttgcttgatttgacttcaagtgtacttgtttaatgtataaaatatttctataatgaattttaatgggaattagagcatcatagaaaaaatgctcttactgttgaaaacattatttgttacattttggtcaactaatctttcaataacttttagtaactataatgttaagttgtaccagtggcagtcttatatagtaaatggcagctgacagcatgaaaataacatatctaatattttgtgactatcttattaggaaaatcagagaatttcaaaaccttgttagtttttagggtatagtcacattttataaatgtgcggtatatttatacatgatttgacgtttgtgaaaatattttccctggacttttattttagatgagatctacagtgtaggcaaacttatataatctgtcaactccattagtgtcatagtcagactcatccccatgctaaaattatagttgttaaaatacgcttttgtaaatagttgtgttaggtcattatcaccaagtcttcaaggtattacattataaaaaccttggtttttattcttgtgaataaccgttttttccatgcaaagttaaaattcttcagcctttaatttttttattaatatataaggatgtgatgagtatgactacaaaacaggaaaaaataaacagatttcgtttgtggcttttgctaaattgttacctgacaaaatcttagccagttcttcattttcgttttgagatgaagatacttagttttagtccaggggctgggcgcgatagctgatgcctgtaatcccagtactttgcggggccgaggcaggtggatcacttaaggtcaggagtttgagaccagcctgcccaacatggtgaaacgttgtctctactaaaaatacaaaaattagacaggcgtggtggcacacatctgtaattccagctactcaggaggctaacacaggaaaattccttgaacctgggaggcagaggttgcagtgagccattgcactccagcctgggcaacacagtgagactcttgtctcaaaaaaaaaaaaaaaaaattttttttttttagtccagggatcaaacctctaagtaagcagcatgtatgatgtgaaattgtaattactgtataatgaatgtagtactttataatacttttttcttaatgatagttataatacatattcattgtaaaattcaggaaatagataaatgcataatgaaaaaaggaatatatttcttagaatcatattttgttttgagcattgcaaaccaatggaaatattgaaagctatatataaacttgagttagttgggtgaagaatgttctttgttattggtcagaaaatgagatttcgttgtctttgttttcatctttagttcaccaaattgtttctagtagaaaatataagacattgggagcttgaagtgcgagatacctttaggtatattttaaaatttttttctgtgatttcttcaacatttgctattaattaaatgatttaattatgccaattagattaaattagtatgatatttttaacttaaggaaaagcaatacaggtagttgtaatataacactcatcgaatatctgaatctcttacttgagctcaagacctgtatttttcattgcctactagtgttttcatctgaacatctagtaggatatgaattccctaattgtcccctcacctctgttttgtatctcccttctcagtgacatcaccattcacccaatcactcaagctagaaacctgagatttttcttcttctcatctttagtcttctacctttgaaatgtctgttgaattgattccttaccttcccatctcttttgtctaatcaacttctcactcttcaaatctcatcttagacatcatttcctctgggagaggaagccttccttgatttacctcccaacctccatactctcttcaagtcttatttaagagcctattttatgtagtctttatatttacaactgttataacacttatcattctttgttataattctgtgttttttaatctcccactagattatgtgcttcttaaacacgggctgcttgtatccctagtgtttagctcataatagatgagaaaataattttttcaatattgttgaaatctgtcttctctgttttctatgtttccttcttagttttagcctttgtcttttatctggatcatggctgtaacctcctcattggctctctgctttgagccttttcctcctttggaccatcctacttccaactgatatataaaatacaactcagatccctcagtgacttcccatctccaactgaatccagttcacttctttgaacatggtgtaaaggctcttccttcatggtgttctcttggcattctgaccgttctgtcttagccacctctcacagtatgctgccctgtggtactaaaaagctatttgagaacagatacagtgtgtttgctctttgtactctgagtgttcagtacagtactcgaatctactatttcagctttgttccctttctccagtcgtatgatagatgggtttattacctcttacttcaacataccaccacttttattcttctatgcctctgatcctactgttcgcctttgcctggagcataccttttaccttataaagttttgttcatgttcaagacccgtcttaaatattgtctcttctgtcaagccttccatgaaatcttcagattacttttctttcctcttcttccagaggctttattcgtttattgtagtatttctactgtttaactatagtaatttatattgcttttttggtaaatttttaattcctaagggcaagagctatgtcttgttcattttgataggcctagaaattaacacacacattacttaacaccgaggaataggctagttggttgaatgaatgacgcaaagtatgttataaatattagaatatttccaagacttacttcctgcaaagtttatggcagaatagaagccatgtgttaaatgttgaactaaggcaaagaccttctgaataatagcttattttgaagactataggaaaggattttaggccggacacagtggctcacacctgtaatcccagcactttgggaggctgcagcgtgtggatcacctgaggtcaggagtttgagaccagcttggccaacatggcgaaacctcatctgtactaaaaatacaaaaattagccaggcgtggtggcgcatgcctataatcccagctactcaggaggctgagacacgagaatcgcttgaacctgggtggcagaagttgcagtgagccgagatcactcacagccgagatcactccagcttaggcaacagagtgagactcagtctcaaaaaaagaaaaaagaaaaaagaaaaagaaaaggattttatatataaaaggtttttgaatcctcacaggaacattaaggttagtgggctgatttttttttttaaatattctgcagacttagtttttcttttttttcacatgtttaaaaattgtgataaaatacacataacatagtaatttatcatcttaaccatttttaaacatacaattcagtggtatgaaatatattcacatggccaggcacagtggctcatgcctgtaatcccagcactttgggaggctgagatgggtgaatcacctcaggtcaggagttcgagaccagcctgcccaacatgatgaaactccgtctctactaaaaatacaaaaattagctgggcatggtggcaggtgcctggaatcccagttactcaggaggctgaggcagcagaatcgcttgaacccgggaggtggaggttacggtgagccgagattacgccactgcactccagcctgggagacaagtgcgagactccgtctcaaaaaaagaaaaagaaatatattcacagtgttgtgcaaccatcatcaccattcatttccaagacttttcatcttacaaaactgaaaccccatacccattaaacaataactccccatactctactccctcccattttccccgcccttcctcatagcagccaccattctattatactttctatctctatgattttgactactgtaactatctcatataagcagaatcgtgagatatttgtctttttatgactatcttatttcactcagcataatatcctcagggttcttctgtgttgtggcatatgtcagaatttccttcctttttcaggctgaataataattccattgtacttacataccacatttgtttacctgttcatctattgatggacatttgggttgtttccacattttagctattatgaataacgctgctatgaacatgaacatacaaataccatttcaagaccctgctgtcagttctttggagtatatttgcaaaagtggaattgctgaatcatggtaattgcagacctgtttttgtgtcaaggatttcctttgaaaatctgatgaagactgttataccctgcccacagaaaaaaagaacatgtatatctgtgatactattttgtatttatttcaggagttcccagacacttaaaaactatctgtggacccattcttgagagctgttgctgtgacagtaaaatgcctcagttagagaagttcttggcagtggaaaagatgaaactactaagagagtgcttcagtcacttggataatgtggtagtggtaaattatgctgaggcaggagttaatattttgtcatctactagcttccatttccttcctgtctctgtccttttagcaagaacatcaggaagttaaagccacatcctgtcaggcctgtttgttatcctggtcttgggccagtaaacaggatagataattagaataatagttatcaggcattgtactgtgccttctttatgtaagttcacttgctgagctcttgtaacatccctgaagggtaataactttatttcagtttttcagatgaagaaatgaactagtcttcatttccacgaagttttccctgattatctacctcagctcagagagcactcaatttccttctctcccagtagattctcgactctgtgtgatggcacaggccaactcttacttctaatgaggcaatatagtgtagtatttcagagcatgggctttttaaccagatttccagattgcctgacatgacctggatatacttaactatctgtacctcagtttatttatctgtaaaatggaaatatgaataaccatgtacaatgcttaacgcaatgcttggaacatagtaagttctcaatacatgttagtatttatcatcatcatccccaacaccgagttcagcacttagagtacaggatttactcaatagctgttcactaaatattggttggagtagctgaatgaactttctttctctagttgaagagtgaatggaactatgtagccaggtagccagattctgtgttcctaaatatatagacctctacttcagtcatattcaagaaccgattttttaaaatttctaaatcctagcatatggttcaaatttttaaaaattctatgtttttgttttagttcagttcaaatatcattagaaaccattatgtctggagagttcattgcttatattatcaaatctggagctcttttgcttatgatccaacttgatgtgtttgtgaccctctaaagatctgtgacactgacactaaaaggtctcttttgtgactctgccttaagaatggtattactggttaaataattgaagctctaggttgcggtgtgcatttctttgatagtaaggaggcagcctaattcattttcacataaagtgtatagatcatcattaaaacctctgttttgggagactctccttacttgaaaacctccttgctaaagtctgaacctgtgctgtccagtatagtagccactagctgtgtggtgattgagcacttgaaatatggctagtccaatttaagatgtgttgttagtataaaatatactggatttcaaagatttagaatgaaaaaaaaatgtaaaatatcttagtatttttcatctttattacattttgaaatattacattaaaataaatttcactcatttctttttattttttaatgtgtgcctgttagatcatttaaaaattacttaggctgggcatggtggctcacatctgtaatcccaggactttgggaggccaaggcaagagaattgctgaggccaggagttgagatcaccctgggcaacaaagcaagtctctattaaatatatacatacatacatacatacatacatacatacatacatacatacatacatacataatctatgtggcttctttgtacctgttctgagttagaattattatacatttcatttgcttgtactgttttgtggctctggtagcttactaagggacacttacctcttttaatacagcaataattattgagatgtattatagtctgtctttggaaagcaaaagcatctaccaagaaatttcaactcctggaggatttaagagtcacagtctctgccgacatactggaggcctgattgccatcactccaggtgctttattacagctttcaaaaagccagtaaatgtatttttatactagtaaacaatgtaatggtaataataataatagctgaaatttatttagcacttaactacatgccaggcattgctctggagtctttctagatgtaacataaattaatcctgcccatcaactttattatccctattttgtaattcagaaagttaaggtttcgttttatatttcttttctgttagtttcttttaatctcattttgtcctgccagataagtagaataaattattatggatttgcaaaataaatttatatttctggccaggcgcggtaactcacgcctgtaatcccagcactttgggaggccgaggtgggaggatcacctgagggtcaggagtttgaaaccagcctggccaataaggtgaaaccccgtctctagtaaaaatacaaaaattagtcgggcgtggtggtgcacacctgtaatcccagcttctctgaaggccgagacaggagaactgcttgaacccgggaggcagaggttgtagtgagccaagattgccccactgcattctcgcctgggtgacagagtgagactctgtctccaaaaaaaaaaagaaaagaaattatttcacctttgtaaaatgaaccatctgattttgggacctgccactaagggggtgtgctttgtcatataagccacaccccaaagtttgtattttttctgattctacttaggctctcttttcagttacttacacccataaatatattctcttatttttaaaaataaaacccattaaaaacagccagtctctcagaactaagtaagaacattagttattcccatagtaccatcatactttcacagaatttatctttaatttttataattaatggctactaattttccccagcaaactataaatagaggcccaactacaatcttgtttggaatatagtagacatttaataaatatttgttgaaagaatgaaattgtatcacataaagattatataattaaggcaagttttatttttgtgtgtgtgtgtgtgtgtgtgtgtgtgtgtgtgtgtgtgtgtgtgtatgtaagtaatgtatttttcagatagggtcaggctctgctgcccaggctggagagcagtggcgtgatcatgggtcactttagccttgacctcccaggcttaagcagtcctcccaccttagcctcctgagtagctgggactacaggcatgtgccatcatgcccagctaattaaaaaaaaaaattttatagagatgtgggtgtcactatgttgcccagcatggtctcaaactcttggctcaagtggtcctcccacttcagcctcccaaagtgttcagattacagttgtgaaccactgtgcctggcaaaggaacttttaatttaaaacttatggtaagaataaatgtctttgttctcaaactttaacctaagcttttgtgaactacgaattcttgatttttttttttttttttgagacgaagtcttgctctgtcacccaggcaggagtgcagtgacacgatcttggctcactgcagcctccatctttcaggttcaagtgattctcctgcctcagcctctcaggtagctgggattaaggcatgcaccaccgcacccggctaatttttgtatttttagtagagatggggtttcagcgagttggccaggcttgtctcgaactcctgacctccagtgatctgcccacctcggcctcccaaagtgctgggattaaaaacatgagccactgcacccggccatgaactctgaattcttagaatgaaaggtcatgtaactttcaaattgtttaaattaaaaacgaagactttctcatcagctttctatagttattactgtaatctagctcaaggcttctgacagttcctaagataagcagagtcagggtgttttattgcctttctagcaattgtcatcagctttctgagcgataagagcctctgcttcctctcttcctccacaagccagacaggaaagaagagctgtgttgctaaataatgccattcggtgttcaaagaagcatgtctcagaaacctctaagggactcaccatttcctgtgtattgaaagtctgtcttggctgggcacgatggctcacacctgtaatcccagcactttgggaggctgaggtgggtggatcacctgaggtcaggagttcaagaccagcctgcccaataaggtgaaaccccatctctactaaaaatacaaaaattagccaggcgtggtggcggatgcctgtaatcccagctactcggaaggctgaggcaggagaatcacttgaatgcgggaggcagaggttgcagtgagccaagatcgcgccactgcactccaacctgggcttcaaagtgagacttcatctcaaaaaaaagaaaaaaaaaaaaaaaaccaacaacaacagtaaaaggctgtctttacctagtacagaagttctttataatctttttctgatttaccatttcagctttatttaaccacacatgaaccttccattctaggtaagttagtctgtctagaattttctcatctctctacttttttttcattaattttttattatcataaaatatacataacataaaatttactactttaaatttttaactacttaaagtgtacaattcagtgtcattaattgtacacttaaagtggttaaaattttaaagtggtaattttttttttttgagacagagtttcactcttttgttgtcaattttaaatgtacttaatgtcattaaatacattcacagtaattgtgtagttatcaccactatgaatctccagaactttatcatcccagactgaataatctaattggaattgatatcaacttacttcagtcccatacaaaactgtgctcctggccaggcgtggtggctcacgcctgtaatcccaggaatatggaagccaagatgggaggattgcttgaggtcagggcaacatagtgagaccttgtctctacagaaaataaaattagttggctgtggtggtgcatacctgtagacctagctacttgagaggctgaggcgggaggactgcctgaggccaggagttcgaggatgcagtgagctatgatcacaccaatgcactccagcctgggaaacagagacactctgtctttaaagacacaaataaaattctggtcctatacagctccattctctcctctgccttaccctcactttttttttttttttttttttttgagatggagtcttgctctgtcatctaagctggagtgcagcagtgcaatctcggctcactgcaacctctgcctcctgggttcaagtgattctcctgcctcagcctcccaagtagctgggattacaggcgcctgccaccacacccagctaatttttgtatttttagtggagacagggtttcactgtgttggccaggctggtctcgaactcctgacctcaggtgatccatccgcctcagcttcccaaagtgctgggattacaggagtgagccactgcacctggcccattctcaccctgttatgttattgatgtcacaaactgtatcagaactccccctgttatgttattgatgtcacaaactatatctttatacattgtgtatctactaacagattcataaattcttttttatgcatttgtctcttaaattctatagaaagtataaagtggagttgtaaacaaaaattacagtaatactggtttttacatttgtccatgtatttacctttactggagatctttttatcttcatatggctttcagttactgtctagcatcctttcattttaacctgaaggactccctttagcatttattgtagggtagatctagaagtaatgaactccctcagcctttgtttgtctgagaatattttaatttctccctcatgtttttgaagcacagttttgtcaggtatagaattctcagttgacaggttttttttttccttccagcactttaaatatatcatttcattgccttctgaccttcaagtttctgctgagaaatccattgataatcttattaaggattgattatatgtcacaaattgacaagttgcttttcttcttgcttgctattttaaagattattgcaacagtttgattataatgtgtctcagtgtgagtctttttgtgtttatcctacttggagttcattgagctttttagatctgtagatgcagatattttatcaaatttgagttttcttcttagtctgcttcttactgctgttttgccaacatcttctgtgctttcttacgtaagctctctctagtagaaataccattttcttacctgacatttactctttccttcaaggcttagctgaagtctctcacctccatcacacagtattctcagactggagtaatttatattgtaaatatgacattattatctgcacagctcactttgcaattaatcatcctgccttcagtgataccaaggaggccttttctgacctccttcagggagagtcaagttcccattctctgtgttccaatagcaccttacctgtcccacagtgcttacctgttgtagcacctagtacactgcattgtaattatctctttatattcttatccccaacccctcacaccaggtgtgtgttcacatacactgaattaagagcttcttaatgacaggtgcctatctcactggttttatgtacctcctaagtatagcatagtgacaagtatgtaataggattcagtatgtgttattgagtaagtagataagttgtatagtggtatattaggttttattgtgtattttccctatcgctcttcatagcaatcccatatatggtttgtaaagtagatattcattttatagctgcagaaactagagcttataaagagtttgttggtgtttaactttttatttagcatctactatgtaaactgggtatgctggcataagttatgtaatcctgtatgcagttgtgagatacaggttttattatccctctttgaagagaagaaaacggaggcttaaaaaagatgaaatgacctacctaactggagctggtttaggcaaaaagaatttgatgacccctatataattggaagagtaaaggtataagtgggcgggaaggagggttagaaagagaacaaataggatgtgtatatatatgtatgtatatatgtatatatatgtgtgtgtatatatgtgtatatatatatgtgtgtgtatatatatatatatagagagagagagagagagagagagacagatttattttaagaaatttttaagattgtgggagctggcaagtccgacatctctaggacaggctggcaggctggagacccagtgaagagtttatgttgcatctcaagtttaaaggcaatctgagatagaattccttattccttgggagacctcatcttttcttaatgccatcaagtgattggatgtggtctacctacattattgagggtaatctgctttactcaagcctaccgatttaaatgttaatctcacctaaaaaataccttcacagtaacatctagggtcgtgtttgtccaaatatctgggtactgtggcctagccaaatcagcccataaaattaagtatgacaggaggtgacaggagccagggcttgctacctagaatgctagctttttatcagttccaaataaaggcatcctagatgaagattctgactgctttggcattggtcacaggctcattcttgaattaatctctgtgattgtgtggtggggtactttggctaagcttcgaccaggagccaatttctggacagtcattgcccagagagatggcatcttctgtttgaactatatgagtagaaagacattagaagaggcggaaagagaagcaatctcctaaaaggactgctgaaccctagaaggagagagagtcggtcagaacaaatagcttacatcaccactacagtgatgtaaggtgacttgtgacagagtttgtatttagtatttagtaacctatttttctccaaatctgatggtttcaaaaccatataatgaatttctaaaagtagagagtagataggttattttgaatgatattgagataagattttgggggcagaaattttagtgtttacattatttattctgtaactatattagatcagtgttttctaaccttttttataacccataattccttttaacaaatttaaaaactacttcactgttgtttaaaattctaagtaatgttaatatttaggctcaatattaattacttgacatcttacatattttgccttgcaaatcctaagatgatagagatattaacatccacatatgaaaaataagactagggttctgaaaggttaagtgacctgatcagagtgagaaaaactatttctcagaagagctagatttttctctgtttgcttgtgagagagattgacagttaagctacttaatgataccatttttatggtgaaatgtactccaagagaatttttataaataagtttcaggattggaaaatacagctttgtgagttttcacaactttgtagtttctaatagtttctagtttttaatgttttctggttacgaaatagtggatgctgctgtttaggaaaaaagacataaaactgtgtttctgggaaggactttgaagatgattttatcttgtctttgataatattggaattgcatcaaaaactgagacagatggcttacaccctactgcctgtacatagagtctaggaaaatggaagtggattgcatagactcaaggtccctcagcctaactgtccttgtgaataacttgaccatttcatattagatttatgtatttatgaaccttaggcttctgaaagcctagcttgggatttgctttccttgatggttcaaattcaccgctccatggaatcagaactgtgagcctttggaataccagggaggtttattcttggcttgttctttatagctttggtacttgtggattcctcaggatgtgtaagcatcttaaaaatgaaaacctgaaagatagtctaaaatagaggatgagtaggatcatttcatttcccttttctggagattactaaggtgaaggtaatagcttttcctgtcatgacatccaagatgagtggtggtttgggcaaaatgctcacacacctttttttattttattttatttttttttgagacagagtctgactctgttgcccaggctggagtgcagtggcctgatagctgctcactgcagcttccgccttctgagttcaagtgatcctcctgcctcagcctcctcagtagctgggactacaggtgtgcgagaccacacccagctaatttttgtatttttagtagagacagggtttaccacattggccaggctggtctcgaactcctcacctcaagtgatccatccacctcggcctcccaaagtgctggaattacaggtgtgagccaccacacccagcctcacacacctatttttgaaataatgtcttatatctgtcttatctacctatattggtgggctccttgagaagttgcatataaatattacttcttattgtggcacagatccttaaagagaattgcttttaaattactagtgttaaaaataatgcttgtattgattatgtgtccatcaactgtagaaaaatatacatgttcaaaattagggagaatataagaaatatggtcaagtatcctaagtgcacacaaagatatgtttagatatttttatttgcctgaaatgagaagaatagttataaaggttaagaatcattgcaagacaacagaataacatttgagcatctctgaaactgtaaactaggtcaagaaaattacttgattttcagtctgatatacaggacaagttttcagtcataatttttttaatagaaagtgatataattgaacatttaattctttttaagttttctgtttagcaatatatgttatactacttggttgtgctaataaaaggaatattgtaagaccagaattttattagataaacatgaatcaaaagttaaatttaattgatcttcttactaagaggaattaatgcctaaagatctccatattttttttttagttgggaatggtcttcaggatatgattagagataacaccatcctttcctccccttcctcttcctcccccatagaccccaaattatgaagagaaatttgtagtcctcaagcttcctccattttacccaaacatagactgtgtttgctgtttagagctgagtcctttgtaatctgttttggattttcaccaagtgagcttccttcctttgctctcccatctttctgccttggctactttgagtcagctcactggcttcttgtagccctgttttcctgcatgcacacttgatctgagcagacactgtcagtgacagcagttagcagcagagcagaaagaattcagtacaaatgtgtgcactgctgatctgtgacactgtagtgttttctatttttgttattatctactttcagaaaccaggagctgagttgatactgaccttgtgtggaatgcctctgaggatttgggatggggggagggtgctagattttcatgtgacttatctctaacatgctgcagcaagactgaaaacattcatctgctcacataaggaggaaagaaaatttccaagattgagcttgcagaatttgttgggtattttcagaaatttttccccgtgtttttgtatttcttgaatttgcttaatttatataagggttggaggtgggggatggtctttgcatgataaataggttgaggtatggaaggatcgggctgcaacaatgattctcatggtaagggactgtttaaaatcacaacatcgcgacccacattgcgacccatctgacaaacggttagtgagctccttggccatctcaaatgtttaaaagtaacagtgtacaaatagctttatttgtatgctttcttccatagacatcttaagaacattgtgcctacgtatccaaaacagttgatttttgtctacatttaaaatctcacctcaagaaggtgagaaatataaatgaagcatgcagttgtcccttaagtatctgctttggtataattttctcactttcctttatgctggagctaaatggagcctgagcttacattttgggttatgtctgagatggaaactgaaatgtagtcttgaagctcgaaggagaaacttggctatactaatctggaggacttgttaaatgctgtcttcccttctccatgttgccgccttttacctttccctgcgaccccagaaatgtactgctgcagaattctttgagctttttctctcattttgtagaaaagaaagtgaagggaggtgtgtgtgtttgtgtgtgcgtgtgcacgcatgatttcagtacaactacaaatgggcagttaaattgttacatcaaaagtgacagctttattttgcaattctgaatctaaggttgcttgggattcgttcatagccactcaggcctgattaaagcatataagaatttaggtaacgatgtttcaaagtaaaagcggagcccagcatgtttgatttgaagagcagaagagataaatgctgctgtggttctttttttactttatatatactgtttgtatatttgatcaattggatttgatatatggtcctaaaatagctttttttgagatgtaatttttgatagagcaaattgcctgtgtattaataatctttcccattttctctgttgtttcattctaaaattgatgcacaccagtgatttaaggggaaattaacacttcagtaaatgtctttttccttagtattgttgactgtttttattagccattttcatttaatttgacagtggtacctaagggttaaccttacagagctgatgcaacccctccttttctttaccagcaattttcattggacactatttccatagcaacagtgacatcagtgaaacctgagtgtttcattgattatttttctcctcttccttttttaatctatcctcttttcaccacattttagtgagaaagcaattttttttttacaaatggagcttatattgatttttatttcataaataattgaaagagggtagaaaaatctgcccttcatttaaaaattgaatgtttcactatgtatttaaaaagcgattcaggattaggaggatggataaccataccagctgtagctgatgttctaaaatattcttgcattgtttgctggtcttctagggaaaagaataatgtggaacaggaccttaaggagaaggaagatactattaaacagaggacaagtgaggttcaggtaagtgaccataaaatttagtgttccactgctgatttaggactattcattttaaatttatatggttatttactatttgctggatgtagtattaggtcaagagaatgcctaatgtttatattatataaatgtttatcttttccaagatgattgttcttgcttggaattctggcctgcaaagattatactgcaatgagaaagcagtatttttcagcatagatttctagttttgaaagtattttttaaatggtacttacctgcatattatatcattaaaggggtaagtttgcatgacttacaatgttaatatttttgcaccagtaaaattagagtgagatcatcatctcatcatcatcatcatcatcatcatcaaaaaccagtatgctttttcatgcatgtgaggtttttgttagctaggagacctagtatgttaaaggactgtttctcataatacttgtagggtgggagatgatacagaacaatttaaagtagcattttatgagtagcttagtaaccagcatatcttaaactttggcataaagagctttagttcattttcattaggtgttgtgttaaattgtttcattttacaaagagaaaggatgacaaaaacctcagtttttgtttgggaaatgataaaaataagggagtagcagtgtttctaacgttagaaatagagaaaactgggcagtgcctcacttagagcagtaagcaatgcatgtggccatgttattggggtactgtttccttagtgctgcaccggcacatagaggagattggatatagaagcactggtagcagttgctagtaagaactcttggatgggcatttcttaatgtgttgcttgtatgttggattttcctgcttttcctaatagttttaagtagggaaaaactctaaattgtgttaggcccattgttttgttttgatgcaggacattcattagagattgtctgtctggtggactgtgctagggtggggagaatgatttactgaagaattgaggaagaagccagagagacttcttgttggaagttgattctctgattgggtgactacatttattatatttacttgaattttcctgaaggcagtgcaagttaagagatcatcatcaatataattctctctctggcagtgaggttaggtgggcataagagggtaagttatctgaattacattattttgtgcagtttttgagcttcttaggaaatgcaaaagagccacacattctaagcagttattactaaaaatagtttaaaatggaagataaaataatctacacaagttttcataatttgaagaaataggtgtagctactgatacaattttggacagcttctaaatttagccagttactgctttaaagtacataggttcttgtgatagacagtattttgttgagtatatctacctgttggtttttccctgctgcattttttgaggatgtgaatttaaatacccagtttagaagagtgctgaaatttacattgtttccttcagtttaaataggctatccctgaacatttggtgtcttataattatagaagttttgttgtccatcagaatttctccgtgatttgcttgcccttcttacttagtggcaatggtaaggtgtatgtctaaccttaagctttgcaaaatccaaaatgtgtgattggcacaggaagtcgaaatggttcaatttttccacatagagtgctctaagtataagtaaggcatcttgggccatggtaagtaaagaccaagtaataatcaatgaaaaaaatagtggattaattaaagatttgggttagtagattcattatttattcattatacactacagttatctatgttacgcatggtaatgaggtactagactaagaatgatgtggatagttgacatctaccagtaattaaaactcttatattagtgatcattttcaattttctgaagcaaaacttaccataggtggtaataagtatatttcattacctattttgaggtaactctgatttacccattggtactgagatgtagactggaaataatatggataattaaagtctgtaaataactccaactctcaatacttactttctaatttccctggcaaaaggcaactcactggagctattaataaatggcagaatcaaagagagtgtatttcactgcttctttctgatctactttctaatggtgatgctaatgagaaatgtcaaaatgaagacattggggaggagaagtaagggaattttgacctatcagtacctgccgcacttggctttttgagtgttcttgcttttctccatattaataaagtcacagtgataatatgagctcatatctcaaacacagaaatcaaacttttaaagccaaaagctttaattttttttttgttttgtgtttatgtagtctgtctaattcagttagagtagaaagtctgctatgtaattaatttctgaatttttgtttcctgtctgtatttctgttaattactgccttgaaaactttctgtttaggattttttcttgaagatgacttcacattttatttcatgagatgatcactgttagcttgtatgagatatataccagtggatcaagttctgtggacaaattaggcccaaagtgatccaattccaagggggaaatgttgtgaaaagccattttatctaaaatgtctaaggtttgggtgtgtattttttgttttgtttttcataaggggagaaagtaggctcacattcttcctaccttaaagaattgcctatgtatgatcttattaaaaatttttttcttctgagtagtcaacagatattttagaaattcactctcatatgcctggtttcttcagttttgagtagaactttatagcaacaatttgatgtcaaacaaacttgaattcagttcctagctctgccacttcctaggtttgtgatcttaagtaatttaaccattctatactttagtttcctcttctgtaacatgggataataaaaataacaaacacttaagagctgatgtaagaataaaatgagataatgcagtaaagtgcctcacagagtgattggcacttggtaagtgttcagtaaatgttcttactagctgtattattccgcaccctacaatcatctctttattatcttctcttcacctttaagctctttcttctctttcttcacataggcctcttggacataggactcttcaatttgaaaataccccttccttggctattgctgccactttaactaccaacttattttgctctacttttattgctttgtgtggccattttcccccccttcctatctttgtagcaaccctgtacagtctgctgcttgcccataccacactgtgcattttctccccagggccaagaataatcttaaggccaaatctgttcgtccttcttgtattaggtactcctttcttgggttgtattctcctggatatcttcctacctctctgaacctttgcttccattgactttgccaaggacagatggacagacagattgtgtgtgtgtttatgtgtgtcctttctttccttctccataacccctgtcatccatatgctgataacacccaaatgtttatcaagctctcaactctcctgagtgccagtcccacatctccagttaaccattttggtgtttatcatttgaaaatccgtgtgtctaaaatgaatcttattgaaaaaacttggcttctggtttgaactttcctatttttctttctcactactgccacctgtatcgcctaatatctaaaatcttaaagtcatatcagaagtactcactccattcgctcttgcctttcctcctaaaccaatttagtatcatgactctcagatgtgggaatctttactgttgctcactgccaccattaatgatgggagggtgtcatacctcaggttattggagacagagaaaaagatgaaatacaaaccctcctcttttttgactgtctgactctgtactctgtgccatatatattctccttcttattcccacttttataacttttgttgttatagtccagaatgttctctactttcctgcttatgtgaattccactcatgccttaaagcctagctcatatcccaccgcttgtcttaaactttcccttctctgtctcttggtccacaccagtctttcctgtgttggaactcccagaggaaggaatacgtatccacttatatatggcatgaaccatatgttacctggtagtgttagcttggtgtgatgtgtatagcttccaatatcttccttcctatatattgtgagttccttgggcttagaaattgtgccttggatcatatttttcattatatttggcaatatattgttagatggaggtaaatttaaggaagctgttcacagcagaagtgaataaactttggttttgtgtatacaatttaaaataagacaatataactggaacccataggtagaaaagattgagagcatagtagttatcatgaaaagtcagacttcttgatattgttcatattaccctcatgtaaaagaagctccctattatttatgtttcatcataagattcagtaattcagagtacttgtccatgttttttattttaattcacttagtttttttcttagatgaagagggatgacttatcttagatagaaataaaattagatacatgagctcagcattctttttctggccataatgctctttagaacatactgggaagcatatgattgagaaataaaggcagtctgttaatggggttttctaacacccaccctagtttattaggcttcctttctgttcattgacttaaacatcttgttctatagttgatacatttttaatgttaagaatagtcctaaaacttccatcagataaaacagtgtatctgattatttctaattgtaggttagtttatagaggttttcttttaaaaataaataattatataattatgtataatatataaaatatattactgatattgatatgaactattaacatgatatgtttgcatctgtttcatataaaatacagagttaaaaggtttaacttttcagataacttttaaagtaacttcatcagttgtacatctgacttgagttgctaaaatgaaagttttattttttcatatgtctaaaattcttaggtatttgtttaaattttatttccactaccccatagcacttcatgggggatagagggatagcagataatttgccattttcagtaacttcagtgatttctagaaaacaggacgttttccttgaaatttctttttaagtaaagccaagattgccagctcaaatatcctttaatttctagatgagtaacctcggatatggcttgctttgatatttttctaaaataaaccttggcactatattgctctagttttgttcacttcatccttgccatgcttcagctgctgctatcttcctttcttttgctgttgatggcactagtaggcaagtagaccatgatcaggggaataaagcagaactaggaaagcatctgcaaatgtcttctgtcattcactggagggaatggcatttgatagtgctgagtctgtgcacagacccaggaaaggatgttcccaagggccacgtttaggaaagagaaaattacccaagttcagcagaagacactgtttgttaggagaaccttccactgctctagttaagggcatggcgggggaggagagagcaggaagagagagagaggtacatctgttgccttaatttagtctcaggataagcaatctgtaccaaaataaagttgctaagtatatctagatgctgatattgatattgaaattgcattgtgatggtggtagccttacaaataattttccagtgaaatttgttattagcatgtatatttgcatgagttcattttgattttgtgcagtttaataattttaattctgtatactggaaaggaaggcctttttgtatgtagtttagtgttggaatttttttttttttttttttttttttttttttttttgagacggagttttgctcttgttgcccaggctggagtgcaatggcacgatctcgactcactgcaacctctgcctcccaagtttaagtgattctcctgcctcagcctcccaagtagctgggattacaggcatccgccaccacgcctggctaattttttatttttagtagagacggggtttttccatgttggccaggctggtctcgaacttctgacctcaggtgatcttccagcctcagcctcccaaagtgctgagattacaggcgtgagccaccacgcctggcccagaatttttatagaccttttttcatatttagaaatagacatagagagacattaattataatgaattttaatatggacatcgttccagcttgaagtttctcattaatgttaggtatttcctcagtaacctttcctttaagtcctgtagttttgtattactatgtggatttttactgaagctaagaaatgaaaaagggcagtgagtctgggaaatttgaatgaatgtgtttgctctttgggagagaaagggcagaaagaagtaaatattatattggtttgtttatttgtcttcctcttacataagcctgtcttttgaggttgtgtttaagtggctcactaaaaatattatttatgaaaaatagttcagtttattaaaggaaaccagcattgattctattattggtagttcttacataaaaatttagtcacatcagaatatttttgtattggtatttttatattttatattggtagcaatgtgatacttaaaaaaaacagcaaacttgacattttctgattataaaagtaacatgggttcatggtaaatttgtaaaatgaagaaaagtatgaaaaagatgtaaaaagcctttctagagagagctattgttaacattttgctgtattttctacaaatatgtataaatttctttatattaatttgtgatcatactgtatatgcctctgtattcagcttttaaaacttagtatcatgtcctagacattttcttatattgtgtgacccttttaaggtaaattgtgttttttgtccctggatttacaataaaagacatcaaaattacatctggctttaaagatattattagagacatgaagtagataaagaatatttttctttggggtatgagggagggtggggaatatgactagagtatttactaatggggatagataacatatttttcctattcccactcttgaacatttttagttaaagggaaagagaaaaaacttttttccctctaggatttaaaacatgcttttgggaccagcatattgttatataaacctatataataattttatgaacaaagtaaggaattcaaaatagattatattttcttttttctttttttttttgagatggagtttcactcttgttgcccaggctggagtgcagtggcgccatcttggctcactgctgcaacttctgcctcctgggttcaagtgatcctcctgcctcagtctccctagtagcgggaattacaggcggccactaccacgcccagctgattttttgtatttttaatagagatggggttttactatgttggccaggctggtctcgaactcctgacctcaggtcatccacccgtctcagcctcccaaagtgctgggattacaggcatgagccactttgccggctcaatagattgtattttcaaactaacaaaattactttagatctgcaggtaacattcttttaaaatattttatagctgaactagaccaagcactgtggctcatgtttgtaatcccagcattttgggaggccgaggcgggcagatcatttgagcctaggagtttgagaccaccctgggcaacatggtaaaaccccatctctacaaaaaaatttaaaaattagccaggcgtggtggcacatgcctgtagcctcagctacttgggaggctgaggtgggaagattacttgagcccaggaggttgaagctacagtgagccgtgattataccactgcattctagcctgggtgacagagtaagatcctgtcttaaaaaaataaaggtatatgccacagtgacatgttaaagcagtaatgattatttccaaataatgaaagttttaaatgtcagatcagccttggtctatagattataaaaatactgaatcagtttagaaatgtaggtattattttaaaaagtttaaaaagcatttgtcataggtcagtttggggtattaataaatagctatagtttaaatacatagtgaagtgtttcacattatgtaaaaagaatgtaagtcttttctttctgtcagtctcatgcgtgtttcccattagtttttcccacatactaaaatcctatgatagttacagtaattgcttaattaagcccctggaatgtgctaggcattgtacaagattttggataatcaaagaaagatgaagcatggacactgtcctttagaagtttgtaatttagaggttagctatgattacagtgtattaagtatgacagtagaggttaggaacaaacagtagagtttgagcataggtgaaggaagcccaagatgagtcagacgagattaaatttggctggattctgaagaatcaatagtgggtttccaggtacatatggtgtggaaggacattgaagacagaggttatggcttgtggaaaggcatagggtcattgaaatatgttgtctattggagaaggaatagggtcttctgaggctgggacacaggtgaatatgagaggaaaagaaggtagaacccagaactgaaggttttaatgtgtcttgcagcaagttttacttaatcctctagataagagggaacaacacatattttaaaaataacagtgactagagaaatatcctttgcagtgagttattttttaagcaagttggacatttggaataggaagaaacaaagggagaaaacccagttgtatgtcaaggaaggaacgatgaaagctaaaataatttggtaaacagcttaaagagagattttaaggtagaatctataggacatgtatgaatggagaaaatcaaagatgaatctgaagttactagactgggtgatacagaaattgaagtcatttttctcttttggcatgggtttattcagagccaatgccatgtgcatatctaaagtcgtatctctatatggtatggattagttaacagtgtaggcaaggttaaaaatttagacatgaaaaaaattaggcatgctggtaaattaatgataaagtactaaaggagttcaccagtttgaaactgtgatcacacaaactcacggaatgttagcactggaaagtctttcatgatcatctattgtgttggcatttttaaaggaatttttaaaataaattatagtaaataattgataaacatttttgtcaaaggaatcagaaagagaacatctaattcttttttattattattatactttaagttctgggatacatgtgtggaacgtacaggtttgttacataggtatacatgtgccatggtggttggctgcacccatcaacccatcatctaggttttaagctctgcatgtattaggtatttgtcctaatgctctgcctccccttgtcccccacctcccgacaggccccggtgtgtgatgttcccctcccttgtgtccatgcgttctcattgttcagctcccacttatgagtgagaacatgtggtgtttggttttctgttcctgtggtagtttgctgagaatgatggtttccagcttcatccatgtccctgcaaaggacatgagctcattcttttttatggctgcatagtattccatgggatgtatgtgccacattttctttatctagtctatcgttggtgggcatttgcattggttccaagtctttgctattgtgaatagtgctgcaataaacatacgtgtgcatgtgtctttatagtggaatgatttataatcctttgggtatatacccagtaatgggattgctgggtcaaatggtatttctggttctagatccttgaggaatcgccagactgtcttccacaatggttgaactaatttacactcccactaacagtgtaaaagcgttcctgtttctccacatcctctccagcttctgttgtttcctgacgggttaatgagagaacatctgattcttaagaaacctaggcaaagcaaaactctatataatacaataaagaaaaattcaatttagaaggggcataagcatatttaactaagatttaaaatgtacttatttcctcatttaaaatttcttctccttcaatattataatttcaagtctcttaaaataaggactgaattaaaatacagaaattgtttttcttccagaaatcaagtgtccctgtatcttaaattctctgtacagttccatttatcagtcctttgtgcaagagttagcaattcatggcacaagggtcactttttgcctttctttgcagagttgatgatactcatcaaacattgtccgaattcctcaagtatcattgaggaattcaaaggctactgcctttgagtttccctttttgtctgcctgctctgcctgggctttaaaggaattttttaaagaaagcaacatgatatttttagactaaccagttggttaagaaaatataagataaaaagcaattattgaaagcattgttcagtgttctatttaatcacagaaacatctgcatatatttgaaaaatagtgacacatgtgagacatttagtctgcagatggtatgtcacatggtggttaagagctcaggctgtggagtcagaacccactttgaatccatagcttactatttttaactttggacacattacctacacatcagtacttcagttttctcatctgtaaaatatgaaatgatatcagtacctaactcgtagatctgtcatatagactataaataagttagtatatttaaagagcctagagcacaacctagcacattttaagtagcatttaaagtgttggctattatcataatggtgctatcttgtgtaacctatgcagtaattcagagaccttttacctgtaagtttctcttctgttcttagattcttattctggtgaatgactgttgggacctttgaatagatattatttttagaaatttgtgttcagttttacctcacccgctttgaaatctttgcctacctcctgctgacagatacttcggagttattaatccctgagccactgcgcctggctttttaaaaatttctgtagttcttgttattaagcatgaggtctggtatgtacatggatgaataaataacattttcaaaatggttctttttttgttttaagaaatcttttcctacactgagatctgcatttcttctacacattttaaagttagacttttacattcaggtccattatttacctggaattaatttttcttttttttttttttggagacagtgtctcactctgttgcccagtctgggcatgctgtggcatgatcacagctcactgcagccttgacctcctgggctcaagagatcctcccatctcagcctcccaagtaactgggaccacaggcacgtactaccacgtccagctaatttttttttttttgagatggagtttcactcttgttgcccaggctggagtgcaatgcatgatctcggctcgctgcaacctccacctcctgggttcaagcaattctcctgctttagcctcccgagtagctgggattacaggcatgcgccaccacgcccagctaaatttttttttttttttttgcatttttgttagagacagggtttctccatgtggggtttttttttgaccagagaatctgagaggggaaagattgagcttaaaacagatttgtggggaaattccaggagttctattttcaacatgttagcaaagcccatcacatgtccaaggacagatttgagttagcaaattgaatatctaaatatggattctaggaaagatgtcttcaagtaaagattgtatttaaagctgttaagtaccctagtctcatcaacacagtatactcagtaagactttattctttcttaaggtagatttaaaattactaacttaaccctcccctgcccgcaaagaaaataaatatattaattttcttggattttaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactggtaatgtctggctgtttcctgctgcctgcacctatacattagttgcttttcctggcttaagatgaaaacattctctactttttgttattgatggtggtggttggcaatccagtcagcatttgggttcatgggggcgatggagcaaggttcatccagaaattacaggccttctttagaggaaatagaagggcagttaatgaactgtttttccaaatttttgttggaaatatggtgcctataccttcaactctcctctgtccctcccccagttacccttctttacgaaaaccatacatcaaaaaacatcataattggctgggcacagtggctcacacctgtaatcccaacactttgggagtctgaggcggggggaattgctggagcccaggagttggagaccagcctgggaaacatggagaaatcccatctctacaaaaaatatgaaagctggttgggtgcagtggctcacgcctttaatcccagcactttgggaggccgaggcaggcggatcacgaagtcaggagatcgagaccacggtgaaaccccgtctctactaaaaatacaaaaaattagccagggcggtggcgggtgcctgtagtcccagctactcggcaggctgagccaggagaatggtgtgaacccaggaggcggagcttgcagtgagctgagatcacgccactgcactccagcctgggcaacagagcgagactctgtctcaaaaaaaaaaaaaaaaaaaattgaaagccaggcgtggtggcccacatctgtaatcccacctactcgagaggctgaggtgagaggatcacctgagcctgggaaagttgagcctgaagtctgaagtgagctgtgatcgtgccattgcactccagcctgggtgacagagtgagactgtctcaaaaaaataaaacatcaacaacaacaacaacatcaaaaactccataatagggctaggtatggctgggcatgttcctatagtcccagctactcaggaggatcacttgagcccaggagtttgaatccagcctgggcaacatagcaagactctctctctcaaaaattaaattaaataaattatttgctattgctgtcaaaaaaaacaccaaaatagtaaactaaacaaataaatgtattgcattttggaacattttaatgacatctcttcttttaatccccatttcttctcattcactttcacattatagatctcttctctgaaagctgaattaactagtcaggaatcgcagatctccacttacgaagaagaattggcaaaagctagagaagagctgagccgtctacagcaagaaacagcagaattggaggagagtgtagagtcagggaaggctcagttggaacctcttcagcagcacctacaagattcacaacaggaaattagttcagtaagtctttgtaaagcaagaaatatattcaaatggatcctctgtgtcctttagtcagttatactttccaacttctgctccttcaacctcttgcctagtttactgttcatttttcagtcattttatacaataggtttttttgtcacctgttatatattgaaactatcatacatcttgtatatctatctgatgattatcattggagtagtgattaagagtgtgggctttgtggctagatggtctaggtttaagtactggtgtgccacttactagctaaatcaccttagtatcagattcttcatcttcaaaattggaggattaataaataccctaccccttagggccactgtgaggattaatgaggcaaaacctgtaagacattttagcatggtgcttggtacataaatgctccataagtgttgcctgttttataaacaataacctagtttcttctgttttgtgattctaattttgaattcacatttgctaatttggaaacttttttcttaaggaaattgttccttctgtagataaatttgcagtgttatagttggtcttatgtatagatcctttgctttatttccaggtttccctacatgaagactaatgttttaatgaatgataagatagttagggctcggcatggtggtggcccatgcctgtaatcccagcactttgggaggctgaggcaatggatcacttgaggccgggagttcgagaccagccctgccaacatggccaaactctgtttctactaaaaggtacaaaaattaactgggcatggtggtacctgcctgtaattccagctacttgggaggctgaggcacgagaatcacttgagcctgggaggcagaggttgcagtgagctcagatcacaccactgcactccaccctgggcaacagagtgagaatctgtctcaaaaaataaaaactaaaaaaaaaaggatagaaacacagagatcatggagttgatttctttcattatgaatttgaacaaactaaagccaaggaagttcaagtaactttctcaaggttacatatccttgaaaagagctacatctaaaatccagttcttctaaaacccagtccagtgtgctcagttattacatataatgaagtccttcacttttgcgcttccttaccccctgttatctggcagctgagtacctacctactcattcgtcatgcaagatataccttaaattcttatttctttatggtattttctgcatcctgcttttgttggactttgtatttatgttacagcaataataagatttttccctgcatatttgcttatatgtctgtctcccctagcagagtcatggttttggtctgggaacttacacatttttaaaaatccgtatcatttagcacagttcttgtcccagtgtaggtactcaataaacaggtaacctgaaagagttgttgtagtgagaatgctaccagatgaatgggtattctttaaagtattttctttttttgaatctctttaaaaaaaaaatccatgtatactaaaatttcaagagagaaatacttattgtcagaaattactgaatcttttctctaagtcacgtagcattcccagaggattcttcttaaaggaagcaaatgtatcctagaccaagtctacaggtatagccatttttattttatttatttttttgagacagggtctcattctgtcactcgagtgcagtggtgtgatcatggctcactgcagccttgacctctgggctcaagtgatcctcccatctcagccttctgagtagctgggactacaggtgcactccatcatgcccagctaatttttatatttcttgtagaaatgaggtttcaccgtgttgctcaggctggtcttgaactcctgggctgaagcagtcctcctgcctcagtttcccaaagtgttgagattataggcatgagctaccacacctagcccgtcaggaagtggaggagggcgtttttatgttacatgtctttctagtaataaattctgttctatatttcttctttgtgttggcagatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagtgagtctaatactttcataaccttcataatcaacctccttgtgcagatccaagtttcactgacattatatctaatataaatacatggccttgcctcatctgaggacaattgagatttcctttttagaagcagagagtcctaatccaaacaattgtacgttttaactagtataaaaagataactttagctaatttttttttttttggagatggagttttgctcttgttgcccaggctggagtgcagtggtgcgatcttggcttactgcaacctccgtctcctgggttcaagcaattctcctgcctcagcctcctgagtagctgggattacagtcacgtgccaccacactcagctaattttttgtatttttagtagagatggggtttcatcatgttggccaggctggtttcgaactcctgacctcaagtgacccatctgcctcggcctcccaaagtgcagggattacaggcgtgagccaccacgcccagccagctaatttattttttgtagagcctgtttttaaaatggtggttctatagagtaaaactttttttttaagtaccctcaccaaaagctaaaattatttttattacgtagtgttaaggacattcatttaccaattatttgacgagtaccaactatgtgcaagagtgctgtattacataatataagagctacagagacaagagacctcagtctttccttcaagcagcctacagtgtagtagtgtaacactgtgttaaagggctgtgctaaaggaagcgcagaattttcagttaggacagtttggagggggttcataaagattttgttggggaaagctttgcgagtttagacaagtgagaagtggttaagcaaagaagaggaggatacattcctgccagagaaaacagtattagtataggtacaaggtggaagaatacatgcagcacagaatcttgagaagttctgaaggatatcttgtgatggtggagagggtattggtaagagatgaggcgcttctagtaggcatctgcattacctctggtgattgtcaaagtataaatgtgtatccctttccccaaacttgctgaactagtttctgggatagagccagatatgtatattttaaaaacacactctatgggtgattgtcatgtgcacctggataaaaatgaccaattttaggtcagaaagtgccagaagatgagaaatttagattcatcttaaagcattgggggatttatcctactgcaatgaacagccattgaagaattttaagcaagaagtgacgtgattaacttttagaaatgtggaaaacggattagagagtgagactgtacccgtagaagggataatgagaagaatagaagtttgagaggtattaaaagtgaaaagttaacagactcgattttatttacacagtgcagtcatgtatgcattataaaatattctttcaagcgcaaaaggcagattactaggttatcctgcaaatagataagggtggtataaagtagctattgccctgctacttttttttttttttttgagacggagtctcgctctgttgcccaggctggagtgcagtggcgcaatctcagctcactgcaacctctgcctcctgggttcaagctattctcctgcctcagcctcccgggtttaagctattctcctgcctcagcctcccgagtagctgggactacaggcgtgtgccaccacacctggctaattttttgcatttttagtagagacggggtttcaccgtgttagccaggaaggtctcgatctcctgaccttgtgatctgcctgcctcggcctcccaaagtgctgggattacaggtgtgagccactgcatccggcctgcccctactacttcttaagtctttcacccactcgtctaaatgaagaagacaatgggaagccattgaaggacttttaaccagaagggtcacgatcacatccacattttagagctattagtttggctacaataaggagaagagattggaaatacatgtattggaggcaggaaagcagttggaaggaagactgctatagtaattggaaccaaagatgatagtactataagtgattgatagtgacagtgaggatggagaagaaggcaaggatttgaaaaagaggtaagaggtagactgagcaagacttggagtcatattctgaggattaaagatgacctgaaggtttctgacatgagtgactttgatgcttgatgacaccatttccctaaaaaagattatagaaggagaagttatttgatgaatacattctgcttgtctttttttatttttaaatagtttttggttatctttagtcagttttctctgccatgtcaaaaagtatattgttaatctacttgcattaatattttgtaggcaagaagtagtcctgaactactgccttctggtgtgactgatgaaaatgaggtgactacagctgttactgaaaaagtttgttctgaactcgacaataatagacattcaaaagaggtaaaaaatgattttatatttacattggggacttgtaagggtggaaggacaggaggaggtgaattatcagacattacttaatgggtacaatatacattattcagatgatagatacatcaaaagccccgacttcacctttaggcaatatagccatgtaacaaaattccacttgtgccccttgaatttatacatataaaataaataaatgttcttaatagctggatgtggtggcaagtgcctgtagtcccagctactcaggaggtgaagtaggtggattgcttgagcctgagttggaggcactaggcaacatagagggacctaatctctaaaaattaaatgatattttaaaaaaatgtccttatcactgttttcctcagatgaattatacactattttaggtgaaggaaagagaaaaatatgttaaggtgaaggaaagagaaaaatgtgttaaaggtgctttatgactagagagatatttgttacattaccatcagttgattttccttttgttttcaagaccaagtctcactctgtcacccagccttgagtgcagtagtgtgatcttggctcactgcaacctccacctcccaggttcaagcaattctcctgcctcagcctcctgagtagctgcacatgcccagctaatttttgtgtttttggtagagacggggtttcaccattttggccaggatggtctctatctcttgaccttgtgatctgcccacgtcagcctcccaaagtgctgggattacaggtgtgagccaccgtgcctggcccatcagttgatttttcaaagcatgtgtatgacctgaatgtgtgttattttattttaaaatgttaccttttaaaactttggtttctaaaaaataattttaatttaaaattatttttaggaagatccatttaatgtagactcaagttcgctgacaggtccagttgcagatacaaacttggattttttccagtctgatccttttgttggcagtaagtactcttttttttatattatagatttacccaaaaaaaagactttttaatatataaactaaggattcaaggcttcagtttcaatagcctaccaactcagtctgtcgcccaggctggagtgcagtggcacgatctcggctcactgcaacctccgcctcctgggttcaagcgattctcctgtctcagcctcttgagtagctgagactacaggcgcccaccaccacacccagctaattttatgtatgtatgtatgtatgtatgtgtgtatttatttatttatgtaattaatttatttagaaatggagtctcgctctgtcgccaggctggagtgcagtggcacaatctcggctcactgcaacttctgcctcccggattcaagctaatctcctgcctcagcctcctgagtagttgggattgcaggtgcctgccaccacacccagctaacttttgtgtttttagtagaggcggggtttcaccatgttggccaggatggtctccatctcttgacctcgtgatccgcccacgttggcctcccaaagtgctgggattacaggcgtgagccaccgcgtctggcctaatttttgtatttttagtagagactgggtttcaccattttgaccaggctggtcttgaactcctgatgtaaggtgatccgcctgcctcggccttctaaagtgctgggattacaggtgtgagccactgcgcctggcctgctttgtattttcctactgactaatgttgaacatctttctagatgcttattagccatttgtgtatcttctttggaaaagtgtttattcaattttggtgaagtccagttatctattttttcttctgtcacttgtgcttttggtgtcatctaagaaactattacctaagtcgcaaagatttaatgctgtctttgtctaagagttttatagttttgctgttacagttagatctttgatccattttgagtttatttttgtatatgatgtgagatagaggtcgagcttcattcttttgcaagtggatatccagttgtcctaacaccatttgttgaaaagactgtcctttctccattttgtgttcttgatacgcttgtcaaaaatcaaatgaccataaaggtaaggatttatttctggactcttcaatcctgtaagaatttttttttttttgcttcagtaaagctcagtacctttatttctgaactggtgatgataataccctcccagtactcttgtggagagtagagattttgttagtaaaatttttgctgtaatgtcttcccctccatccgtaacctcaacttgtgatcaaggtaagtatagttggctgtatatttcataaggtcaatgacattccttattttatctactgtgaagtgaagttattgaaataaactttgctttgcttttgtttgaaagttactctttaagtagtggtgtcaccacagtaaatattgttatttggatttctttgtgtttattttatcacaggtgatcctttcaaggatgatccttttggaaaaatcggtcagtatcttattgagtttcatcttagctttcattcatttctgcttaataataagcttatgttatttaggtctgaaactgaagccccagtaagatgctctatgtgcctggcattttcagaaagagagtagtaaattcttttgattttgcttaatgaattgttgctttacttttacttcttctttttttttttttttttttttttggggttttttgtttttgagacagggtcttattctgtcacccaggctggaatgcagtggtgtgatcatggctcactgcagccttgacttcctgggctcaagcaatcctcctgcctcagcctcctgagtacctaggtctacaggctcatgccagcatacttgactgatttttttttattttttgtagagacagggtctcactgtgttgccgaggttggtctcgaactcctgggctcaagcagtcctcctgcctcagcctcccaaagtgctgcgattacagacaggtgtgagcgactgtgcccgatagctttacttttttaaaaatgacattagtgtttagactttggtgctttaaatatttattctgattcctccttactaactaaaggtttggtgagcataatgatctatactgcttcagggtttagaatgtaattttgttttcctaagattatagcccacacgtgtgattagaggcagagaatcttgaagaattactaaaacatcaggctttttgagatattctttttctgggaattttcattagaataatgcaaatcttgtttaccatttagttttgcatcccaaacctgttctaaactattggctgttagctttgagctcagagagaaaaatacatttagaagtttttattgtgttttctttagttacggtagcgtagaataaggggacttaaaattggatcccttgaaattatatgttaattttaaaaataagtttattaggtggaaggttctgtatcttttatcaaaattgcaaaggagtctgtgaaataaaaagtactcagcttagattctacagtatttcaaactgtctttttggattttttttttgagacagtcttgctctgttgcccaggctagagtacaagtagtgcggtcttgactcactgcaacctccgcctcccatgctcaagctattattctcatgcctcagcctcccgaatagccaggattacgggcgcgcaccaccacgcctggctaatttttgtatttttagtagagacagggtttcactgtgttagccaggccggtcttaaactcctgagctcaagtcatccgtctacctcaacctcccaaagtgctggaattacaggtgtgagccactgcacctggcccaaactgtctttttgtttgtttgtttttgagacagggtctcactgtcacccaggctggagtgcagtggcagatctttgctcactgcagcctctgcctcacaggttcaagtgagtctcccacctcagcctcccgagtagctgggactataggtgcgcaccaccatgcctggctaatttttgtgttttttagtagagaggaggttttgacatgttgggcaggctggtcttgaactcctgacctcaagtgatctgcctgtctcagcctcccaaagtggtgggaatgcagacgtgagccactgcacctggccccagactgtcttttaattaaggcactgatcataccttcaagtgatgggaaatttagtgcaataatttttttttgtctcttatattcgtgccttatttttttagatccatttggtggtgatcctttcaaaggttcagatccatttgcatcagactgtttcttcaggcaatctactgatccttttgccacttcaagcactgaccctttcagtgcagccaacaatagcagtattacatcggtaagtgggagaattaaaaactgttaagttaaatggataataagtgtcctaagcaagtttcttgaaatacatagtgatgaaagaaccctcatttagattacttctaatggaccatataagaatttcagtctcatcccaattcatttagtttttggttcagactggtatttcatagtttgattacccactggaattaactggaatgactgaacggagtccaaaagtgatgttcatctttcaagagactaaatcttatcctattgaggatactaaaaatgattggaaatttataagccaatcttacataaaacttttctgaaatgtttggtatattattgaaataatgaaaattaaaagaattttagaaaaataaaatcgtttatgttatttcatagacacatctggaatgttaattctgcaaagtacaaattctcactaaatgtcaagctctcttgagaatgtacatacctacagcaatcactgtttaataaccacatgcctgatccaggtactggtgtgtgctttacattcattgtttctaatcttcacatcaattttgcaaagtaggtgttgatatccctattttaaaaatgaggacactgggacttagaaaaattaacatgtttaaggtcctatagctagttgctgttttatctggaggctttaaaaaaatcttcatggctgggcgcggtggctcacgcctgtaatcccagcactttgggaggctgaggtgggcggatcacgaggtcaggagatcgagaccatcctggctaacacggtgaaaactcgtctctactaaaaatacaaaaaattagccaggcgcggtggtgggtgcctatagtcccagctactcaggaggctgaggcaggagaatggcgtgaacccgggaggcggagcttgcagtgagccgagatcgcgccactgcactccagcctgggtgacagagcgagactccgtctcaaaaaaaaaaaaaaaaatcttcatcttgtggatatttagaaatactcaaaggagaataatgtaatgaaatattttaacaagcttccatgcatccattacccaatttcaatagttaggaatggttttgcaggtttttggttttgctttttaatttgtattttgagacttcgtttttgagaccacagtttcatgtctgtaggtaaactgaacctataaaggaccagttaactgagaagcatttgaagcaaaaaatttgtcttctagtactattagattaagaatatttcctttaaaatgtaattgattattttaaagataataggttttgtattattgaaagttgcttcttttttgtattcagtaaagagctgcttggctaagaactggtgttttccattgaataaaaactggacagataccttcgtgactgaatatttttcgtttccctgggctgctggatactctgttttcctatagcacttagtttgcaatgtggacccatttgccaaattcttctaaaattgctgctactggaattcttctcctctcaccttcttattctagcctctcattctcctatcatctaaagagcaagaaagctaaattagctcttctaatttaaaaatgaatacattcctcttgtcctgtcccccatgagatttttctaccatttgttttactgacttttattcccagttttctaaaggaatattgtccttgctttacagcttgtaatttcaccattcaaaacaaaaaaccagattggcaatataataatagctgcagtttatctaatttcctctgtgtgccagggatggtgccaagctctttatatgcattgtctcatttacttttcacagtaatcctatgaggtttacgtaggttaagttgaggccaggtgtggtggctcccacctctaattccagcacttcaggaggccaaggcaggaggatcacttgaggcaagtagttcacaaccagcctgggcaacaaagtgagacactgtctctacaaaaaaattaaaatattagaggtgtaatagcatgcacctgtaatcccagctactcgagagactgaggtggtaggattgtgtgagctcaggaagtcaaggcagcagtgagccatgattgtaccacagcactccagcttgggtgacagagtgagatcttgtctcaatttaaaaaaaaaaaaagatagattaagttggtagtaagttagtaactggtagaacttgactcaagccaaaatctaagattttcaccaatacaatctggaaatttttaaaaaattgccctgctaaactccccaattatcaaactgacatagagttttgtggccccttattccttcatgggctgcacaatctatcctgttccccctgctatcctgatggccttttagggtggttgcacagtatatgatgaaggactagaaactaaacctgacacacatgtggttatgccctttccctttctccttgtgatggcaaatcaaatctgcaagctgttgtttaaaacacagcctgttagttttttcttctctcaaagagaagaagtaataatacaggttgagcaccccaaatccgaaatgtgccagtgagcatttcctgagtatcatgtcagcactcaaaaggtttcagactttggagcatttcacgttttcagattatggatgttcacttggtaagtataacacaaatattccaaaatctgaaaaaaaacccaacatccaaaatactttttgtcccaagcatttcagataaggatgctcagcctgtacttggtgacttgttatgtcagtgaccttctcttacactggagttatgactatcatattaggaaacatggaaagttatctcgctatatagaccagtttaagtttttctttaattgctgtttattctgcagatatctaagttagtgtgctagttgtataatagtataattggcctcagttaatactatcattactttttatcattcatagttttcatttctaaaaacttcattagtattaattctttctgctagtagttttaatggactctcttttataaagagagaaggttagtcccagttaacattacctttctctacaattaatttttttaacttggagatttatacattagctctggcagtattatttgacatttatttgtaatatccaacttcttgataattggaaatagagtctgtaatacaaatgacattgataatcatgcatcagagttgcatataaatgttcagaaactcttttcacactctttttacctgtttgccaagtctttcatctagccccttaaaaagagcctggtgccagaaagaggaaactcagttatcttcctagatatacaatttgtttgactatgattaaaaactaaagtataaagtaggaagacagttaaaagccagaatcgctggcatctggtaacatcctcacctttagcaagatcagttgctcttgatcccagacttttacatagcttattgttgaaagcaggatcttagcaaaaagctatctttgtgtatatgtgtgtgtgtgtgtgtatgtgtgtatgtgtgtatatgtgttttctctctgagggtcagaatgcagaatgatttttagataacaattagaaaatagaaatgtaacattttatgatattaagtactaggatatttgagaattaaaatagtgtgtgcattctaaacgtaaaatgatattctggaatcgaaaaaggacattaatggaaaaactggtgaaatctaataaaatctatggtttatagttttgtaccagtgttcttagttttaatagatgtactataattatgtgagatattaacattaggggaaactgggtgaaaagtgcatgggaactctgtactatctttacaactcttatgtaaatgtaaattattccaagataaaaggttagtggtggctgccacctaaaatcccagtgctttcagaggccaaggtgggaggatttcttgaggccaggatttgaggaaaacatagcaagaccctatctatacaaataataacaaaaattacccaggtatggtggcatacacctgcggtcccagctattcaggaggctaaggcaggagagaggcaggaggatcacttgagcccaggagtttgaggttacagtaagctgtgatcacaccactgcattccagctggggtgacagagcaagaccctgtctctaaaaaataagtaaaaagttaaaacagtgtacatctatacaactagcaagattatgaagaaaaaaataaacgaatatcaccaaagtcaggattgtgattatagagggacacatgaagacttctgaggtattggcagtttcctgggagatgactacacaagtgttcacttgatacttacttgttaaaccatagatctgtttcatgtacttttctgaatagatgttatatttcacagttaagattagaaaataatatgtattatttccagttagtaagattgcagatcactatggggaaacatttgttcctaatgtctatattccttaattaattaagaatttgtaaagaatatattctttggagtggtgatgaggtttcagctgtgaagtgttgcctctctcattcatggttttgtatgctttgtttaggtagaaacgttgaagcacaatgatccttttgctcctggtggaacagttgttgcagcaagcgattcaggtaaataaataatttatcaacttcattgaacattaaacattttttttaagattcttttttctttgtctctaaatatatttgtcctgttatttatagctttaaaattattgcataattatatccaatagtaatttaccaataataagcatttgtatatcactttctacttatctttcattctttcatttattattcatgttgaatattacactagaatatgaactctacccagtatcagtaaaccaataaaaatgttttgctttataaaatgctgtgttgcttggcagcttcaaagtcagcattgactgttacggatcttggtctaagttaaaagattagtggcttccagtagaaaatgaaaattgctttacaaatacaaatgggttctgttaataatacagagaaaagctaaatgttattttagcatccagtcttcatacttcatttatggtataaaattttttatttattcttttaataactttttaaatagtaatctcattttaaacataaactgaggaccagaatattaagcagtgttcatcaagatcgtacagtttaatagatttgaaccaggtaaagccaagattcaatattaggtctgacaaaaagctttttcaacaaagtaactctgcttcttttctactgttcatttaaaacaaaacagataaacagaccagctatcatttgggatgggagagcagaaaatttgaggaaagtaaactcaaatgtgtaaatactctaatattatgctgaaaatagatcgctttatttttctaggtgaatacagagtgagttgttcagtatacagatgtattaattgtgactaattaaggattatgaacatagaaaaagaatagtagaaatgcctttacaggagcctgggcccggtggctcacgcctgtaatcccagcattttgggaaaccaaggcaggtagatcacttgaggtcgagaccagcctggccaacatggtgaaaccccgtctccactaaaaatgcaaaaattagccaggtatggtggtgggtgcctataatcccagctacttgggaggctgaggcaggagaattgccagaaggcggaggttgcaatgagctgagattgtgccattgcacgccagcctgggcaacagagtgagactctgtctccaaaaaaaaggctggctctaaaaaacaggttgggtttcttataatgaacaaattgtaacaagatgagatttagcagagtgcattgttttcgggttggaaattaactcccaacatgagtagcaagagtgaggaatacaaaaaggagatatgtagaaaataagatttaatgtaggctggatattgatttaaatagaaacttagaatgagagcaagtgagacttctaaaaggcttattgtattaacagtggttaaattacatattttttaagtacatgtgctctttttataccctcattattaagctgattatattgctaggggtactatagaattaaaaaggataacctaagagaataaaatgaaaggttaatacgtttatgattgcccacaccaaggaaatggtaagtgccataagagttaattaaaccagcagagattaaaggaaggggagatcacgttaaggataaatcattaatgatatcaaagtggaatgtggcttttgtggtatgccttgaaagcatgggctagtattttagcaggtaaatatggaaagagattatgtggagcaaaaagaacaatgtgaacaaggaatggaggcagaacatatagggcatattcaaggaaaaactaacacatttttgcaagagctatttctcttttttttgcaagatagaggaatagtcaaggctgaagtggtaggttacagtgttacattaaagatttctaatacctctgttgatcttctgcttaaattccagttcctaattcatttcctgtaaagtggtagaataaatgatgataatagcctaggagggtgcaaagatttatcattaattgtaataataatggctactatttattgaacacttgcagagttccagcagtcaacatgctaatcatttttctctacttggtcccatttaattctcacaacaactacgttagattatttgtattatgtttattatacagacaaggaaaatccaggcatggagagatgaaacagttttcagaaggttaaagtagtagtattagatgtatccaattcaaatgaggtctctggttttccacctgcctctttggtcattctttctttaatctcctttgttgatatttcctctttttctcaacctcttaatattgtgttgtcccaagtcttagtccttggacctcttttcttttttatctgtactcccttgggggaactcatctgtggcttcaaatactactgatacactgatctatatctctagtcacatctctttcctgaaccccaggctcatttttccagctatttatttggcatctccacttgaatgtctgatagatatatctaatgcataagtctaacacaaagcagctatttttccttcctaaacctgcttttcttggcaccttcgacatcttcatggttcatctttaatgttgtccaggcctaaaatcttagaatcatccttggttcttcttttgctcttcctctgtctctaatctgtcaggaaatcttattgactctaccttcaaattatatccagtaaaagccttacagtggcctgcacttttctaacaatatctcatcattattcccattactcactctgctccagccacactggtcttcttgctgctgctcaaacaacagacccatgttctttggccctttgcactagctgttccctcttcctgggatgatccttctccgtatgttcacatgataatctctactacctctgacaaatcttttattttattttattttattttattttattttattttattaaagttttagggtacatgtgcacaatgtgcaggttagttacatatgtatacatgtgccatgctggtgtgctgcacccattaactcgtcatttagcattaggtatatctcctaatgctatccctcccccttccccccaacccacgaaaggccatggtgtgtgatgttccccttcctgtgtccatgtgttctcattgttcaattcccacctatgagtgagaacatgcggtgtttggttttttgtccttgtgatagtttactgagaatgatgatttccagtttcatccatgtccctacaaaggacatgaactcatcattttttatggctccatagtattccatggtgtatatgtgccacattttcttaatccagtctatcattgatggacatttgggttggttccaagtctttgctattgtgaatagtgctgcaataaatatacgtgtgcatgtgtctttatagcagcatgatttatagtcctttgggtatatacccagtaatgggatggctgggtcaaatggtatttctagttctagatccctgaggaattgccacactgaattccacatggttgaactagttgacagtcccaccaacagtgtaaaaatgttcctgtttctccatatcctctccagcacctgttgtttcctgactttttaatgattgccattctaactggtgtgagatggtatctcattgtggttttgatttgcatttctctgatggccagtgatgatgagcattttttcacgtgtctgttggctgcataaatgtcttctttggagaagtgtctgttcatatccttcatccactttttgatggggttgttttttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaatgagatcccatttgtcaattttggcttctgttgtcattgcttttggtgttttagacatgaagtccttgcccatgcctatgtcctgaatggtgatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttcctcattgcttgtttttctcaggtttgtcaaagatcagatagttgtagatatgcggcgttatttctaagggctctgttctgttccattgatctatatctctgttttggtaccagtaccatgctgttttggttactgtagccttgtagtatagtttgaagtcaggtatttgatgctgccagctttgttcttttggcttaggattgacttggcgatgcaggctcttttttggttccatatgaattttaaagtagttttttccaattctgtgaagaaagtcattggtagcttgatggggatggcattgaatctataaattaccttgggcagtatggccattttcacgatattgattcttcctacccatgaacatggaatgttcttccatttgtttgtatcctcttttatttcattgagcagtggtttgtagttctccttgaagaggtccctcatgtcccttgtaagttggattcctaggtattttattctctttgaagcaattgtgaatgagagttcactcatgatttggctctctgtctgttattggtgtataagaatgcttgtgatttttatacattgattttgtatcctgagactttgctgaagttgcttatcagcttaaggagattttgggctgagacagtggggttttctagatatataatcatgtcatctgcaaacagggacaatttgatttcctcttttcctaattgaataccctttatttccttctcctgcctaatggccctggccagaacttccaacactgtgttgaataggagtggtgagagagggcatccctgtcttgtgccagttttcaaggggaatgcttgcagtttttgcccattcagtatgatattggctgtgggtttgtcatagatagctcttattattttgagatacgtcccatcaatacctaatttattgagaatttttagcatgaagggttgttgaattttgtcaaaggccttttctgcatctattgagataatcatgtggtttttgtctttggttctgtttatatgctggattacatttattgattggcatatattgaaccagccttgcatcccagggatgaagcccacttgatcatggtggataagctttttgatgtgctgctggattcggtttgccagtatttgattgaggatttttgcatcaatgttcatcaaggatattggtctaaaattctcttttttggttgcatctctgcctggctttggtatcaggatgatgctggcctcataaaatgagttagggaggattccctctttttctgttgattggaatagtttcagaaggaatggtaccagttcctccttgtacctctggtagaattcggctgtgaatccatctggtcctggactctttttggttggtaagctattgattattgccacaatttcagagtctgttattggtctattcagagagtcaacttcttcctggtttagtcttgggagggtgtatgtgtcgaggaatttatccatttcttctagattttctagtttatttgcatagaggtgtttgtagtattctctgatggtagtttgtatttctgtgggatcggtggtgatatcccctttatcagtttttattgcgtctatttgattcttctctctttttttctttattagtcttgctagcggtctatcaatttcgttgatcctttcaaaaaaccagctcctggattcattaatattttgaagggcttttttgtctgtttccttcagttctgctctgattttagttatttcttgccttctgctagcttttgaatgtgtttgctcttgcttttctaattcttttaattgtgatgttagggtgtcaattttggatctttcctgctttgtcttgtgggcatttagtgctataaatttccctctacacactgctttgaatgtgtcccagagattctggtatgttgtgtctttgtgctcgttggtttcaaagaagatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagagctttacttccaactacatggtcaattttggaataggtgtggtgtggtgctgaaaataatgtatattctgttgatttgtggtggagagttctgtagatgtctattaggtctgcttggtgcagagctgagttcaattcctggatatcctttttaactttctgtctcattgatctgtctaatgttaacagtggggtgttaaagtctcccattattattgtgtgggagtctaagtctctttgtaggtctctaaggacttgctttatgaatctgggtgctcctgtattgggtgcatatatacttaggatagttagctcttcttgttgaattgatccctttaccattatgtaatggccttctttgtctcttttgatctttgttggtttaaagtctgttttatcagagactaagattgcaacccctgcctttttttgttttccatttgcttggtagatcttcctccatccttctattttgagcctatgtgtgtctctgcacgtgagatgggtttcctgaatacagcacactaatgggtcttgactctttatccaacttgccagtctgtgtcttttaattggagcatttagtccatttacatttaaagttaatattgttatgtgtgaatttgatcctgtcgttatgatgttagctggtgattttgctcattagttgatgcagtttcttcctagtctcgatggtctttacaatttggcatgattttgcagtggctggtactggttgttcctttccatgtttagtgcttccttcaggagctcttttagggcaggtctggtggtgacaaaatctctcagcatttgcttgtctgtaaagtattttatttctccttcacttatgaagcttagtttggctggatatgaaattctgggttgaaaattcttttctttaagaatgttgaacattggcccccactctcttctggcttgtggagtttctgccaagagatcccgctgttagtctgatggggcttcccctttgtgggtaacccgacctttctctctggctgcccttaaccttttttccttcatttcaactttggtgaatctgataattaagtgtcttggagttgctcttctcgaggagtatctttgtgtcgttctctgtatttcctgaatctgaatgttggcctgccttgctagattggggaagttctcctggataatatcctgcagagtgttttccaacttggttccattctccctgtcactttcaggtacaccaatcagatgtagatttggtcttttcacatagtcccatatttcttggaggctttgttcgtttctttttattcttttttctctaaacttcccttcttgcttcatttcattcatttcatcttccatcactgataccctttcttccagttgatcgcattggctgctgaggcttctgcattcttcacgtagttctcgacttttggtctttgatgatggtgatgtacagatgagtttttggtgtggatgtcctttctgtttgttagttttccttctaacagacaggaccctcagctgcaggtctgttggagtttgctagaggtccactccagaccctgtttgcctgggtatcagcagcggtggctgcagaacagcggattttcttgaaccgcaaatgctgctgaccgctgacaaatcttaattcagatatcaccttctcagtgaagcttattcaggccactctgtctgacatttacaagtaccactacccagctcagtgctcccacattactattctctacttttcttctttcattgtcacttactttccatcttattatataaattactttacttttctcttatctgtttccttttcatcctattagaaattaagctccagaaggaattgagatctttgttttcactgatataacccaagaacctgaaaatatgcctgggcgtatgttattgaatgaaaaaatgagccagctgctcttctcagagaacatgtaatgggagtctagtgggtagacattatttattttgttatgataagtagtttttttaaattgtggtaaaatatacataacataaagtttggcattttaaccttttttaaatgtacagttcacgagcattaagtacattcacattgttgtgcaatcatcaccaccatccatctcaagaacttttttcatattccagaactgaaattctgtatccattaaataataactccctatcctccctctcaccaaaccctaacaaccatcattactactctgcatacttcatataagtggaatcataaaaaaaattcatattttggtgattgacttatttcatttaccataatgtcctcaaggttcatccatatggtataatgtattgaattttttacctttttcagacttgataatattctattatatgtatatactgcattttgtttatttgttcattcattaatggacacttagttgccgtcacattttgtttgtgtgcataatgctactgtgaatgtgagggtacagatatctgagtccctgctttcagttcttttgggtataattctaaaagtagaattgctggatcatatggtaatgctgtttttagttttttgagaaatgatcatactattctccacagcagccataccattttatacaccagccaacaattcacagtggttccagtatttccacatctttgccaacccttactactttctgttttataggcatcctaatgggtgtgaagtggtatcttattgctttgatttgtatttccctaatgattagtatgtagtgcctttttttatatgcttattggctatttgtatatcttctatggagaaatacctattcaagtcctctgcccatttctaaatcaggttgtttttgttgaattttttatatatcctagatattaaccccttatcagataaatgatttgcaaatattttctcccatcctgtgggttaccttttcattctgttagtactgtccgttggtgaacaaaagtttttaattttgatgtagctcattttatctattgtgttgttgttgcctttgcttttagtgttataaccaagaaagcgttgctaaatccaatatcaggaagcatttccccgataagttttatagttttagctcttacatttaggtatttaatccattttgagttaatttttgtatattgtgtgaggtaagagtccaacttcattcatttgcatgtggatattcagttttcccatcatcttttcttgtgaagaccgtcctttttccattgtttgttcttggcacgtttcttgaaaatcatttgaccatatatgtgagggtttatttctggattctgtattctgttccattgatctatatggtttgtatttatgcagttcctcactgttttaattactatagctttgaaataagatttgaaatcagaaagtttgactaccaactttgttgttcctttttaagactgctttgggctgggcacagtggctcatgcatgtaatcccagcactttgggaggtcaaggtgggtggatcgcctgagctcaggagttcaagaccagcctggccaatgactgagttcaggagttcaagaccagcctgggcaacatagtgagactctgtctctacaaaaaaatgcaaaaattagccaggcatagtggcatgcacctgtactcccagctacttgggaagctgaggtgggaggatcacttgagccgaggaggcagagattacagtgagccaagatcatgccactgcactgtagcctgggtgacagaaccagaccctgtctcaaaaaaaaaaaaaaaaaaaagaaagaaagaaaaagaaaaagactgctttggctattcaggttccttgagattccatatgaattttaggatgaatttttctatttctgccaaaagaaaaagtcattaggatttttgatagggattgcattgaatctgtagatatctttgggtaatattaccaacttaaaaatattaagtcttctaatctgtgaacatgggatgtctttccatttgtttgtgtctttaatttctttcagaatgtattgtattgtcagtatacaagtcctccttggttaattcccaagtatttcattctttttgatgctgttgtaaatggaattgttttcttaatttcctttccagattgttcattgttggtatatagaaatatgactgattttcatatgttgatttttgtatcctgctactgtgccaaattcaactattagttctaattgttttttggtggaatctttagggttttctacatataagagcatgttatttgcaaacagattttatttctttgttttgaatctggatgccttttatttctttttcttgcctaagtgctttggctaggacttccactactatattgcagggatccccaaaccctgggccacggaccagtaccagtctgtggcctgttaggaaccaggctgcacaggaggaggtgagtgatgggcaagtgagcagtacctaatgcctgagctccgcttcctgtcagatcagcagcagcattagattctcataggagcttgaaccttattgtgaactgcacatgtgagggatctaggttgtgcactccttatgagaatctaacacctgatgatctgaggtggaacagtttcatcctgaaatcattcccctcatcccacccccaagtcctaaaaaaattgtcttccacaaaaccggtccctggtgccagaaaggttgagaactgctgctatattgaatagaagtggtagaaatggtaagagcacgcatccttgtcttgttccttattgtagagaaatggtttcagcctctcaagattgaatgtgatattcactgttggcttttcatatatagcctttattaagttgaggtagttttccttctgttcttagcttgttgagtgtttttatcatgaaagggttttgaattctgtcaaatactttttttgcatccattgaaatgattggtgttgtatttttcccctcattctgttaatgtggtgtattacattgaatgatttttgtatgttgaaccattcttatattccaggaataaatcccacttggacatggtgtataatccctttaatgtgctgttgaattctgttgaggatttttacaaaaatattcataaaggatattgatctatagttttcttttctcatctatatgtcttcatctggctttgatagcagagtaatactggcttcacagaatgagtatggaattgttcctgcctcttcaattttttggaagagtttgagggagactggttttgattatactttaaatgtttggtagaattcacccgtgaagtcatgtaatcgtgagcttttctttgttgggaggtgttttgttttgttaattttaaaaataatggtggccgggcacagtggctcacgcctgtaatcccagcactttgggaggctgaggcgggtggatcacttgaggtcaggagttcaaaaccagcctggccaacatggtgaaaccccatctctactaaaaatacaaaaatgagccaggcgtggtggtgggcgcctgtcatcccagctactcaggagactgagataggagaatctcttgaacctgggatgtggaggttgcagtgagccgagattacaccactgcactccagcctgggccacaaagcgagactctgtctcaaaaaaaaaaaaaaaaaaaattaaaaatatggaatgccacaagaatttgcatgttatccttgcacaggggccatgctaaccttccctgtatctttctagttttagtatatgtgctgctaaagtgagcactgttggaaggtttttgattacagattcaatctctttattagttatgagtcaattcagattttctttgtttttgtgattcagtctccatgacttgtgtttctcagaatttgttcttctcatttatattattcagtttgttgatgtataattgttcatagcactgtgttaacaatcctttttatttctgtgaaattactagtaatgtctcctctttcatttctgattttagttattgagtcttgttttcttagcccatctaggaatgtcaattttgttgatcttttcaaagaacaaactcttggttctattgattttctctatttttctattctctgtgttgtctctgctccaatttttattattcatttctttctgctagctttgagtttagcttgcttttctttttttaggtcctttacagtgtaaagttaggttgttgatttgagctcttcttttttaagtatttatagttagaagtttatctcagcacagcttttgctgctatatcccgttagttttggtaatgctgtgtttccattttcatttgtttcaagatattttctaattttctttgtgatttttctttgaccaattggttgagcgtgatatttaatttccacctatttgtaggtcgtctagttttgcttctgctgttaatttttagttttattctgttttaattggaagagataaatttatttattatttttattttgagatagagcctcgttctgccacccaggctggggtgcaatggcgcgatctcagctcactgcaacctctgcctcccgggttcaagcaattctcctgcctcagcctcacaagtagctgggactataggcgcccaccaccacgcccgtgtcatttttgtatttttagtagagacggggtttcaccatgttggccaggctggtctcgaactcctgatctcaagggacctgcccatctcggcctcccaaagtgttgggattacaggcatgagccaccgcacctggctggaagagatatttttatgatttcaattttttaaaattcattaagagttgttctatggcctaaagtatgttctgtcttggagaacattagatatgtacttgagaaaatgtgtattctgctattgttgggtggagtgttctgtatatatctgttaggtccagttgatctaaagtgttgttcaagtcctctctctccttattgaaagtgagatattgaagtctccaactgttactgtagagctgtctgtttctcccttcagttctgtcagtgtttaatgtatatattgaagaagcatgtttggtgcatgtatgtttataaatgttacatcatattggtaaattgaccctttatttattgtataatgtccatctttgtctcttgtaacagttgtagagttaaagtctattttttctgatattaagatatctctgctttcttgatattctatttgcatgaaatatcttttttcatcttttccctttcaaactatgtgtgtccttagatctaaagtgaatctctcttatacagcatgtagttgtgttttgcattttttttctaccagtttgtgtcttttcattagagagtttaatccattcacatttaaagtaattactgatagggaaggacttattattgtcattttgctgtttgtttctgtatgtcctatagttttatgtcccttatttcctctattacggtcttcatttatgtttagttgattttttgtagtgacattttttattccctcctcatttccttttactcttttctctgtgtttcatggagattacacaaaacatcctacaattataacagtctattttaaactgataagatttaatttcagttggatccaaaaccactcctttacagctccactccccactttatgtggttgaaagtcacaatttacttctaaagttgagttgtgagccagtattatagtaatactattttttatatttgtccatatgttgatatttacctttatcagagaaaactttatattttcatttggtgtctaacatcctttcatttcaacttgaatgactccctttagcatttcttttttttcctttttttttttgaggcagagttttgctcttgttgcccaggctggagtgcagtgacgcagtctcggctcactgcaacgtctgcctcctgggttcaggcgattctcctgcttcagcctcgctagttgctgggattacaggcatctaccaccatgcccgactaatttttttttttttttttcctggaagcagagtctcactccaggctggaatgcagtggcaagatcttggctcactgcatcctccccctgtcgcttcaagttgttctcctgcctcagccttccaagtagctgggactacaggcacgcaccaccatgccccactaatttttgtatctttagcagagatggagtctcaccgtgtttgccaggctggtcttgaactcctgacctcaagtgatccgtccaccttggcctcccaaagtgctgggattacaggcatgagccaccacgcccagccatgcctcactaatttttgtatttttagtagagatggggtttcaccatgttggccaggctggtctcaaactcctgaccttacgtgatccacccaccttggcctccgaaagtgctgggattacaggcatgagccactgctcccagcccctttagcatttcttatagagtaggtctagtggtaatgaaccattcagtttttgtttatctgggaatatcttaatttctctcttgtttgtgaaggacagtttaccagatacagaattctcagttgacagtgtttttttcgaacccttcaatatattcccctactcccttcaaggtttctgctgagaaattcactgataattttattgaggatcctggccaggcactgtggctcatacctgtaatcccaacactgtgggaggccgaggtgggaggatcacttgaggtcaggagttcgagactagcctggccaacatgatgaaactccatctctactaaaaatacaaaaattatccgggcgtggtggcttgcgcctgtagtcctagctactccagaggctgaggcgggagaatcacttgaacccgggaggcagaggttgcagtaagccaagatggcagcattgcactccagactgggtgacagaacgagactccatccaaaaagaaaaaaacaattattgaggatcccttctgcatgatgagtcagttttctctcactactttcacagtgctatctttgtttctgtctttcagcagtttgattataatgtaactcagcataggactcttttgagtttatcctacgtggagtttgttgacctttttatatatccatgtcttccctcaaagttggggagttttggccattatttcttcaaataagctctctgcctctttctttccggtataaagattagtgtgggggtgtctccattgttcttttttttcccctcaaacttagagctggaagaaaccttagacatcctgtgggccagaatttcatattaccttccacaaaactaacttccagagaggtcttcaggaagttggcaaattttagttacgtatttttaaagtgtctttgaacttttaagaactacatctcgttaattatatgtattcgtatatattattatccaaattttaacaaattagagtgcattggtgctttaaagtgctgtcaactactctgagaatgcaaaattcttgttttaaaatgtgtatcttacaactccttccttggatgaattagatttttttagatggagaaaccaaaatcaagtacagccataccttggagacattatggtttggttttgttttaggaacccaggctggtcttgaattcctgggctcaagcagtcctcccacctcagtctcctaaagtgctaggattacaggtgtgagccgctgcacctggcccagcatgggttcttttccataccaccacaataaagcaaatattgcaataaaagaagtcacatataaaagttctgttttcactatactctggtctattaagtgtgcagtaacatgtctaaaaaatgcacgtgtcttaattagaaaatgcttcattgctttaaaaaaaaaaaatgctaatgatcgggcacagtggctcacacctgtaatcccagcactttgggaggccggggtgggtgaatcacctgaggtcaggagttcaagaccagcctgcgcaacatggtgaaaccacgtctctactaaaaatacaaaaaattagccaggcgtggtggcgggtgcctgtaatcccagctacttgggaggctgaggcaggagaattgcttgaacccaggaggctgaggttgcagtgagctgagatagtgccattacactccagcctgggcaacaagagtgaaactccatctcaaaaaaaaaaaaaaaaagctaatgattatttgagccttcaacaaattgtaatcttcttggtggtggagaatcttgcctcgatattggtggctgccgactgatcaaggtgttagctgctgaaggttggggtgcctgtggcgatttcttaaaataacactgaagtttgtcacatcaattgactcttcctttcctgtacgatttcttttagcatgtgacactgttcgatagccttttacccacacaagatagtctttgaaaattggtatccgtccttttagatcctgccactgcttcacgaactaaatttatgtaatattctaaatccattgttctcattttaacaatgttcacagcatcttcaccaggagtacattctatctcaagaaatcactttcttatctgtagaggcaactcctctttggttccagttttatcatgagatttcagcaattcagtcacatcatcaggctctacttctaattgaagttcccttactaatttgtaccacgtctgcagttacttcctccactgaagtcttgaatccatcagtaatacatgacggttggatgtaacttctttcaaagtcctcttactattgctattttcacctccttccatgagtcacactgtttttgttttgttttgtttgagacggagtttcactcttgttgcccaggctggagtgcaatggagctgtctcggctcattgcaacttccgcctcttgggttcaaatgattttcctgcctcagccttccaagtagctgagattacgcccgccaccacgctcagctaattttttgtatttttagtagagacagggtttcactgtgttggccaggctggtctcgaactgctgacctcaggcgatccaccccgcctcagcctcccaaagtgctgggattacaagcgtgagccactacacccggcctgagtcacattgttcttaatagcatctagaatggtgaatccttcccaggaggttttcagtgtactttgcccaaatccatcagaggaatggctgtctatggcagctatagccttataaagtgtatttcttaaataataaaactagaaagtcaaaattactccttgatttgcaagaattactgcctggctgcaagaatggatgttgtgttagcaggcatgaaaacaacattcatctccttatacatcttcatcagagctctgggtgacttaggtgcattgtcagtgagcagatttttgggtttttttgtttgtttgtttgttttgagacagtctccctctgttgcccaggctggagcacagtggtgcaatctcagctcaccacaacctctgcctcccaggttcaagcaattctcctgcctcagcctcccaagtagctgggactacaggcacatgccaccacacacggctgatttttgtatttttagtagagacaggatttcaccatgttggccaggctggtctcgaactcctgacctcaagtgatctgcccgccttggcctccaaaagtactgggattacagacgtgagccacagtgcccagcctagcaggagtattttgaaagaaatctcttatctgagcagtggatcccaacaatgggcttaaaatattcagtaaaacatgccataaacagctgtgctgtcatccaggctttgttattttatttctactgtcaatttatcttaattcataggggccttaggattttcagaatggtcaatgagcattggcttcaacttaaaagttgccacagctgcattagccccataggagactcaacctgtcctttgatgcttcaaagccagacattgacttctctttagctatgacagttgtagatggcattttcttccagtagaagactgctttgtctacattgaaaatctgttgtttagtgtagccacctttatagatcaattatctaagctagacttctggataacttgctgcaacttctgtatcagtacttgctaagtttgtttttcttctttttaaaatccttttgtttgtgaaatgaagaatggactgtttttttcagttcctatggttaagttggcaaacctgttcttgccctatttatgtatttatgttggtttgtttgttttgttttgtttttagttacaacgtaagtcttttcctacattgtcttcttaaatgtaattccacttgacatgaaaacttttaattatgagaatatggagaaggagaattagttattattatataggtcattcaggtcagtggttcctaaatatcttttaaactttatatggggaaaaagagatatgtatataggtttttaatgtatttatttaattagtttacttgttcataaaatcccaacttctggaaactactgagattctgagaggtgatgttacatacccaagtcacaaacacaagacatttacccaccttactggtacccttctacccttattattttcttccactaggtagaattccaccaggcaaaaagattgatcctacggaacaggggaattgttaagctttcaaaataaataaaaacatgccagtaaatttttgttcttaaatgttatatataactctactccaacctctaaaatatacttgttatcatagggatagaagcatattaaatatagtcgggcgcggtggctcacgcctgtaatcccagcagtttgggaggccgaggcaggtggatcacaaggtcaggagattgagaccatcctagctaacacagtgaaaccctgtctctactaaaaatacaaaaaattagccgggcgtggtggcgggcacctgtagtcccagctacttgggaggctgaggcaggagaatggcgtgaaccgaggaggcagagcttgcagtgagccaagatcgcaccactgcactccagcctgggcgacagagcaagactccatctcaaaaaaaaaaaaaaaaaaaaaaagaagtatattaaatattttatggctgggcgaggtggcttacacctgtaattccagcactttgggaggccgaggcagacaggagtttgagaccagcctggccaacatggctactaaaaattcaaaaattagctgggcatggtggcatgcacctgtaattccagctacttgggaggctgaggcaggagaatctcttgaacctgagagatgttgctcgcctgagcaacagagcgagactccatctcaaaaaaggtatgttaaatattttgcctcacattgagatcttgttagcatttgcttctggtgaatagacacattgcagactgtgaaagaaaactaaggaaagcaaatttagaattcttactgggtttttttgtttgtttgttttgttttggagacagagttttgctcttgttgcctgagctggagtgcaatggcgcaatctcagctcactgcaacctccgcctcccaggttcaagcgattctcctgcctcaccctcccgagtagctgagattacaggcatccgccaccacgcccggctaatttttgtatttttagtaaagacgttggccaggctggtctcgaagccctgacctcaggtgatccacccgccttagcctcccaaagtgctgggattacaggcatgagcaaccgtacccggcaggatacttactttctacatgtactttataaaaattatttttccattttattgtgagattagtttaagtgccagaaatttttttgtgtggaatattttactaactcctgacagaaaatgcagaacttcccaactgttaattaaatctttataacatcctgaggatatagaagggagctcatgatctccctagagcatctttgactccagcaggagtaaaatacccagtaggttttcctttttacaggcaatgactcaggctaaacgtatatgtgttcatgtatttacttagcctctgctttctttcatatttcttctcttaattttcatcatttccagaaaccacaagctgtgactgtccttcaagttcacttaattttttttggagacggagtcttgctctgttcacccaggctggagtgcagtggtgcaatctcggctcactgcgacctccatctcctgggttcaagtgattctcctgcctcagcctcccaagtagctgagattacaggcgtgcaccaccacgcctggctaatttttgtatttttagtagagacagggtttcaccatgttggccaggctggtctcgaactcctgacctcaagccatttaattgtgtctttgaaggtaaataatatgtggaactggatcccaaatcctgagaatgccagaactacaggtccaaaacatgatgcactattctcagcagagttcagaagggtcagaactcaaggtgttatgaggcagagaacacatgaaattcgtgcattccatttagcagcccccatgagaccagaaatacaccccaggagtctttgaagatggggataattcaactcctggttttataaatagaagaatgaggagtaccaaaaatgttatgttgaattctcttcatttttctcatacaatctgaagcctgagctatcttatcctcaactcatagcagctgatgctgcagtttaggtttgagatcagtccctctatccattcaagagtgacccgaggcatagagctctaatcaggacagctttttaacaagaaccttctagtgacatactggtttagtttataagattttaatttacaaatttaaaaagctgcatctttaactttttctcctttttcttttctttcttcacatcactcttttccttatctatatcttactctttgtcatcttttctatcctttttgctcccttctgtttcctgcccttctttcttctctacatcctgattggcaatcttgttgttgatgaagttgtgtagggcaactatggaatgtgtcagggaggcagagtaccccactgccatttggtcgttgatcttcaggtacaaggccttgacagactgctgcaggctgatgtctggcagcagattgaagacttcctgcagctaatgatctggtggttgattggcagcttgcctgtggctgttttttccaggtagctcctgatatccagaagcttggagttcagcctcctcaaaccatggacctctttgtgatcagctggtaaagactgtccactgtagcatctttgatgtcttgtaacaagtgttcagctccagctgcctcagcttcctctgctccagtttcattagccacatgctcaaatgtttttgaggttggagcaccatcatcatggacttctctcactgaaatatatgcttctgtgggcagccccagatcctttagtttcagtcagtaataccaatactgagttaggttagtgtcttttcttgagttcattgatggcaatgttactcttgtgtagtttagggcctgtgtggtaccacccaactattctttggcattaattttcttaaacattccatacatgttttccaaataatcatggtctaaaaaccagacagaatgatttttgtcatcttcatcaaaagggactccagaactgttggatacatcaagtacttttgtctgccatgaccccaaaagcacaccaacaatgcactgctggtttccaaccttgctgattcggttgaaatgatccaccacactgagcagcaccggaaggtggaccactgccttctgcactgccagctctgacatcttgacacacaccgcccactaggcctagctccctgcaacccacaaactccagcagtagcagcaactcctgtgaagactacttaattttttaatgaaaaaaatgtgtgtgcatgggcaggtatgaatttatgtatagtcatgcattgcttaatgatgggaaaatgtgagaaatgtgtggttaggggaacatcagaaagtgtactgacacaacctggatggtgtagcttactacacaacctaggctattcgtcatatagcctattgctcctaggcttcaaacttgtacagccttgaatactatactgaatactgtaggcagttgtaacgcaatggtaagtatttatgtatctaaacatagagtaaaaattcagtatagaaaatagaaatggtacatctgtataggacacttaaccatgaacggagcttgcggggctggaagttgctctgggtgagtcagtgagtcaagtaatagtgaatgtgaaggcccaagacatcactgtacattgttgtaaactttataaacactgtacacttgcactacactaaatttataaaaaacatttttcttcaataataaattaaccttatcttactgtaactttttaactttctaaaactttaaaaaatttttgaactttttgactcttgtaataaacctttagtttaaaacactatacagctgtacaaaaatattttctttctgtatatctaaactttgcctacttttaaattttttttttctttttttttttaacttttaaacttttttcttaaatgtaagatgcaaaagagaaaaaaggaaaaaaaattaatacacaaacaaacatgagcctaggcctgcacggggtcaggaccatcaatatcactgtcttccacctccacatcttgtccccctggaaggtctttgggggcagtcaaacacatgaagctgtcatctcttacgataacaatgccttcttctggtatatctcctgaaggacctgcctgaggctctttttcaattaacttatttgttgtatatgtagaaggtgaacactaaaataacgattggccaggcacagtggctcacacctgtaatcccagcactttgagaggccacggtgggtggattgaggttgggagttcgagaccagcctggccaacatggtgaaactcaatctctactaaaaaatacaaaaaaaattagctgggtgtggtggcatacacctgtaatgcaagctactcggaggctgaggcacaagaatcgctttaacccgggaggtggaagttgcagtgagatgagatcgcacgaccgcactccagcctgggcaacagagcaagattccatctcaaaaaaaccaaaatagggtgggcatggtggcttatgcctgtaatcccagcactttggaaggctgaggtgggtggatcacctgaggtcaggagttcgagaccagcctggccaacagcgaaaccctgtctctactaaaagtgcaaaaattagccaggcatggtggtacgtgcctataatcttagctactcaggaggctgaggcaggagaattgcttgaacccaagaggcggaggtttcggtgagctgaggttatgccactgcactccagcctgggctacagagtgagactctgtctttaaaaaaaaaaaaacagcctaacaaacaaaataataataaaataacgattaaaaactatagtatagtaaatatgtaaaccagtaacatagttgtttattattattatcaaatacgggttgagcatccaaggtctgaaaaatctaaaatttgaaaatctaaacctttttgagcactgatatgatgctccaaggaaatgcttattggagcatttttggtttcaggatttttggatttggagtactcaacttataagcatatacagtgcaaatattccaaaatctgcaaaaatctgaaatccaaaacactccttctcccaagcatttcagataagggatactcagcctgcattgtgtactccacataatcgtgtgtgctatactttgatacgactggcaacacagtaggtttgtttacaccaacatcaccacaaacacatgagtaatgcattggactatggatattatgatggctatgaagtcattaggtgataggaattttttagcccaattataatcttactgggccaccatcatatatgtagcctgttgttgaccaaacattgttatgtggcatatgtcaagatttctggtagatagctgtttttcagggaattatttgtgagccttaaaattggtttcccttattccttgttattcatctggttatgctaagaaatgttatatttgtttggacgattcttaatagacagtttctgtcccttttttctttgcatattttcaacaaatatgagcatctcctagtttccagaccttgtgctaggccttgaggatacagctgtgaacaaaacaaagttcctgtcttcatagagtttgtataagaaagataggcaatgaacaaatatatgtcaaatactgatgagtactgtgattaaatcagggtaagggataaaaagtgatatacctaaaatgtagctttttcatgtacaccttcacaaaaaaccgtatcagcatagcatgatctcaaatatgtaagaaaaaaataccaggaataaaggctgttaaagaagtatgctgaaatattcataagggttatttctgatagtgagatttagggatgatttttaaattatacttttatatatttttccaaagcattcattacctttattctttggggaaaggcggtactaatgaggtcataagtgcagctaaagcccagttctgctggctcatagcccctgtgtacaccaagaggaagaaagtcacctgcatggtttctctaaaagtgtttctggaactccccccagcaggtatcttacgcgtgatctgaacaagttgaactcattgagtcctgctttctgaacgggcctctgcctcaaatcaaccatgatcagtatctgagaaagttatttgtcattcatctaagatttgtctttctgcagtgtttagactagtgctaaataggtcatttatgaggaaagtgtagaaaaactctttagtaaggtactatatattcttcatatagaagtgtcctttttaaaattaattttgttcacaatatatgcttcacaatattccagtcaaatctgacctaactgaggctattgcacacatgttgtgacttgtaaaggctgtgggacaggacagagaaaaggcatgaagcaaattttcagtcccacaagtgaaatgagcccaactctttttcccttgtcagcagtcagggagagcatcttcaccccactcaggctgtgccttagctacctcagcatcagaaataacaggagccgggcacgtggcctataatcccagcactttgggaggcttaggccggcagattgcttgaggtcagaggtttgagaccagcctggccaacatagtgaaaccccgtctctactaaaaatacaaagaaagaattagccaggtgtggtggcacacacctgtattcccagctacgtgggaggctgaggcacgagaatcacttgaatctgggaggcagaggttgcagtgagccgagatcgtgccactgcactccagcctgggtgacacaggcgagactccatctccaaaaaaaaaaaaaaagaaacaaaaaagaaaaataacaggaaaaggacagaaagaagggaaaccctgaaactacctatgatgaggctgggccctaggctgaggattcagcagatatgtatcaatgaaaaggccatcttttatagctagaattataggatttcctataaccctgaacttccaacatcctcttcaggatcagagttgctggtatatccctaaaggcctgatttctctatgcttccacccactcctttttcccacttgggctaccctttgcctacagctgtcttggtgacgaaatgtttggtgacaaagcaaacaaaaatagtgtatcttctttgctcctctttttatgtccaagatatactcatttttagagatacgggcacactttacacattcaaatgggcggataggcacacttttgttctaagaatagtttgaggataacttttctttttttattttattttattttttttgagacggagtcttgctctgtcgcccaggctggagtgcagtggcgcaatctcagcttactgcagcctccaccttccaggttcaagtgattctcctgcctcagcctcctgagtagctgagattacaggcgtgtgccaccatgcccgtctaatttttgtatttttagtagagacggggtttcaccgtgttggccaggctggtctcaaactcctgacctcaggtgatctgcccgcctcggcctcccaaagtgccgggattacaggcgtgagccactgtgcccggcctgaggagaacttttctgtgcctctttgtcttgccttctcttttgcagttctttccttgccttcctttccaactgtttgctttgtttctttccatcttcctgtatcaggcagcaattcctataaacattctttgacgttattggtagcccttacacctgaatgggtgaagcctatctcagagtagatcattcattccagctgaaaatgttagtctgcttggtaagtgcaatgtgatggaagaaacaacttctcaggcctgtgaaacattgattaaatatactttgtttgtttgtttgttggagacagacacgctctgtcgcccaggctggagtgcagtgtcatgatctcagctcactgcaacctccgcctcctgggttcaagcgattctcctgcctcagcttcccaagcagctgatattacaggcacgcaccaccacgcccagctaattttttgtatttttagtagagagagggtttcgctgtgttggccaggctggtctcgaaatcctggcctcaagtgatctgcccacctatgtttcccaaagtgctgggattacaggcgtgagccactgcacctggcctgttaaatatacttttgtagttactgttccttctgcctggtagcctggtttctcttccccgtgtttatctatttggtaaactccatttcttactcaaaagattttatttaaaagctgaatgtaatggcttctttgctccgtttccagattcacccaggcagttagtgactcccactacaggtttttcatacctctttcataacccatataagactgttttattattatttgtttacatatcttttactagactgaactttttcaagggtagaaatttgtatcattttattttctcagacttggtatatggtcaacaaatgtttgttgactgtccattctttggataggacttattgcctgttttcaaggaccttaccatctaataaaggtgatcaattacaggtaaccatggtacaaactagaatgccattagtgccgcagagaaggaaaaaattacttcttgctgtgggaagtagtgacacctaagttactccagggtttgttgatgaggtagcatttgaaatatgtcttgaaggatgagtgtgaaatgtggcattaatggtattatattagctttttgtacttcttgatgtctttattagcagtgatttaagttcataggagctatattatttgaaatgtgttccaaagccttacctataaatcatctagttgttcctttacctgtactttacctataaatcattactttatttgctattactttacctataaatcattcatcagttgatttatacaaaggaatacatcttgtggggttatcagtatacagtctgtctttgtgggtgtcagtcataaattcaggaattaatatttgagattgtatgttttcaactgtctgaatgtgattaaccaaaagaaaacatgaaatttgatgccttggctgggtttggtggctcatgcctataattccagcactctgggaggctgaggcaggaggatcacttgaacccaggagtttgggatcagcctggacaacatggcaaaaccccatatctacaaaaaacacaaaaattagtcaggcatggtggtgcatacccgtagtcccagctactcaggaggctgaggtgggaggatcacttgagcctgggagattgaggctgcagtgagccatgatcgtaccactgctcttgaggctgggtggacagagtgagactctgtctcaaaaaaaaaaaatgtcttactgtcctgtttcatttattttctttattcattttagccacagacccctttgcttctgtttttgggaatgaatcatttggaggtggatttgctgacttcagcacattgtcaaaggtaatctacagtaattaatgggaagggaaaacatactgtgtttccaccaaaagaacaatcctcctttcaattatatagtcctctcacaaagttgcaacttgatttcagtaaatcacagcaaatgttgatttcagatagaaatgaaagataacatatagttaaagtagacatatttctttatataactagactgtattgatggtagaggtaattataattttctgttggcatgtttgcttaacaacttcatatttagtcttctgtctttttaaacatgtttctcccaattgaaccacattttccccctgttgactgtctgggtcaataggtgtaaaatctgggtttttatttcgtcctctctgtattggttacttgattttatgttctgaggttgttagggccagtattaaggtaattaatacacaaagtccagtactaaatgtccactatttactttccactgtggctgtgatattgattcgggctaagagaaaaggaggattagattgttggttccttggttctcaactgagggttattttgccaccagaggaacatttggcaatgtctagagacctttttggttttcacaattgaataggagatgctacttacatctagtggatagagatgagggatgctatttaatacagtccactctctagccccccacaatatgcaattacgtccagcctgaaatgtcaatgttgagcattacctaaataaatgtaaaattgtgaagtctgattcattatagaaaagttaatcttttgttacatatttgaaagggtcttcagacacacattaagatttatcattccagccaggcgcggtggctcatgcctgttatcccagcactttgagaggccaaggcaggtggattgtctgagctcaggagttcaagaccagcctgggcaatgtggtgaaacctcgtcttgaccaaaaaacacaaaaaattggtcaggcatgccggcacgcacctgtaatcccagctgctcaggaggctgaggcgggaggatcacatgagcccaagaggcagaggttgcagtgagcctagattgcgccactgtactccaaccttagagtgagaccttgtctcaaaaaaaaaaattatccttttatgggatcagtttgcttcaaaaaattgactttcaggctgggtgcagtaactcaagcctgtaatcccagcatcttgggaggctgagatgggaggattgcttgagcccaggagttcgagaccagcctgggcaacataacgaaactccatctctacaaaataaaaattaaaaaaataactaggcgtggtggtacacacctgtagtcctagctattcgagaggctgaggcaggaggatccctagagcccaggggttcaaggctgcagtgagctatgattgtgccactgctctccagcttgggagactcctgccttttaaattaaaaaaaaaaaaaattgactttcaagttgtccttatagtttgtcaagatgccattttccttgcattagtattaaatcttatatttaagttcattaggacgtatggaatccattttttttcctttgattaccatttagatcagatattcgtttgcggaaaggcatacagtccctttaaaatgggcctcaggtggtttttgcattgaatatttcctgaagcttgacaaacctttaatctagattgagctgtttttggtttgatctgttaatcttaataagtaatgatgttagaatcactcctcatatagaataacttttttttcagaaatttctcccattggaccctgaatgcaaaggttaaaatttcagtgttctcagaattaaaataaataaaactgtataatactgaaatcattattctgaatgctacatgactaccacaatttgcttggtatagccatgtataaccatttctttttaaacaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctggtatgagagttggtacttttcttcagtcaactgcatggcttttctctttctgaaaagtattgtgcggaacttacttatataaatggctttaagtgaaacaagtcaaacatatgtcagaagcctgctgctgtcattcattctgacctaactgctgaattacagacatgcacttaagaagtcagcatgtataaatttcatgagctgtctttctgctaagaccttttttcttttcttttttttaacttaatcatttcagagaggcaatcaatggaaaagggaaagtgtcaagaaaatctttttgccttttggaaactcattgattatccatttgaatagcagtttcctgtactttggtgttttaattataatttatttaagagaagattgtttcaaagtccttttcctgtaaagtataaagtcttccttaaatcctttaatgtgagaatatatggcctctttagtatccagaattcagcaatacagtgatttgaaacaaagtattggttttcttgaaggaaaatggtattttagctaacttaaaatattcctcttttttttttttttttttgagatggaatctcgctctgttgcccaggctggagtacagtggcatgatctcagctcactgtaacctcagcctcccggattcaagggattctcctgcctcagcctcccgagtagttgggattataggcatgatccaccatgcctggctaatttttgtatttttagcagagatggggtttcaccatgttggccacgctggtctctacctcctgacctcaagtgatctgtccacctcggcctcccaaagtgctgggattacaggtgtgagccactgcacctggccaagactcttttctaatagtgatttgtttcttatttttgtttgtttctatgtataattagtatgtgtgtgtatgtatatgtttagcactatacaaaggaaagtttgttttgtttttaggtcataataagtggctaaaaggataattccttgagtagttgtagtgctgttggggtattatgtgagaagacacatcttagtatatttttttttaaatcatacctcattccttgggaaattttcagtctcagtagttacagattaatattgccttttcatcataacctttccatggtcttgagcagataggttttttttctttgactgaaagaattgcatgtacaattgtaaatatccgataatctgttgaaaaatcaggtaaatgagttaagtgattccttctaaggaaaggtagcttatgtcatatatttctagaagtgaggttatcagaatatatttaaaaataaataatggttaatttgcacatttaagtttttacaacttgcatgatgccaatagtgaggttgtttttttaaatcttaagtaaaataatatgctagtgtttttgctcaatctaagaatcttcatccaagtaattgtatatcattgtaaaaagattaaggaaaagactggtttgttggaaagagcactaaactgggagtctaaatatctgggttctgtttctggatgttccctgactaactatgatcttaagtgtataatttcatatatctgacccttggctattaaatgttggcagtaattctaattttgcctactttcacaggattattggaagaatccattgagatatgagcatcttttctaagcagctacagtgatggaatctgttgttatgattgctattaccagcttatgcattttaggaaaaaaatatatttggagatattttgacccctatttttattatcttttcttcaagaagtactaagtttaagtaagacttagagaacttgtttgaaaatggtaatgaattagtgagtgactaataggacagaatactattgtttggtcagagattatttgatcagcaaccgcaaagatttaggccctgggcttcaaaacattttttcttcattttgaaatacagtaaataacaaaaaattggcagcattttactacggtaatttaaaaattttatgctcttaggtattgtatgtagaactagagaaaaatcagaagaattttcccagttttcagaggtcatttgctcttactgccactagtggataactgttatcaggctgagggctgtaacagcagaggcaggccatttctgtctttattctttattattctccttctgtttaatccattcgtctctccttttgggaacatgctgcttgggtgtggctaggggatggtgggattcagtctttggacaaaaatatgattcctggcccatccttactttgctatttgtttcattagctgcacatagctggaatctatttgagagatcatgtgtgaagaatttgaggacaaattgttggtgtagctatttaagacaatattcagaatgtgttttaggtactcaatcatcctctacccacagtactttaatgctatctgtgtacatgttcttgtgtgcttgtatttgctgtatttactggttgaattaattgtaatgattttgatccagggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgctgtaagtactgtgaatgagctgtttgggggagaaatctttaaagagttttcagagattattttggagtctgccaagtttgcatcattttaactaaatttaccaagatactaaaaatgatctttcattcttcccccaagcaaaacctctgtttgatcctgttttgacagttctacggttgttccatcgcacagatgattttagtagtcccagttcttgtcatatacacaagttgttttgtaaatctttctcttagtcttggtaatgtaagtaaaatcctaacagttattattttgtggatggttatgggtgatggtgatttaatgaacaattacagagtcattgctctctgcccactagatgaataatgccagtaataagtttgtgtatttgcagctgtgtatgtgtgtttgtgtataaagttttaatgatttctggagaccagtcagcaaatattatatgagaggatagagccagagattctttgaatagaaagtaaaactattaaacttacacagtagctttttaaaaatgtaaatgccagttttatgaaataaataaataaatggttgtcaggatttaaacaatctttatttggagggccctaattcactaacttctcatgtttactctgcgttctttcagagatgtctaaaataggaagatcgttagaaacagtggaagggtgccatgataacagcataagcagggcctataaaatcacagaaatggggcaaccaaccatggaggtatcagtctagagagacataaagcaatgtcatatattccatcattattcagtaaaaaaagttattttttaataaaattcttagaccgggtaacaaattttcagtttcacagttttttcaggcaaaataaccttcgttatcattgcctgttctataaaacagagattttcttctatttatcaccttatgcccttgagatgattttggaaatagatctagtggccaggtaactctgcctaatatttccctcctcagtgtagcattgggccattcaaccaattgctttattcctgcagctgtttctagttagaagggaggtagtcaagaatctgcatgcaggccgggcgtggtggctcacgcctgtaatctcagcattttaagaggccaaagtgctttaagcacctgtagtcccagctacttggggggctgaggtggtggaggttgcagtgagctgtgatcatgccactgtacttcagcctgggtgacagagccagaccctgtctccaaaaaaaaaaagaatctgcatgcaactaagacgactgagctcccagcttttgaatctgtactctaagttctggtggcttctcttgactatgaaggagcaaaataggaatcaatattttgaatattgtaaaaatggagtgccagaattatactgatttttttttttttttgagatgagttttgctcttattgcccaggctggaggcgcgatcttggctcaccacaaccttcacctcccaggttcaagcaattctcctgcctcagcctcccgagtagctgggattgcaggcatacccaccacacctggctaattttgtatttttagtagagacggggtttctccatgttggtcaggctggtcttgtactcctgatctcaggcgatccaccggcctcagcctctcaaagtgttgggattacaggtgtgagccatcgcgcccagccttacttaactttccttttttttttttttttttttaaagacagagtcttgctctgtcgccaggctggagtgcagtggcgtaatctcagctcactgcaacctccacctcccaggttcaagcaattctcctgcctcagcctcccaagtagctgggactacaggcacgcaccaccacacctagccaatttttgtgtttttagtagagacggggtttcaccatgttggccgggatggtctcgatcccttgatcttgcaatgtgcatgccttggcctcccaaagtgatgggattacaggggtgagccaccgcatccagcccgacttaactttcattagatggaatttgatttgtttcaagcagagaatcaaaaattggcctttttagaaggttataattctcttagtgtaaaataaccctctggtagtttgtggcatttaatatcttaagtatggttttagcaagtcaaactcttgttggggccagacggggtggctcacacctgtaatcccagcactttggaaggccgaagcgggcggatcacttgaggtcaggagtgtgagaccagcctggccaacatggtgaaaccccgtctctactaaaaatacaaaaattagccaggcatggtggcgcatgcctgtaatcccagctagggaggctgaggtgggaggatcacttaagccccagaggcagaggttgcgggagctgatatagtgccactgtcctcaagctgagttacagagcgagactccgcctcaaaaaaaaaaaaaaaaacaaaaaaaaacaaatctggttggaaggagtcttgaacaacagctgaggcattttgctccaaaatctcaatatagtataataaaaaacagcttataataagaacatcttcttttttcattgtgaaagatgtggttaagcattacacgtttcaaagttttgcttaattccctagggaaaaaaactaccatttcaaaagcctgacagtgtattttatttcatcctttcatgaaggattttctatgtaacaagacttgaaaccaattagaatttttaatttagtatttgccaaggttgctgtttggggtagataaaaatatttccccaacataataattatgagtgttaagattttatttagactggtctaaaagttcccaaagcctggagaaatcttcataatgctttttgttttatttttattttttttggctcactccgtcgatctggctggagagcggtggtatgatcacagctcactgcagcctcaacttcccaggctcaggtgatcctcccaggtagctggaactacagatgtgcaccaccacacctggctaattttttttgtaaaaacagagttttgccatgttgccaagatgaacttcttgaacttctgagctcaagcaattggcccacacccacagaactaggattacagatgtcagccaccatgcctggctcaaaatgctttttataaaatatgattaggttcttgggaggccgagatgggcggatcacctgaggtcaggagttcgagatcagcctaaccaacatgaagaaaccctatctctactaaaaatacaggattagccgggcgtggtggtgcatgcttgtaattccagctactcgggaggctgaggcaagagaatcgcttgaacccgggaggcggaggttgtggtgagccaagattgctccatagcacccagcctgggcaacaagagcgaaaactctgtctcaaaaaaaaaaaaaaaagattaggtttaaatcacatcttgcttagtatacccaatactttaatatgatgtatagcaaaatcagcttttttttttttttcttgcttcttagcttttttacacattaagggttaggaaactaccagtgggattaaattaaaaatgatttgttgtgtgagggtctcagtaaagttgaagtggtaaatattttacattacattaggtcaaaaaggctagccctgtcctgtttttaaatcttctaatctactataagcatttctactttttttagtgagatatatatatatatatatcacatttaaaaaaaaaaaatatatatatatatatatatatatatatatatatatattttttttttttttcagagggaatctcactttgtcacccaggctggagtgcaggggtgcattttcggctcactgcaacctctgcctcctgggttcaagtgattcatgtgcctcaccctcccaagtagctgggattacaggcaccaccaccatgcccagctaatttttgtatttttagttgagagcgagttttgccatgttggccaagctggtctcgaactcctgacctcaggtgatccacctgcctcagcctccaaagtgctgggattacaggcatgagccaccacatctagcctagtggcatttttaacatttagttttatagactttctatctatagattgaattaattttttaaattaaactatagcttaataactggttaatattaaacatgttttcagggggaaaaaaaaaagaattaacaagtaaccagactatttccagagtccttcaggtgtccttttgtaaaaactatttttccttctttttacttgctttactcatttatttattcgtttgttcatcgatcttttaaatggcagtatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactattatttttggttatcatgtcgtgcttttatgaaagaaatgaaatgtatatgcataaagacagtgcctaaaacataagaatttgtaggcaggacacagtggctcgcgcctgtaatcccagcactttgggaggccaaggtgggcagatcacctgaggtcaggagttcgagaacaacctggtgaacatggtgaaaccccgtctctactaaaaatacgaaaaaattagcaggcatagtggctcgctcctgtagtcccagctactcgggaggctgaaacaggagaattgcttgaacccaggaggcagaggttgcagtgagccgagatcacactactggactccagcctgggtgacagagtgagactccgtctcaaaaagaaaaaagaatttgtcactgggcacagtggctcatgcctgtaatcccagcactttgggaggctgaggtgggaggatcccttgagcccaggagtttgagaccagcctggggcaacatggtgagaccccgtctctacaaaaaaaatacaaaaattagccaggtgcggtggtgcgtgtctgtagtcccagctactgggggctgaggtgggaggatcggttgagcccagtgaggctgcaagaagctgggattgtgccactgtactacaacctaggcaacagagcaagaccctgtctcaaaaaaaaaaaacattgtgcttgtaatcccagcactttgggagttcaaggtgggtggatctcctgaggtcaggagttcaagaccaacctggccaacatggtgaaacccctgtctaataaaaaatacaaaaattagccgggcatggtggtgggtgcctgtattcccagctacttgggaggctgaggcaggagaattgcttgagcttgggaggtggaggttgcagtgagccaagactgtgccactgcaccccagcctgggcaacagagtaagactctgtatcaaaaaaaaaaaaattgtgacatggacttttggaaggcactgtgttctgaaaaactcatacagtactgggactgaatctctttctgccattttt

SEQ ID NO: 12027 - DNA, 7772 bp, Human
ccaaggcaggaaaaggttctaggatttgactcccctcactcccaattgatcctctcacctctaaaacatttccctggattttggggctagcagtgctcagcatatagtggcttcaggagtcccaaggagtagaaatatctatgtggacactaccttccggatcccgctgcctccgcccccaggcaagattaatgaacatcgtcttagactgaaagagaagtggaaagccggagtgaagaggaaactttgtctttctttggaccccttacttcctctaccttccttaaccctatggataggaagatggaggagagaagcaaagaaggagaagaatacagaaagagaaaaaggaggagagaaaagtaggagataacagataaaaaggtcacggaagaggacttacctgtaaaagctggggctttgctagggacacagaaaggagggaggtgctgggctgccctttgcagctggctgcctagggctagaagctcttcgggaggaggcggagaaaggggggttgagcatagaaggtgcccacctcctgctctcagcaatgtggggatagactcagcccacccacctggccccagcacacttgcttggagctcaaaaagggtcagtttgaaggagttttataccagcttcttccctgggagaggagccaagagaggcctatggcagcttccagatattaagttccacaacccctgcccccacctccagcccttcatcagagcccctacttacttgctgttttagggcattttcagcgacttcactctcttctacctcaaacgccatccacttttggagacaggtaccactgcccctaggcagggacttgggagaggaccttatgagtcaaacctctatgaaccccaacatttttgtactcggggaggctgaacccctgcccaaaatagcgcggtgaaagctactgccttctcccaagtaggggcctccagtactgccacagcaggggccgcattcctggcgcctcttcattcgaaaaacctctttccaggagacttcgctgattctgaacgaatactttaaaatatgggcaagggaaaaaaaaagacaactcttagaaactctccccacccaacatacctggagtgcaggcgaggtccaggcaaacgggaaagcgacttcttgtacgaatagccatctcaagatgaagccaggctgtggaaaacttaaggccatctagatgggaaggaggtatttaaaagaaatcagcacacactcttacagaagccaaggcgggtctttaaattaaaaaataataataaggtatttatttcttgccccttagggaagaaaaatagcaaagtttggttcgcaggagtaaggagacagaggtgggtagggagagggaggagaaaagaggaaaagatggcccagcctcaagctctccagtcaacttggggcgggggaatacatttttccgtagcttgtaaaaagacttttcagccagtttgaggttagctgccaggggcagacagttgtaataatgccgacagaattgaggcttgtaagccgggcttcacacttctaaaatgcagttatggattctttcatcggtgttagatcaaggcaccaagttaagaaaacaaaagtcaaaacaacaataaaagaaaaaatcaaaagcttatttaattaccgagtcccgctgcccctgcggaactcgccgcgcgcgttaagctctcttttctttctgcggaattccatttgcatcccctctgcctgggtgtctccctctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccaccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgctgagggggcggatgcaagtcctggacttgggggattcgaagctcaccccaagcacccagtgtttcaactgctcggggaatgcttcaattgctcggggaagacactttccccaggcgagggcaagatcaaacgccgatccgggcagtttgtggctggcagggtgtaagaggcatggaggcgcggaagccaggagtccataaaggaccgtaaaattgcggcccacttgggcagcccgggtgctgcagccctccgaccagtttgcacgtcggtcagaggtccaaattaccttgtcacttcccgggcttcgcggcgccaggtcggaaatggtcccaatggtctaattgcctttggtctccggttgcatttgaaaaggcagagatcgggtcctccccccttcccctttccttcctagtcccacttctccacccaaaggaaaaggagctgcagggggctggagccccacccttctcagaggtaggcccaaaggggggctggtttaactggagaacccctccccaccaaaggctaatgggaaaggggtggatagcccggaagggagtttccctctgtgccaacaatcacctccccagaagggggtagaaaactgggcgcgggttggtgggggggaggagaggggagcccaccagcagacactcctccacagaactgtaggagtgggtggaaagagcctgggggcgggggggagaaagaccaccccctggtcttggcagccaacgccttgttgaatacctgcacctaccccttactatcttatcaccgatttcacccagcctccttcccataaccctcagaacaacctggactccactcacatatactaaggtaataaataagatactcaacatgcattctcactccagccctgcaatacacggaacctagtacacattcccacacctgttctggcagcccgtcacacataagagcaaggaaactctctgaatgcccagcatactacaatgcacttgacccagagtttacaaccctctagcacaaaggtgcatctcaactcatgtgcctgtcagaagtgcacgccctgccaacgggaggcagaaatctcacctatgctccagggcaggtgggaagggcggctgggaacccctgtacccaggatgccttagaggaagggaaggcctccccaaagacctctacctacccaatcaagggcaggcccttattttcccttcttgggttccccagaggccgcagtaccctagcagaaacagttactgaggtggctgacagggtgtcccttcccaaatcaccctcccaccttaggcctacagccccacttcaatggcgtttgtgtgtctgtgtctgtacacgcctgtgctctggactcgctgtgcagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtatgcggggtccaggctggggaggcgggtgtgcacctatttagcgggaagtaaatgccaactgccaactccctgaaacgcaggccaggaatctgggcctggggtctccctgcccggcgcgtgcagattgaccctcgtgacagctcctaggcaggcattgctgccatgtggctgactctgtccctttcctggttaaatagacaaggggtgggcgtgggggaaggggatagagtgcctgtgcgggtgacaaggaagtttctggggacacgctctctgcggccgcagaccaattgagtccatgtcctttcactgctcctcccatacacacactggcctctggcaccccgggggcctggccacctgggcagaaggaaggagggagcgggctggagtcactccccaaacctctctcggagggattccagctccaggtggtggtggtggggtcggtctctacccggctggtgtctgctttggctgttcctgccctgcgaacactgtccccggagcgggaccagactactggcctctgagcatcgggccaagtccagctactgaacctgctccgctcctctccccaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgccaagggggaaaggagagggcggaaaaggaccagcgggatccggccgcaagaattggaaagcctaggaagtggcggtggctggcgcgtttggggagcaggagtggggatagggaagcagagcttgagagaccttcctccggggcagcctccggacccaccgccccccaccagggtcgaggctgtagctccaaagctaaacaaaacttagcagcaacagcaaccaatatccagcccctcggcccctcggcccctcaccctccacctcacactcccttctcaccgggccccctctccccagccaaggcccaagcactggaaagggaaattgctgtctctctgaacaaaatgctgtgtatgcagagcaggtagagattaatctttgccagcttttccaaggcatgacaaggggctggtggatggcaacataccagtcatttggaggagagagtgagagatgatttactaccagggagaatccagccccttggcatgggacctggagcctcgactacacagcatcttctgggtctggcgtctgccagcacctgatctctttcctcattcccagctttgtgacacttctcaacttgcggctccatctctccctgcccccacttttttgttggccagggaggctgcagatgtcccaggagccctttgccgcttctatgaggccaagccttttttccctgggcccagcacacaccctgattagcaagtgatgtgtgcgaggagggtttgtgaatgttgaatgtgtaataatgatcaccatggagctggccactgaccccagagctgagctgttaacaaggcgcccagggaagagcttagggagtgggaacttcacctccctctctcggtatctggcggtaaattagaggcaattttcatcctttgcttgttcaccttcacttcaccaggaactttctggccctaccctttgcattgggtattttacaactttctctcattttcttcccaagctaccactggagcttgactttcagataccagtgggagccttctgtcccttttggggaccctgtctgtggcctccaccagggtttgtttagagccactcccaaatcctcactcccacactcatccttgcagccagtttttgaggaagaggagaacgtgtaaccccaatgcaagcttcaccctgactgagagggagtggttcttcctgtagggaatgaatttggtttgatttggggttttcctttgaagcccaaagaacttgctgttatgattcgttaaccatattgcaataaaagctggacataattctcactttacattttagtttttgtggcagcaggcagctcttaactgaattttaaagttgctatttcagccaccatgggttcgaatagggaaggaaccaaaagatggacccacagagtcttccaagccactgtttgtcactggtaggctccaagcagccattgcatggaggtggagaagacaggctccaagctgccctggggtgcatgtttccttaattttgggtatgttgggaacagttccttggtaaagtggcagcagagtgctgccaggggcccacccctgtggtttcttctccagttgttccaatcctttgagcaacagaaaggggacccaggttgtggtctctgagcaacctgcctccaccccagcccaaagggaaggtgagtggggcagtggcagtagagcctgagtactgcagagacctgagttttctggtcaaactgggtctgcacttgagggtggaggacagcagggaggaaggctccttggttgggatcatcttggtctgaattgtcctcatactggaagtcatcttgagggtgggattctgaggggttaggacaagaggaaaggagtgctcagcagctaccttccagcccacacctgcatcccccacaggagagccaaatgtggctggttgtggagttccacttaagcaggggagagatgggtgccttctgggagtccaggaggctctggattgcatagacacgaggagtcctctgccactgtctttgccagcacatagaga

SEQ ID NO: 12028 - DNA, 32043 bp, Human
agaaacaactccggacgcaccatcttttagagctgtaacactcactgtgaaggtctgcggcttcactcctgaagtcagcaagaccaggaacccaccagaaggaagaaactctggacacatctgaacatcagaggaacaaactccggacacaccatctttaaaaactgtaatgctcaccgcaagcgtccgcagcttcattcttgaagtcagcaagaccaagaacccattggaaggaaccaattccagacacactgccatgaggtagtgctttcatgagagcatcagctgtggtatataggggaggatcaggtggtgggtgggacactagaacttccaagagaatatgacctttgtcttcagctaccagggtgggtagggaaggaccatcaggtgggggcagggttaggcatgtctgagctcagagtcttcttgggtggggcttgttgtggctctgtggggaatgggggtgtgattcccaggttaatggagttaccttcccaggaggattatggctgcctcttctgtgtcatgcaggttgtcagggaagtgggggaaagctggcagttacagacctcacccagctctcacacaacccaacaagcaaatctcacttctactgtgttcccccaaaaagcaccgaatttgtttccaggcagtaggggagcaggattgagaacttgccccaggctactagcctcccagccgagaatgcaagccagacttttgtgcctccctacctgttaagtctgcacaccagattcacgccctttcctgagttctggacaggaaagtttgtgttcggttggaattgttactaagttcagctggaggtttccttctccctgtggtcttttcccagttcctccggcagcccctgtgagacaagtcagaaatggcttctctggggacccacagagacgacggggctttaccctttgcttcctctacccctgtatttcgctcagctctctaaattgtctgagctccaggtaaggtcaaatccttctcctgtgatctagaccttcaggttccccaagggtgtgtgttcaggggtggacaatacccctttcacacttttcacagtttgggcattcacagtatgtgggctattttctgggtcatgcaggagcaatgtactttcttcagagggtctgtggattatcttggctttcctgttatatccttgcagcagttcttggagcaaaagttcacaatgcgagtctccacatcctgctctgtccatccaagtgggagctgcaagttagtcctgcctcctatccaccattttttcctattttgtattttaaattaaaactcattagaatgtaaactccatgagggcaataattttaatccagttttttcactgctaaatacctcaaaactgttacatgtgctgccattatcatggacgttctaaacatttctcatgaatgaatgttgatatagcacagtgctgatctcaccacctgccacaaagtaaaaactctctaaatgtcaaacactactattataagtaatactattctatcattgagacaactatggttctgtatctctttaaggagtgcagtctaggcaacaacatatttcaacatcaggtatctgttatctcatgttcctaagttcatctttttacctgatcaatattagtaaagatctatggcctcaagtgaactttactctatgaatttacaattgggaacttaggttgaaaatttacctagtattatttattctgctgctataatttattatttattctgctgctattgttgccctaatcagttatcatgctcttactggactctgacatggtaagtaatgtcaattaatatagttgtgttattttaacattatttcaaaatattttaagtgaaatataagactcgttacaaaaggacttagacagaggttataaattattaactttttcctcaagagaagtattgtgtacttaatgacaagttcctagtgcttagaattgttaaaatctttgtgaagcacaccactgaagatgaggttgaaaaacctgacttttatcatcatattgataatctcaggagaactctatgcagaaggtaaaattaattcttaatattctttattctctaaaacatacaaatggagattctaatatttatacaactcaagttttaatatactcttctattttcattatcaattttataacatattttataaatataactttttataatatttagaccttttcctttgagcaaaattagtaaagtgttcttacagtagcataagtcagaaaagcaaaacaaaacaaaaacccttgtatctctagggggcataggagaccaggatctaaatacttcgaaaaggttttcaggttaacaatatgtccatttcgaagtcacatgttaactttaattctaaatttatgctagaatccattcctaatactgacaaaacttgtacaattttaattctgttcataaggtgagagtttaatgtgggaaatttgaaaaggaaatagccataaatattttttacttttgagactttgatttttatcacaatgaattattcatttgttggagacattaagtagtgattagtaggtgaaccatataattgcttgtacaaacagggacacttagagagtaaaagaggggctctattaataactgtttggacaacacatgtaaatcaggactttccaaacaaaccaatacctatggactccctattagaaagctttatagtcagattgcccaatgtgtaagattagtgtgcgagtggaagctaggcagtgtacatgggtatgttgttcaggaacattatcaatattatcaggccgtaggatgaagaatccagggaggacacttagcattagcaagagtgaacatacaaagaaggaagctacagcaatacagcttttctaaaataaacatttttgggaatttgttgaaattaaatacataagttttaactgtgttttagttgaatagttaactataaattttctaccaaaacatctataattaaaattataaaagtgaaagacacagaattaatcttattttatacttttaattctataataggatgatttttgcatgaatttcttttgattttatttttctgtctaaatagggaaataccagcagatataattgtctgttatctataccataaagacattgcaatattctagttaattttctaattattataaggttataatgctattttacacaacaaaaaaaaaagtaagctgcttgaagaccaagacaatgattttatttttgcatgcttctctcaactcccattgtgcacttcagggacaagaattgaattaattgtgtttctcatttcatggtatgcaagtattattggcctatgaaaggtctcactcttgctttacttacacattttatccccttattcctaatcttgaagtccatttcccctgggacctactacaatgttttaacatgttactctagctctctcaaccacaaatagctctggaatgaatattgtaatataaccaacttatctttctgtaagaatgtcatcagtctgtattcactcacagatagcattattgagtctattcttgtacttgatttctgtaatgagagattacttttgcagaatggcagttttgaagtatatcatctctgagagaggatgtaaattgttgctcctcatcattctcaccaacacctcatattgtccatttttgtactggttgctatatggttattcataaagtgatatcccatttttatttatttaccattctctgatcagtagtaagtgtgtccatcgcttcatgtactttttttaatatgttcagacatctgtgatttcctggtttatatgtgattagtatattcctcacatttctcattaattttttgtcaggaattcatattctccaaggcattccagctaccttaacaaataatgtgcctatcctggtggtggagggagatgtcccaggacagagagtctttaaagccacaacctaggattgttgtgcagagaatactttgctgcccctccctgacaagcaactgtgcccctcagggaaatttcttgtgtattcaccattgcactgctattttggaagactctttttattgtaaattcctttggtgcttgggtgtgaaaaaatggtgagaataattctcaaggaatggggactatccagcccatgtttttctgtctgctccatcagatagtggaagttttgttgctcatcattccacatccatttccttcaaacctaggctagcactactagtattttatgtctcatagtagcattaaggtatacagtgatcaaccaaggcattgaagccgtagtaatcacactggatccaggccttcttccatccatgactgcccatgtttcttcccaccacagctcctaggattgttcgagcatttctttcttttaagtgtttttatgactttaagatcttcaacataaagatatatttttaaaatatatgttttatttggagtataacatatccagaaaaatgcaaaaatcacaggatacacttatatagtttttacaaaattttacaccatccagatcaagatatagaacagtgatagtaccccagaaatatgatccttctaaggcactaaaccccaaaggtaaccattctgacttctattatcatggattagtttgttttcttttaaaaagttatgcaaatgtatacattaattcatatgtgattggcttctttcactcaatattatgtttatgagattcaccatttgttcatttctgttgttggataatattccattgtatgcatagtctaaaatgtgtttatcttttctattatttatgggcatttagattgttcccagtttgggactatatgaatactgccactataagcatttttttccatgtcttttggtatacaaatatgtgctttttttattgggtaatatggtttgtacatgttttaccccaatatatattgcaaaggtgttctctcatagagtttggactgatttatactttcagttgtagaaatatgcgagttccagtttcttcacttcttcacaatcattgagatagcttgtctttttcatttcagcagttctattggatatgcagtagtatctcatggtggtttaaattttcatttccctgatgactagtaatgctaagtaccaggtctctaaccatttaaatatcctattttgccaagttcttgccaagtattgctttgttttacttggttgtctgttttttcttttaatgctatttatttcaaaattttttatgagttagcatatgttaaggagaaactttatctattcctgaactgtactgtccaatacagtggccatcagccacatatagctattggagacagtacttaaaatgtcactagttcaagatcagatattctgtaagtataaatatgtagtggattttaaagagttagaaaaaaaaagaatgtaaaatattttcaatatattgggttaaataaaaacctattattaaaactaacttcaattgttccttagtatttttatgaatgtgactattagaaatttttaaattacataagtgacttacaatacatatctattaggaagtgcaggcagggtggagtggttcaagtcttgtaatcctagtgctttgggaggccaaagcagaaggatcctttgagtccaggagtttgagaccagcgtgagcaacagagtgagacccctcatctctacaaaaaataaaacaaaaattagccagatgtggtggcatgtgcctgcagtcctagctacaggagaggaggcttgcttaagcccaggagctcctggtggcagtgagctatatttcagcactgcactgaagcttggataactgaggaagactctgtgtctaggaagaaaaaaaaaagtactgttctacgaagttatgcaaagcttccctgaaaaagtggtctgctaaattttatcatgactgttggatgtttaaagtcatttgcagatcaattatgataaaaggactgcttgagttgtcacaaaagtaccttaaaaatttaagtaagaaaaataagtactagttgaagtgtctctaaaaacttttagtttgtattgtcacctgattacaaatttatgtttttagatttgtttttccattttcagcttgacatttactcatttcagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcagtaagtcagctggatatgtcactcaatgtttcaatactcaaagaaatttgtatataaaaataggggtccaataaaaatggaaagcggttaaaccttttagtagataagaacaaaatcactagcaatctgtctttctacaaaatgaaggcataatttgaaatccagtaaataatgcttttacattaaaatgttattttctgtatctgtttttaataatactctgttgaagggaatagggtaataactgaaattatcatattgcaaggcaaagagaggtaatttactttaagtaacaagaaacttattttgataattaagcataggatgccagaaaaatgcttgaaactctggcctctggaagggcaagattgctactctaatgctttatcatttgtaagactcatctctcttcatgtgccaacttctctcatgatacccattgaaaaatgtgtttttcaattttgaattgaaagtttgagttcaaagttgtgagaaggtaatctaattgactcatttcattattttatatcaggctacactatcatcaaactatcaatgatcttccactagggcaggtgacccagagtaaggggctttggttgagccagtttcgtttaaaagaggatgttgaatatggctattgtggttgatatatctagtaaacctatctagaagtagatgtggtaggggtagaaattactataagaactaaaattagtaaatacaaagagagtcagtgttaaattgaatccattttcaaaaaaattatgcagatatttccaaaatgaaatcgccaataataacattatacttttggcttaattttacaatttagtaaaagacaagcttagtttcatcattaagttaaataattttttttcccatagaaaaatgcactaagcctgacctgagtaatggttacatctctgatgtaaagttattgtataaaattcaagagaacatgcattatggttgcgcttcagggtacaaaaccactggagggaaggatgaagaagtggttcaatgtctctctgatggatggtcttctcaaccaacctgtaggaaagaacatggtataagaatcatttcctaaaactgaagataagtgcttatcaagcttatattgaatatattgaagcttatattgatatctattatttaatagaatttatttttcattatgtctacaatgcaggaagttgatattacattgcttttctcaagtactaggtgattccttaatccaaatgttctcaatccctacaacccacctacgccaatagttcctactttgcatcaataaaaggaattggaatggaataaaatgaaagaagctttttctttatatgtcactatttcctttattacagaagaatttaagatcatgtacattattttatattgtgaaccaatgtcagatatacttaaaaatagttcaataatttaaatatatgtatactttgttagtaagttgtttaaattgtaaaaatgcatagacagcacatactttcacaattgctactgcacaagcctttagttgaattttggcctttggtcaagcacttgtagactagaattttaaaaacagaaaactggtagagttaggtcacaaggtgtatgaagaagagaatagaggcaaagaaaaattggggctatttttcaattttgccaagagttgattttaccatgtattcttaagatttgtaaaaccatattttgagattttttataatctaggttattaaaaagtttataaaataaataatttttataattttagaaacgtgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccagtaggttctcatttggaataaaatctactctcactctgaaagctttttctcatagagaagtgtatataagttgtcatgctcattatgtttcaccttttcatgcatttttgcctttatttttaattatgttgatagcagtctttgataattaaagctctcaagtagaataaattcattttagctcacagaattaaattagaataagcctaatgatatttaacaaatatataaaatgaattcataagctttttggcaaatttaatttctattctagttatgtcatgtaaatagtgcattttgttgtagcagaaaaaataaacatttgtttgtaattttattcattcttttatttgcagaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggtaaatttttaaatttaatactcgcaaaatgccatgtctttatcagctttaatctctattagctctgacaaaattcctgtggtcatatctattttttttcctgagtcctatttttaaaataaatattatcttttaaatcagtgctatttttagcaatctttaatatatcccacctgaataaatcttgttttgtcttagtttgtaaatgactatatcttttaaatttattattttaaaatatctattatacattttaaatcccttattataacgaataacttttcttattgggaattattaggactaattaccccaatctggcagctttgcaaggatattttctcttaatttgccacatatttccagatgtaaaaattaatctccaaaatagtgaggtagaaagcagagaaagcaggaaaagcagaagaataatgcccagaagtgaaaatgggaaaagaggtcatcttgtaaaagctgcccaaaaatgtaatatctatggtcacatttctattactggaagtgtccaaacaggtaatgcaattacctgtcagaagacatccatagttatttaaacaaacctacaatttaatatgaggagggtcctatactagcagaagatatgaaaacagtaattgcagatatgaaaaaaataattgctataatgtgacaaatggtacaatcaactcaggtacaaagtgcaggaataaacattagagattctgattggtatgctgtggaatagcattcacagaagtgatggacaatatttaagttgggtcttaagagataagtagcagtttgagaattgggaggatagggtgaggcaaagggtttgatagtcattttttattttctgtaatatgggatataaggtctattgacaggcaggtgaaagacatgaaggtagaacttggaggaaagtggtgaagatttgaaacaggtgctaggggaaacaaatgagggctctgaccatgggtatgcagtgggattgccagaactatcataattccctaaatgcactgtacagtaactttaaagattttatgatttttcatttgtgctcgacatccttggtatagtagtagagaagtagattttttaagcaaatttttttaaagtctattattccttatttattttttatttttttgagatggagtcctgctgtgtcgcctaagctagagtgcagtggcacgatctcagctcactgcaacctccacctcccaggttcaagtgattctcctgcctcagcctcctgagtagctgggactacaggtgtcggccaccatgcccagctaatttttttgtgtttttagtagagacagggttttgccacgttggtcaggctggtcttgaactcctgacctcaggtgatcagcctgcctcagcctctcaaagtgctacttcaaaaataaatggcagacctacttaaggccttttatacccttctcctcttccaaattagccagcatgacaacatgcctgttttttccggtaaacagtcattaggcatacaatggctaatataattcagcccacaacaatataattcagttgtgggctgaattatatctctcttactcctcccaaaatatagccacattctaatactgagaaccattaaacgttaccttacacggtacaagacactttgaggttaacaatcttaaggtaggaatattatctggaactatctatccagactctaaatataatcacaaatgcttttataaaagggaggcagagggagattgactgcagaagaggaagcaggagatgtgacaatggaagccacaggttgaaatgttttgaggaaggggttgtgagccaaggaatacaggtgatttcaagaagctagaaaaggcaaagtagctgattctcctccaaagcctccagcaggaatgtggctctcctgatatctcgattttagtccagtgaaactgactctggacttctggcctctaggactgtaggaggataaatctgtgctgttttaagccactaaattgtaattcatcaaagcagcaataggaaagtagtgtggtcagtattttagagcaggagactttaatttagacagacgtgggttcaagaacagatctgctacatgctattaatttatttacttcataagttttagtttgtctataacatgggagaaataatagttcctacttaataaagttattttaggactaaaagaggtaatgaatgtaaaatgcctgctgtgttagtattctattggtgcgtaacaatgtcaccacaaactcagcagcttaaaacaacacaaagaaattatttcccattgggtgtaggttgggggtctgggtgcggcttaaccgactccttgcatcgatggctatcaaagctgcaatcaagatgttagctggactgcagtctcatctgaggcttgactgggcaagacttcttccaaactcactgtagttattggcagcattcagtgctttgcagactgctgaactgagagcctctgtttcttgtggctgttaactgaaggcagccctctgccccttgccttgcagccgttctgctttggaagctcatgatgtagcctcttgtttcttcaaaaccagcaaggatagagagtctcttggcaagaatggcgttaaaaactgatgttacataattatgtgtgcataatcacgtactaatccatcacctttgctgtattttgtgggctagaagcaagtcacaggtcctactcatggaaaggggtatcacacaaggaagttaacatcaggaggtgaggatcaaaggaatgctcctagaatcagtctgccattctctctatgatgcttgacatgatgaatattttaatttaatctttattattttttgtaattatatgactaaaggtgctgattaattttttccataaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatggacagaacctccaaaatgcattggttagtaacaccttgaagaagctttgctaaaatgaaatctgcatgtgtagctaaatggtcagttctctttcaactgtaccttttcagaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttggtatgtatgctacatttaccatcagtagctaaacttatggtgtaaaattttccattctgttactttaatctgaatattcctaggaaaagaccactgcttaggcaaattagaaacacattgctacagcacctactcttctgctttgcatgtgtgcatgtgtgtgtgcctgtatgtgtagctatctgtagaatttaagtcaatgtaaagaattcttaaacaaaagttttttttgaacgctagtgctaagcacggttatctgatctgtgtcatgccattacctgtaagttctaaatgacaacacataaatgacgatgtgcttcattagataagtaaataagggcatggtggattgagtgacgggccatgagcattatctacttcttctccccatatgtcctgcaaagttagggtagtgcattctgttcttgaccttgggtaagtcctgctgatattttgcatctggccattctgaaccttatgcccttctgagacatgtccctggtctttcattttactgaaaggcaccaccaggctacactatcattcctggagactactcttcctgtcatctatctcatttcttaatcagatcagagcaacatctccacacacatgtttatctaggatatttattaaataagacaaaagcaatgaaggatgctaaagaaatagataaagtgagagaaagataccaaaaagaggaaaaaaattgatatttccttcatgggtctattgagacctgagatgaagaggaatgaaaaagaagaaaataaaagtggggtaatgccaaagagcaattttagaattgaccataatctttaggttgaagaacagtttctcattctataggtttaagaaatgtgtatatcataattccttcacaattgagaaaagagaaaaatacgtatagttgtttttaggtaacatatttgctgtcaactcttgcttagcaaattttaaaaatatttgagctgaaaaaatttttcatatttgtaatgaatttataaaacaattgtcctaaattatataatacaaatatcgagacactatagtatgagttactatagtatattgttatgagctcatattaattttaaaacaacctcttttcttagaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttgggtaagaaagagaacacatggaatgtctacgtttgtacttttatgtgattttcttacagtgttttatatcatgaaaatgatgattttgtacaaatcttttttcacaagtgttttctctctcatttctttaagtagaaagtccctaaaatattagtgtattttttctattgtggtaaaatatacataacataaaatttaccactgtagctatttttaagtgtacaattcagtggcattaagtatattaacatttttgtgaccaattagcttttgggttgtctttctcctagctgaaattccctccctggtatacagccctcaatatctctgcttgtattgccctcagaatgtcatttcaagaagaataattagtcctattctttccttggtagagtatattgctaatatattatagagtatattatatagagtatattgctaaattttaccaccgcatcctcatctgaatggacacgtttgttacatcttgttgattatataaaagtgtttgctaatgacttagataataaatggtcttctaaatgttttacacacacaagcacacactccacaaaatgctatgatatgatgcagaggtatatatcttagattttttcactcaaaatatattgtaaacatggtttgtcatacttctacaatatatactttaatggctgcatagtattccataatgcagatatacatatgtaatttaaccagtttattgatggatgtttagtgttcaacatttttatattccaaacagtacactttcaagtaaatctttgtacatgttaaacatatttatttttgttaaaaataattatcatgagatcaggaattttaattctttttctattaattggcaaattgtctatcagaaagtttgttctgctttgttaaccctaccataagtgaattaaagtagtaatcatcctaatctttgttaactttgaatattttaatcttgacattttttgttaagcaggcaagcacaattattttaatttgatttatttaagaattaattaatttggaattttttaactttctagtagccacaggtttttttacatgaattaattattcatagtttagccattttttcatacttataaatctatatataaattattttatccaattgagaatcatgtttattgcaattatttttaatttatttttatttatagtgtttttaagtatatataagtgtatgttttaagtcttgagctctttcaaccttttgttagtagtttccacctttcaagtaattcttaggagtcgattcccattcaaattcagatacagatacatattcacatagaattttgctattggtctcatatttttataaatgtttttgatattaagtttttgatgctttggttgatattgcattgagtggagatatagtaatctctaaggacaaagactagattaaaatatttatggcaaagctggtaatgaaacaagctcataaggaaataacaacatttaaggaaatacatcattctatatctggaacaactgcctcaagagagttaggtttggtcctaatgaatcaaagcaaataccaaatgaagattaatcattgttatcagggcaagagaaaggggctttgtatatcttggtaactattgaaactggaaaggctatcagtacaaattcacaacagtatgataaagcgtagaattttctctgtaggaattattattccagacattaagagtctctctaacctctccatactctcttccctgctctaatcactccagtctttctggtctccttacttttccacaaacaagccaagaatgctctcacttcagggcctttgcactggttgttccctttgcttgggacactctttcataagaaaatgacatggttcactcagtctccttcaagcttttgtgcaaagtccccttcaagcttttttacttcttatttaggcctaccctaatcaccttactgaaaagtgcaacttctcttcacctagctcttttgttaccccctcctgctccagtactctttttttcatctaatttatcttatgctgtagtttaaagatggctactgtgttagtctgttctcatgctgctaataaagacatacctgagactgggtaatttataaaggaaagagatttaatgcactcacagttccacatggctggggaggcctcacaatcatggtagaagacaaaggagaagcatggaacgtcttacaaggtggcaagcaagagagcatgtgcagggaaactcccctttataaaaccatcagatctcatgagacttattcactgtaatgagaacagcatgggaaagacccaccccaggattcaattacctccaaccaggttcctcccatgacatatgggaattatgggagctacaattcaagatgagatttgggtaggcacacagccaaaccatatcagccacaaattatacaattcatgtctttattatatttattatgtattgtaggtgtttctcccagttagaaggtaagctccatgggagcaggagtcttggttttattcattagcaggttttctattattttctacatggtagttaaaggtttttattttatagaaagaaaattattattaatctaactgattgatgcccttaaatagtatttttgatgttttaaattaagtggttttagtttatgacaataatgtatagattcatttgatagtaataaagtatatattttcttatatatatatgtgtgtgagagaagccttaattatgatttcaattataaaatattgcttttgaaacttgtcataatttttgttttaaaaaatatcacttttatatttgtcagacaagtaaagaatttaaaagagcattttgttttacagaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaaggtaaaataataatgttctctgcaagtatctttacttgaccaatatctgctacctcggttgaaaatttatttatagtttgttgctatttttcttattattattctttttaattttgttttattttattttattttactttgagttctgagacacaagtgcagaatgtgcaggtttgttacatgggtatacgtgtgccatggtggtttgcaattccagtaatggaattgctgcgtcgaatttcatttctggttctaggtccttgaggaatcaccacactgtcttccacaatggttgaactaatttacattcccatcagcagtgtaaaagcattcctatttctccccagccttaccagcatctattgtttcttggctttttagtaattgccattctgactggtgtgaaatggtgtctcattgtgattacaccttatacaaaaattaactcaagatggattaaagatttaaatgtaaaaaccccaaaccataaaaactctagaagaaaacctaggcaataccattcaggacataggcatgggcaaatacttaatgacgaaaatgccaaaagcaattgcgatgagagccaaaactgacaaatgagatctaattaacctaaagagcttctgcacagcaaaagaaactatcatcagagtgaacaggaaacttacagaatgggagaaaatttttgcaatctgcccatgtgacaaaggtctaatatccagaatctacatggaacttaacacaaatttacaagaaaaaaacgaacaacaccatcaaaaagtaggcaaaggatataaacagtcacttctcaaaagaagacatttatgtggccaacaaacatatgaggaaaaagctcaacatcgctgatctttagagaaaatttatacctatgaccccaattcaccaccatcatattctaatctataaagttgagaggagtgatccaacttccaaacttcaatcagcatatatacctatataggatggccatgctgacatcttttaattccaataagtcaattttatgaagggaaaaaatcaagaggttttataaatgttgccagactatcagagaattgatcaccttcttgtgagcactcaacaacaaacactgtaaagcattgctctacttagggctttctggggacccattgtctcagtactcactggctatagggactattacttttaataaggaagaaaaggaaaataatatatacagaaatcatggcttctagaaaaatcccatatacacttagggagaaataaaatcatgattgttaatactctcatagttttaaatatgcatgtaaacactataacgtgggattctaattataaaaatacattgtatggtataatattattgcaaaaacatcttcaatattttaaaaatatttgagaactgcctaaaaaatggctttatggctaggtgcagtggctcacgcctgtaatcccagcactttgggaggccaaggtgggcagatttcttgagcccaggaattcaagaccaacctgagcaacatagtgagaccctgtctctacaaaagaaaaatgcacctgtagtcccaactagttgggaggctaagacaggaggatcacttgagcctgggaggcagaggttgcagtgagtcatgatcatgccaccatactccagcctgggtgacagagggagactctgtctctgtagcacttataaagtactggatgttcattatagcaattcattgtatactttaaaacttatttttgcagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttaggtatgtactactaaatatgcctctaacaaagtaaaactatatatttttaatttgctgtcatttttgagttaacataacactaatataatgctatatttgctacatttgtgttattttattcatgtgcttattttatcactgctttctattctttcctctagatcataaatacctatagttcagtttgttgtaatacatatttttttaaagacaaaccacacatcaggttggtatgggctataagttgaataagccatagtggtgtgagtaaactttaacaattatcattcattgtgattggtactataatagaaaacattagggaaacatgtataatagaaaacaatgcggaaataaagaaatggacaactcaatatggaaagatgaagcaagttaatgttttattagcaaggcatcctagtaagagtaacaacatttactaaggccctcagaggcatgaaatagcacatctgtaaataataagaaaatattttttatttccaattctgacttttatttacttctcttatcttctttcactggctaggacttcagtacaatgttgaatggaagaggtagtggatatctttatttgcttcccattctcataagtaaaacctttgataattcacctctatgtgttgttataaatatttttttaaaaatcaagttaaaggtataaaaacctttctttctattttgccgaaagtatttttaaagaatcttcaatctgtgtttaatttttagcaatatctgttgaaataattacatgattattacttttgttttttcccctgcaaatttaatgaattatattgcttcttttgaatgttaaagcatgattctattcccataagaaattccacaaggttgtgataaattatgcatattatatgttatatttttatttatcaatattttactcatctattttcatgagaaagactggttggttattttcctttctggtttgatatcaagtctgtgctgacctcatcccatgaatgggaagtgttccgtcttttctggttctctggattgatgctatttcttcctttataattttaagagttaaccagagaagccatctgggacttgagtttttccgtgaaaagacaaattgacagcttcgatttgtttaacaaataatggtaattatttcttcttctgtcagttttggtagggagtggtttcttgatggttcattacaactacattgtcaaatctactaacataaagtagttatgacatcttcctatcctctttttgatgtttttattgatgtatcttttgttattacttctattaatatgtatctgtcttgacatgccttgctaagggtctatacattttattagtgttttcaaaaaaccaacatttgcatttgttgattcatcaaattttgctttctattttattaattatgctgttatctttattatttcctttcttctatgttcttggatttcttttgttactctttttctggcttgtttagatgaatacatagattactaattttcagcatttatattttttctaatacatgaatttaaaaatagaaatttctctctgagcacaactttaacttcatccaaaccatttttatatcttggatttttactgtcattcagctcaaaaattttatagtattcattttgatatattctctgtgctctgaatcatttagaagtttctttttaaagttctgaatatttaggggattttctagttttcttttggttactgatttctagtttaattcaattaagacatactttgaattatatctgcactttaaaatttgttgatatttgctttataacaagcatgtatttgctttaggtaaatgttcttttcattgaaaagttaactttgtcattgttgggttcactgttttatatatgtgaattggattgagttttgtttttgatgtttaagttaatccaaagctgtactgatttgtgtgtgtttgttttctatcaatcactgagagaagcatgttaaagtctcacttggcattttaaaacattactaattttagttctgtccatttttgcttttgtattttgatactatttcattaggtacacacacaaattgagacactaaatcttcgtatcttggtgtattggcattgtctaattttaaaagacctccttcatatatagtaatgctttgcctttttttttgccttgaggtctcctttagctgcaccaaggggcttttgacaagcattcatgtagtacacatttttccatcccttaactttcaaccttctgggtttttacttttagtgtgcctctcttataagcaatatataccttattttaaaatatacttatgcaatttataattttttcccttgtaatggaatagtctatttacatattcatgtaattactaatatatttctgtttatacctaccaaccctaccaactttctatactaggtgtatgttactatactccatgtatatcccattggtcatctccctctttctctctctctctccatataggtgtgtgtgtatatatatatacacatatatatatataatattttaagttctagggtacatatgcacaatgtgcaggtttgttacataggtatacatgtgccatgttggtttgctgcacccatcaactcttcatttacattaggtatttctcctaaagctatccctcccccagacccccacagacaggccctggtgtttgatattccctgccctgtgtccatgtgttctcattcttcaacactcacctatgagtgagaacatgcagtgtttggttttctgtccttgtaatagtttgcttacaatgatggcttccagcttcatccatgtccctgcaaagggtatgaactcatcctttttaatggctgcatagtattccatggtgtgtatgtgccacattttcttaatccagtctatcattgatagacatttgggttggttccaagttttgctattgtgaatagttctgcaaaaaacatatctgtgcatttgtctttatagcagaatgacttataatcctttgggtatatacccagtaatgagatcactaggtcaaatggtatttctagttctagatccttgaggagtcgccacactgtcttccacaatgattgaactagttcatactcccaccaacagtgtaaaagcgctcctatttctccacatcctttccagcatctgctgtttcctgacattttaatgatcgccattgtaactggagtgagatggtctctcattgtggttctgatgaccagtgatgatgagcattttttcatatgtctgttggctgcataaatgtcttcttttgagaagtgtctgttcgtatcctttgcccactttttgatggggttgtttttttctcgtaaactttttaagctctttgtagattctggatggtagctctttgtcagatggatagattgcaaaaattttctcccattctgtaggttgcctgttcactctgatgatcgtttcttttgctgtgcagaagctctttagttcaattaaattccatttgtctattttggcttttgttgccattacttttggtgttttagtcatgaagtacttgccaatgcctatgtcctgaatgatattgcctaggttttcttctagggtttgtatggtgttaggtcttacatttaaatttttaatgcatcttgagttaatttttgtataaggtataaggaagtgatccagtttcagctttctacatatggctagccagttttcccaacaccatttatgaaataggaaatcatttcccatttcttgtttttgtcaggtttgtcaaacatcagatggttgtatgtgtgtgcattatttctgaggcctctgttctgttccattggtctatatatctgttttggtaccagtatcatgctgttttggttactgtagccttgtattatagtttgaagtcaggtagcctgatgcctccagctttgttctttttgcttaggattgtcttggcaatgcgggctcttttttggttccatatgaactttaaagtagttttgtccaattctgtgaagaaagtcaatggtagtttgatggggatggcattgaatctataaattaccttaggcagcatggccattttcacgatattgattcttcctatccatgagcatggaatgttcttccatttgtttgtgtcatcttttatttcgttgggcagtggttagtagttcttgaagaggtccttcacatcccttgtaagttggattcctaggtattttattctctttgaagtaattgtgaatgggggttcactcataatttggctctctgtttgtctattattgatgtataggaatgcttgtgatttttgccattgattttgtatcctgagactttcctgaaattgtttatcagcttaaggagattttgggctgagacgatggggttttctaaatatataatcatgttatctgcaaacagggacaatttgaattcctcttttcctaatttaataccatttatttctttctcttgacagattgccctggccagaacttccaacactatgttgaataggagtggtgagagagggcatccctgtcttgtgccagttttcaaagcaaatgcttccactttttgcccattcagtaagatattggtggtgggtttgtcatgaacagctcatattattttgaggtacattccctcaataccttgtttattgagagtttttagcatgaagggctgttgaattttgtcgaaggctttttctgaatctattgagataatcatgtggtttttgtcattggtcctgtttatgtcatggattatgtttattgatttgtgtatgttgaaccagcattgcatcccagggatgaagccatcttgatcgtggtggataagctttttgatgtgctgctggatttggtttgccagtattttattgaggattttcacatcgatgttcatcaggaatattggtctaaattctgttttttgttgttgttgtgtctctgccaggctttgatatcaggatgatgctgacttcattaaatgaattagggaggattccctctttttctattgattggaatagtttcagaaggaatggtaccagctcctctttgtacctttggtagaattcggctgtgaatccatctggtcctgggctttttttgatttgtaggctattaattattgcctcaatttcagaccctgttattggtctattcagacattcaacttctttctggtttagtcttggaagggtgtatgtgtccaggaatttgtccatttcttctagattttctagtttatttgcatagagtgtttatagtattctctgatggtagtttgtatttctgtgggattggtggtgatattccctttattatattttattgcatctatttgattcttctctcttttcttctttattagtcttgctctcagtctatgtagtttgtttatcttttttaaaaaaacagttcctggattcattgatttttttgaagggattttttgtgtctctatttccttcagttctgctctgatcttagttatttcttgccttctgctagcgtttgaatgtgtttgctcttgcttctctagttctttcattgtgatgttagggtgtcgattttagatctttcctgcattctcttgtgggcatttagtgctataaatttcccactacacactgctttaaatgtgtcccagagattctggtacgtagtgtctttgtccttactgggttcaaagaacatctttatttctgccttcatttcgttatttatctagtagtcattcaggagtaggctgttcagtttccatgtagttgtgcagttttgagtgagtttcttaatcctgagttctaatttgattgcactgtggtctgagagacagtttgttgtgatttctgttctttttcatttgccaaagagtgttttacttgcagttatgtggtcaattttggaataagtgcagtgtggtgctgagaagaatgtatattcttttgatttggagtggagagttatgcagatgtccattaggtctgcttggtccagagctgagttcaagtcctggatattcttatttaccttctgtctcgttgatctgtctagtattgacagtggggtgttaaagtctcccattattattgtgtgggagtctaaatctctttgcaggtctctaaggacttgctttattaacctgggtgctcctgaattgggtgcatatatatttagaatagttagttcttcttgttgaattgatccctttaccattatgtaatggccttctttgtctcttttgatctttgttggtttaaagtctgttttatcagagactaggattgtaacccctgctcagcaatggtagacgaccctccccccataacgctgtcgtgtcacaggttgatctcagactgctgagctagcagtgagcaaggctccatgggcgtggaaactgctgagccaggcaagggagggtatctcctggtctgtcggtggctaagaccttgggaaaagcacagtatttggtcaggagtgtaccatttctcactgtgctgcccaggctggagttccttagaaacaaatcagaaacaaatctctccctctctctctttctctctctctctctatatatatataaatatatatatatatgagttagttccaagatggccgaataggaacagctccggtctgcagctcccagggagatcagtgcaacacaatgagactctctttgtacattttgttcttcaagttagtagcattccttgaaccttgatgtacttgatatccttcatgggttttagaaatgtttggctaatatcttttaaaatgtacatttctcacctcttctgtgatgccatattacatatattacatctttttgctatgccattgtctctttaaatctatattttctctcattttcttcttgtttcactgtagtaattttttggtaattttctcattgtatcatttctttgtttctatttggtaattttcttctagtttaacaatcctctctttagatgtatccaatctgctttaaactcatcttttgagttctcaatttcagttatcatctttgcatttctattttatattttctttttgtagatttgagttatctgatgaaagatcctagcttaacatcaacttcttgaacatataattcatactttttattaaggcttgtctgcaaactccaatatctggatctattttttagccccaaattcttgatatttttgttaacagttgattgaattccaaatattatacgtggaaaatttcaggatgtttggatgatgtcagcttactccaaagaagactcatctcatcctctggctgatgattagtgtagaggcagttggttttaatacaattagaaataaagctttctctatgtttgttttcagacctctgtttgccttttctcacagactgtaactctccagggctctttacagagggtttgttgtgtgtattaaagctttttctccttgactgtctctgatattactgggagactgccaaatgcccactgtaactttttatttactttctgcttggcttctcatcctatgcctctatacaagtcaaggataagcagtaccttagggaaaagctggtgcagagcctcaaactcatatctctacacttcctatccttctaaattctttattcttcaagtcctggctgctttggtttaccgaaattctcatttttctatcttcaactccatgagattttcagaagttctgctggctgtatgcctaagcttaccattctctatcatctaacctctcaggtcagacttagagtcaacaaacacctcaagagaaaaaaatggcacatagaatttttttttttttttagacagtctccttttgttgcccaggctggagtgcagtggtgcgatccctgctcactgcaacctccaccttctaggttcaagagattcttctgcctcagctttcccgagtagctgggattacaggtgcatgccaccatgcccggctattttttttttttttttgtagagatggggtttcaccatgttggccaggctggtctcaaactcctgacctcagatgatccgcccgccttggcctcccaaagtgctgggattacaggtgtgagtcaccacgcccagcctcacatagatgttgaactcacctgaatacattttttccagaaccttacttccttgactaagttccttggaggttttctgatacctcgaaatgcttcctgtttttcagattttctggttcttaatagaagtgctggtttgatataatctcctctgtcatagctgaaagttaaaggtccatgaatcaacttttaaatttattttaatttaaatctcatgttctgtagaacagtgacatcgtaaattatagtgctattcgacttcattttcacaactattttgtaatgagtgtaataattcttgttcattttcatcacctgtagcacttccagcataatgtttgacacataggcatttaataagtagttgttgaagaaagtaactgaacacagtgctctcagctgcggtttcactttctgtggtttcagttacctgctataaactgcagtctgaaaacgttaaattgaaaatttcagaaataaacaacttataaattttaaattatgcacttagtagtataataaaatttcatgccattccatccttcctgccccagatatgctaaaaagaagctgtaaagtgcttcctttaagtgaaagggcggaaattcttaacttaaaaagaaaggaaaaataaatgtatgctgaggttgctaagatccatggtaacaatgagtcttctgtctatgaaagtgtgaagaaggaaaaagaaatccatgctagtttcgttgttgcacctcaaactgcaaaagttacaagccacagtgtataataaatgtttagttgaggtggaagaggcattaaatttgtgggcagaagacatgaacagaaacatgttccaaaagaatgacaacagggtttagcattatctgcggtttcaggcatgcactggggctcttgaaatgtatcccctgtaggcaatcagggagggcatactgtaagtaagtttgttaatgtactacaggtatatgattgatatgccatattagcaactctggacctttttacctgtctcagaagttattccttaatgctaggtcatccaggagacaaataaggacataagaaatcccattttctgaaataatttgatatttgatattttagaaatattaatgtttttattctgtaaaaaaaatcgaagaggtttttttgtgtattttaatacatactttaccattctctttggtttacgatacatgggaaaggacacaactatactttgtatgcttagaatttaaaacgtcttaatccagtcttgatatttcttaactagaaatttgaaagagaagtaactgtcaaccattttggatggcatgaggttataaagcttgggtcagtgttgagaatctacatttccataaaatgttatttatacagcaattaataatttgtctcatgagaattttatttgaactttctgaagaaggaaaagggaaaagagcatgatatcaatgaccattagtaactgtcaatgcttccccccaaatacctttttgtttgtttgctatctttgaaaaagctaatgacataaaactaaaataccttttagtttttaaaactggaagaaaataccttttctccaaatccaggaccacagagagaaatggctcactgttttctgtgagatttgaacatattttctgactcaaatattaattctgattaactgacttgctgctcttaggcctgagaattttaaggtcctcatgagtaggcaacacaacgattcctgttcttaccaagatgtaacaagatagttttcttctttttctttctttttttttaaattgttgttcccagagccatgcacattatcttttactgaaatggaaaagaataatttacttctgaaatgggattttgacaacagaccacacattttgcatggtgaatatattgagtttatttgtagaggagatacttatccagctgaattatatattactggatctatacttagaatgcaatgtgacagagggcagttaaaatatccaagatgtattccaagacaaaggtaagaagttttttttttttggtcagattattttttttggtcagattgttattcaacatttcagaaatgttatgttctataccactcatactttatggcaattgcaaagaaaaaataataatattttcttcattttttttacaccaaacaaacaactggaagtggtaatcaattcaacaggccttctgaattgtctgaagtgaaagcaacgtttgccatttgatatttgtgacactttggcaaatggaaaaataaaccaatttatacgtgcaatatttcaatgtgcaaaaattaacctatatgttctgtgataaggacaaaaatcacactttctcctacttctcaatataagttcaagcactactaataaaggttggaaaatgtggtatttattttcaggaccacatttttgtgtaacttttggaaattacatactaaagtgtttcctcatatgacagtttaaaaaatatatcctctgctacttacaggaaataatttaacaattttcttagagaaatgttaaaaaagtataataaaatgatgtaaaccattttgtaggatcacaattttaaccctttttgaagacactatatataaaaaatggaaattatattttttgttcaactaagaatattaaaaatataagtagtggcaaagtgcatgtggtcctgttttaaaaaatgcaaacaatgaactgtatgaactacataaagtcagttttttagatgctttgaccactctagtaaaaaaatatttaaaagacacacaatagtgggaaaaatttttatttttatttctaattgtggtagcatcagggtggaaaaaattttatatgctatttaaatgttttggtacagtatgaatttctcacttttaagagaaaaaggtaaacacgtagaaaatatttaaaaaatcatgagtagtgtagtaaataatattgcatttttaaaagggaactggtggtattatttactaagtaagatcatttattcttattagtacttaataaaaacaatgactcattatatgaaaaattgaaaggctgagattgtaattaacacctgactgcaattgatgcttatttcaaaaatctctctttttcccctcaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcgttatttataaatgaaaaccaataaatgtctaatttttagtttgtatgatttgatgtagaacttaatctcttttgtatgtcttccatctgttacaaattaatctacacatcatattttcatttcctaatgcccattgactagactatatagttgttttcaatatactgtatgtgcaaaaatttcacattcacattcgtcatcatctttattaatattaaggcttttgttacccttaattcaaagtttatgtcactattaaagggccaaacacactagagataagaaactatatgctgtattagaggatctgccttattaaaggcagaagagactgcccttcagactttctaaatgtaaaaaacttttaaaattaactgtaatatttgctacaacgttaataaccaaattgtttatgaggtggtgtactaccatatttgaacatgtgctcaaatattgttaaagagacacaattaaagaaagaatgacccttggaattttatttaattttatttatttatttatttatttatttatttatttagagacagagtcttgctctgtcgcccagcctagagtgcaatggcatgatcttggctcactgcaatttttgcctcccgggttcaagcaattctccttcctcagccttccaagtagctgggattacaggcgtgtaccaccacgcccgctacggtttttttttttttttgtatttttagtagagacaaggtttcaccatgttgaccaggctggcctcgaactcctgacctcatgtgatccacccgccttggcctcccaggactcttggcatttttacattttacactttcaagtctttttttatatcaaataatttttggaattatgcagactacaaaatctgaaataagagagtcctacaagcatcaaaaaatgagtgtcagtattatcaaggtctgttagagacatgaaacagcaacactgtcactttttcatttgaagtgagagttatacttctaattatttcagctcattcataagcatatgtaatagcactagtacccagatactaggaccccgattaggattggttgttggtattagaacgagttttcctttctagaaactactcagtttttctaactcaagatcttagtttctcattacgatgatattctcaaatgcccaatgtacaattctctactgctgggtatgaaatagcttcttttggaaatgatgccacagctgacctaactctgtggattaaataagtattaattcattcaatgttaaacatgtatatttcagaactgtccttgagttcatattcattattttaattaatctcctgtagtaggttcccacagtggatctcataaaaatggaaatttaattaaaattaaatatcaacagaaaagcattaatctttttaaataaatttcccaatctatcaattaaataacattattgagcacctgctatatcccagggaacatgctgggtagtacaggattcaaaatgattaaaattcacctcgttatttcaaagaactcacaaagtaaaaaactacttacttagtaaaagagataaacttgtactagtgattgcagactcaaaatgggtgatgattgtggcttatctagtgatatttctagtgaactggagatggcatgcactgtttaacctggacaactacttcgctcaaggtgaataattgtcatgggggaatattgtatccagtattgccatatgttctgatttgttaattgtgaaatgcactgatttttatatgttgcgaggagataaaaaattatttaggcagtgcagctcaaagtaaactccacatgctaaagaaataaaaattttgaaaagtgcaacagtggaagcatgtacgaagtaaagtggtggcacaaagtaggtagtatttaacctttttttttttttgtatgaatgtggtataggaagcttcttggaaaaaagttaaagtaaatctgaggtttacaaaactagaaaacacacttcaagtagaaggaatggcatttgcaaagtcaaagctcatactctatgc

SEQ ID NO: 12029 - DNA, 73853 bp, Human
acagggtttcaccatgttggccaggctggtcttgaactcctgacctcagttgatctgcctgcctcggcctcccaaagtgctgggattacaggcatgaaccaccgtgcctgggcattcaggtatcttagaatgggaccttacttggacattacctcatgattacagaggtcatcaagttaaaatgaggcaattcgggtgggccctagtccagtatgactggtgtccttatagaaagaagggatttgcacacacacaccacagggaagatggtgtgaggagacatagggagaagatgggcatctgcaagtcagagtggccgggcacacatgctctttcatgggcctcggaagcagccagccctcccacgccgtgattttgtacttctagtctccagaaccaggacagaccatacatttcggttgttgaagccacttagtgtgtggtacttcgttccagcagcccttgaaaacaatagaccacagaacttgggaggtgcctgcagaggttctggggctgagggaccggttggagaagaggaaaaaggagaggcaaagatgacaaaatcacggatggggaggcgagatctggacagaaaaaccagggattagccaagcgggaaccagtgaaaacgaacgtggagtccattttttctagatctggaagatggagatctaaaaggactgagctgctagagaggttgctggtgtgtgcgttgtcctcaccccactgcaccactgcgcccagcacactgtgggagacacccagggaaagtccttcagttatttgtgggagtgaactgcagtgtggctgaggcctggagcgaaccacggtcagtttcccctgcctgcagcccaggcatagccctgcgttggttgtgcccacactctgggggcagcctgagtgccaagtgtggtactgctctcactagcatttaacctctgtgccccagcttcctcttctgtgaaaggacagtaatgacagtacctacctcactgggttatgaagattaaatagaataatgtgtacgcagtgtttgtagcaatgcctggcatcaagcactgggtaaacagtatctattattatcaaaggcctttacgacaacaatcattcttcaaacggccctccagcgaacgctgggcgcaaactccacggtaacggggaccaatgttgttagaggttgaggttcctggtaggtcccaggtgctaaaaggaagagcagcctttgggatgtgagcccgaaaaccatcgtgttggcttctgaagccccaagatgggcatggcagggacgcggaagccctcagaaccgcggaagccctcagaaccgcacagcaggtggccgccgtggtgcagcgcgcagtcggccctcagctcccctgcaccggcgcgagctgcgggcgctgcccacgtcaggctctgcagacaccagacagaaaaggtcttccggccagggagcgtgggggaaaccctgtggggccgcgcccgtcagtgtcaaggaaaaacggagaggaaggcccttgcctccagggccctcgcagcagaattctgcccggcctgccaggaggccagcggggcacgggctgagggtgcaggatccggagggcgccgcccgcccctcgggcatcgcggggcccagggtccgcggggcctctgagctgaggcggtccaatgtaccctttgtccttcctcagattcattatgaaatccgaggcagtctgggcgactccagcggcgttcgcccgccgcagcctctcgaccgccggccacccgccagccacgcgcgcccagacaggagggcggccgggcgctcggcggggcggggcctgccgggggcggggcctgcgggcggggcggggcgcgggagggcggggccggcgcggcgagcgcaccagcagcatcctggctcagccgcggcggtggcgggggcgcaaccagcgggccgaggcggcggcgccagcggctctttaaatagcatccagagccggcgcggggcagggagtgggctgcagtgacagccggcggcggagcggccggtccacggaggaggtgagtgcgcccgccgtgcggagccgcgcctgctcccgcggcggtgcccgggccccggccgaggcgccggctgacgttgcccttcagggccgagcccggagcagcggccgccgcggaggcgcgtgagccaccccaggctcgtggggccgcgccgcctttccggcctcctgcccgcggccccgcttccctcggcagccggaggcctccggggtgcccgtgctgccgcagcttcctgtgtctgagtcgcgggcggcgcgggcgcggggctggtgcgcggccggggatgcgcgcgggaccgacccttgtgtgtgcggcggcggggaccggcccggcgaagcagccggaggccgcgcttcggctgggaggaggtggcccagctgggccgctgacgttgccctcgtccgcggcccccgcctgcccagaggccgggctcgcgggcgttcggaccgcgcgtggggcgagactgcactcgcgcccgctgagatgccggccccacgcagcgcggcggcacgaggcccacaggcagctcagaggccgctgccagaggcagacattctctcggtgactccagaggagtgcccgtggcccttgcacttggccgtggagtcattgatctaaggagtgctggcattttttgaaattgagaagcaaagatgatgtctgtcacctggcagcgtagacggagagtggcggtagatgacttgaatggacacgtggattcgagtctggggacaggcgttcccccagtcggtgcgttgtgagagtgtggaaaccccttccccactcagtccaatttcaaggttatggagcataattaagagtgaccattctaaaagcgttctctagtgccctggctaagacttttaagcttcttggtgcaggagtgtctaaagtcccgcgactctcactgccctgtcttttattttcttgacctttgattagcgttgagagaaactggttaaatcttgcagtttctgccacccatttcacaacttaacctgtgattgtcccaaagaaaacaattattggcttcttgctagcaaaaaaatcaaaggcttccggttgattgtttctttcttttttttcttttttcaagtggacgtggaaggttaggctggctaaaacttaaagtttgagttgtaggtctgtgctgggtaggcttgagaagatggagctttttaaggaaccattgctcgccatcagattggagccagacagtgcagtgtgatatagtggaaaaggaccaggtcttgggagacttactttcttgttctgactcaactcggaaaacacctccctagtctgaggcccccctccttatatttgtgaacaaactgcattagactaaaatctttcacgagtccaaattctgcgactagaaaaataaacttgttagccgcacaccttatacctctcccctttaaaacagacatattaaagacttctgttttctgaatttactgtaaacagaatacttaaaaaaaaattacccagacaggcgtggtggctcactgtaatcccagcactttgggagaccgaggcgggcagatcatttgaggtcaggagttcgagaccagcctgaccaacatggagaaaccctatctctactaaaaatacaaataattagccaggcgtggtggcatgcatctctagtcccagctactcgagaggctgagccaggagaatcgcttgaactcaggaggcagaagttgtgatgagctgagatcccgccactgcactccagactgggcaacagagcaggactctgtaaaaaacaaaacaaaacaaaaaattacccttccccacaattataagcattttggcatatttccttcctgtctctgttgttcctattttggcagtatttttattgttatcgcaggcagcctgactgaaaagaaatctgggcttctaagtttttggtatttaggaggtagatacaagtgacccatgcatgtagggttaggtatctatttataccatgcaggtagagttttcatagccacctctacttttgggtgaagtttaggctaactgaaagtgtaccagcatgcatggtgtatgcagaaaaatgaacgtaattcagattatgtgatagttttctcttgttgccattatatataacccagggcttaccacaaactgaaatttcttatgcattgacatttagcatttgatgtaaaatgactatctcagagttgctgccacaaacactggtaaaactgtccctactttctagcatgcttaatgtctaggtcttgctacatcttttttgatgtaactgttttgtggaaaatggttgtgtgtttggggaggcttttgagaaaagataaggttgtcttgtcattataactgggtatttctcctctctcccttccagtttcacttgtctggaaatagcaagactataggagtagtaatttctagatatttatagtcagtaaccttagaggaatgtttagtttttaagatcaattgaatttattgtgtaagtttgccatttaaaacaggtgcccatttgtgtttactgtctcttgtaaccaaactctgttcaattagaatccattagtaatgttttgtggagagtcttgtttggatgatgcagtgcatgaggctcctgtactacaaaatagaaaagaagttcctctaaggcagctcaaagctgttgatatcctgaagcctttttaggcctccctctctgacaggcggtgatctgacaggaggtagataaaggtgccggagtttttagtgaaggttggcagtccaacttggtagtcagacaaacacatgatggtcaaaagtgcctttgacactggggcctggagaagaattctcagtggccagagctgatctgaagctgcaggcagttgagtttgagtttcaacatgttggtacttcaaggggcttctgaaaagttttaaaggagcacaagccctgaaggagtagctgaacttagtgaactggagaaggcaggggcagttttaccagggtttgtggcagcgactctaagattgtcattttacatcaaatgctgaatgtcaatgcataagaaatttcagtttgtggcaagccttgggttgtatataatggcaagaagagaaaactatcacataatctgagttatgttcattttctacatcatgacattttcactttcttttttttttcttttttcccagataaggtctcactctgtcgcccaggttggagtacaggcatgatcatggctcgttgcagcctctccacctccctgggctcagttgatcctcccacttcagcctctccagtagcttagactacaggcgcacatcactatgcccagctaatttttgtatttttttcgtagtgaagcggttttgccatattgcccagttgtctcgaactcctgggctcaagcgatttgccctccttggcctccccaaagtgctaggattacaggcgtgagccactgcacccagcccactttcatgttcttgactgtgttagaaacaacacagtattgattcacttatgacctttgaggaatcaagaggggcgggtgaaatattggagactccttgaagtgtggctggcttggagggtgtcacccttggacaaaaacttaagtggaggtgagtaagggccctgctcccctgtgctgcctgccttagaaggatgtgatcatctggaggcaaatagcttgttgcttgaggccaggagttcaagaccagcctgggcaacagagcaagaccccatctctagaaaaaaaaaagtaaaaacaataaaataaaatctcaaaactggtggttccatataggtgcctgggctgattctctttatgaattatttgctggtcttcaagtttaaataaaattctgaaagctgtctaatatctaaaaaccacttgccacagaaaagctgtatttgtttttcatattttaagagtcatacatacttactggagaaaatttgggaaataggaaaaatgaagctcttccagagattaaatactattaacattttgttatatttccttccagtcttttttccctatacaataaacaaattttaagcatacattgttaattaaagattacaattttgacaatttaactttatcacctaagttatattgtgggcttttttacacgttgttacatattcttcaaaaaataagttctgaagatgactgcattatttgctgtatgggccataatttagttacttctccccatttgttggatatttttcagaacagtttaccaacctttgttatatgtttaaatacgtctttaaaaaataaaaaatgttctgctttaaaactcttgaaattaacaataatttgaaaagtgtttttactaatgaataggtttaatggacttttgggttcatgtattctagtcaaaagcagttgaaatagggatttcatggtttggaaagagaaatggaaagaagttagggcatcagaggaggaaacggggcctgcctgtagaccatttcctcattctggaggggacttctgataaatgtaggctctatccattagcacagctttggctgctatagaaatgggcactttccccttaggtttgttgtgggagaaatgtccatataagaaggactgaaacactctgaatactatttattcctttattaagcagagtcatgagaaagtgcttccggagctagtttctccttcagggtccaggtgtctgccacaaagcagggctgtggtagctgaccgaggtggtagccacagcctggacacggccaggcttaggaacagagcagtgatgagagcagcagacagagccaggtgctgctaagcttctgatgggttaactcattagtaccttcagcaaccctgtaaggtaggtcctgctgctatccttactgtacacaagataaaggaacaggtgcaaagattaagttccccataccagaatttgaacctaggcagtctggcttcagggtctgtgctcctaattgctgggctctactgcccctccagagctagaagttctcactccaggagggcctagaaagttccaggttaggccaggtgcggtggctcacgcctgtaatcccagcattttgggaggccgaggcgggtggatcaccctgaccaatatggtgaaaccccgtctctactaaaaatacaaaaattaactgggcgtggtggtacgtgcctgtagtctcagctgctcgggaggttgaggcaggagaatcgcatgaacccaggaggcggaggctgcagtgagccaagattgcgccacagcactccagcctgggtgacagagtgagactctgtctccaaaagaaaaaaaaagaaagttccaggttatacagctggcagtaagacaggaaggacagagctgggtctccttcggtgtcactgctccttgattttacccccatctcatttacactctgccttgaattatctctttataccactagagtgctgaaagagaccacaaattttgattcagcgtggctcagggagtgataagatcacttgctatgtagctgtgactttctagagaattaaaaaataaaaggctttgcctgccctggacattggtcttgtaaggctggagaacaattgagacgcatgactggccgggtgcagtggctcacgcctgtaatcccagcactttgggaggccgaggtgggcggatcatgaggtcaggagatcaagaccatcctggctaacacggtgcaaccctgtctctactaaaaatacaaaaaattagccaggcatggtggtgggcacctgtagtcccagctacttgggagtctgcagggatcggaggggggtgacttggccaaggtaacacaacctgcctgaccctctggccatgcacacgtgtggagtttgttcccgggccctgtgcctgttcaaagaatggctggacgtcggtattgcccttggtttctgccctgaagtccagtcagtcagcagttctgcttattctgaccctctctgtgcagtattacccaacacacatgcatttcctccttgccttctcagtattgccatcgtgaaccagaattgtcacctccaatttaaacagtgaaggcctttgttaggaagaggggcagggtgcagagggggatggttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctgggataaagtttgtgttgagtacatctaggctgggtgtggtagctcacgcctgtaatctcagcactttgggaggccaaggcaggtggatcatctgaggtcaggagttcgagaccagcctggacaacatggtgaaaccctgtctctgctaaaaatacaaaaattagccaggtgtggtggcaggcgcctgtaatcccagctactcaggaggctgaggcaggagaatcccttgagcctgggaggcagaggttgcagtgagccaagatcgtgccattgcactccagcctggggtatagagtgaggctctgtctccaaaaaaaaaaaaaaaaaaagtacatctaaatggtacgatgcccatgttggcctatttggaatgccattccttgtcccacagagccctgctcctcagaggcacttttcctggagtgactctccccttcctcacctacactcactgtcattcagctgtagatgcaccagcgatcatgctagtggttaaaatatcgaaatactcccatcctggctagagaatagctgctacccaagtgcccccgcccttcatatggaaactaaagggttaatacatggggcagtagaggaactttggagccctgttttggtgcactggcctgtgtcttttctggctggttggtgtctggccgtactggctattaaatattttgatgagcatcccagcctctgtcccacgtgcatcttttcatgagtgcatatctggcttccacagattggcaccccagccacactctaagctctgggcacatgggagacctagtcattgtcatctctgtgttttcagcagcgtttaatacagggccttaccgctagtaagcatgtaagattatctaatgatggattgagggtagggcaggttccgatggtcagatgtcccatagaaggtggtccctaacaagaatatacattgtaatgttccaggtttgtctattctgatactgtgcaaaacgtagatcttatagccaagatcaaggcatcgaaagtctgtggacctaagcctgtgctttcactgagtgaagtttgtgtttcggagtacatctgaggtgtttctttccgtgtagtttcacttgtgttggagaagcaggtggctgtggtctttgcagggtgtgagaggggaggagattagtgttgagctccagctaatgttacataactctactgtagtcttcctttacctggtattcttgtgttcaaattgccccttgtttctgtgccactagtgaaatggtcaaatggctcattgttccttctgtaggacagttacctacattgcgcctcaggcaagcttctgaggcatcccaggatggggagctggcgggggaccttatctgtcaagcagcccagccaggcacctcacagtggacggaactgagttcttgagggggtggctgagcagcccagactcccaggttagactctgaagacagccagtctgtgcttttctctcctgatgtgagtcagaggcaaactctgccgatgccaagacctccctagagttcaggcagggtgaagatccttgtccttggggtcagggctgaagcttcagggtgtccaggacagaccttcagaggaggccagccctggagcctggcgtgggtctcggcctcaagcctctctgtcctgcagagaggccggctcagtctcttcaccctctcaggcaggccaggcgacggtcaccagtagcgtcctgctctctctggcatgcttcccttcatcactgggtgatgctgagtgtcttttcctccctctttgatgtgacagtccctttttgcaggcttttgcaggcactgtccctctgcctcccaggtgtggcacgcatttcagggtgcctccattagcagtttcatgcattgttgcccatggtggggaacagatggagacacaaggcaggcaagccaccaaagaggctgcagggctgctcaggagatggaaggactgtctccagagtggggtgtatgccccatagtggctgcctagaccatccattagattgtagaatagaatagaaacattagaacttctatggatagttattttttggccatcttttaaattcatatttgtgtgttttctaatggtcagaaaatacttgtatatggtttatagataaaagcatttaatgtgaggggtgcatttatttattggggtacatcatcagaagtctagagaaccagaaagttaactccttctctagcaccagtatcatgagagacctctgaatgccattttttaaaaaggaaagaatttgtcaattaaaggggaatagaaactgctctctggctaggttgtgattcatgtcaaataggcctgtgacttaaggagagtcaggttaactccagagtatgttttgtctctggtcccaaaacttagcagtgtggaagcctcattgggatcagggttttatttttttctcttttgtttactatcatatcccctgaggctggagctgacttgcatatcctcaatatttgcaaattgaatatatgggcgtttttcttgcatgataattaagtattatgctgagttggatgcttcaagtcaatattcaggttgcctccttttgtttaaacctttgggcagttggcaagatgcagcctacatgccagtcagttttactgtcctgcacatgatacccccacgcggtagaaccatagagccgtggaggcctcagaaatgtcacctgagagacagggtgttgggatgtaacttaaagtaattttttaagaagtgggtataatgaaacagcaaaacgttgatcattactgaagctgaagttggagtcacgggtacataaaatatagttttattatacttctgtgtctacttttgaatagatttgaattttcataataaattttaagtgaaacataaagggaatatagagaccccaaactagtatcacccattccgagcaggtaatggccgaactgcatagtctctttttctttctgtcttttaaacactggtcattattctataatcttctgcaacttgttaggtttgttttgattttggcttccccagagccagtcacctctttttatagttacctgagctctttgtgtaattttagctcatgtctcgtggttgtcaccagtacctctcttctccttcccaatacgatgagctaaatcctggttaaccttttccctatttcacttgttgcttcctccaacaccactgaggtcttccacatgacaggcacaattcagaggccagaacagggtcccatgttttttgcaggctgcgtccagtcctggggaacctcatagcctgtgattatcttctagattccattcatgtctgcttttttttttttcttttggatggcgtctctgttgtccaggctggagcgcagtggtgccatcttggctcactgccgctgcgccccccacaggttcaatcgactctcctgcctcagcctccgagtagccgggactacaggtgtgtgccatcacgcctggctaatttttgtatttttagtagagatggagtttcgccatgttggccaggctgggcttgaactcctggcctcagatgatccacccacctctgcctcccaaagtgctgggtttacaggcatgaacctgtaaacctggcctcatctctgctttttaaagtaacagcaggtacctgttgaaatctgtaaaaactcaactcagaagtggatttctccaaactcgtgagaggctgatcttcttctccctgggcagagaggtctttgtgtcctgtcttctcacccgtgtcctgctaagccatttctgtggttatcagtctctgaaaccttggtctattttaagaggtgtgagtaactctacccaacctttgccctttttaaccttcttatccaggtcactgatatgtgatagctgtgacctctgcgagctgtggggtgctgtggactccttgaagacaaggactgggtcttactcttcccagtttccccccccaggcctgggtcctggaggggacaggagggctctgtgaactaaacacccactgggtgagggcgagcctcctttagccagctgtttcttactcagccaagacattgacaagaatgctgtcatgggagagagagaggcagaggctcctgacggttgccttacaatgcggctgcgagtccccagcccacctgccgctccttcagggcctcctccctgcctctttgctcacagcactgtctggctgttgctggtgtttctccacccactcctgtctctgcctgttcagacttggcctggttccaccctcagctctctggacagccctccctcggatgcctggtgcatgcgtactgttttctccctcccctagattcctggagcaccagggccctacctgccgtggttatcagatctgtcttctgtagctctgttaactcttgcaggtgtgtttgtcttcattgatatcctaaacttgctgaaggcaaagaaaaccttgtaagtattttatcctcaggctttctgattgtcaggaactaaggagagttggttatccccctggaatgttcagagtgttgcttctttttttgtggtgtgactcctttttcaaagaggcacgaaagtggaagtggctcacatagcaggtcagtggctgagccgggtccagcgtgggcagacggggcaaagcatagctacatattttccaggaggggtttatatcctatctgtcattctgttctgaggacaggtcactacctaaatccttcgtggagcaggtgggaaatacataaatacaggaggacattaactgacctgactcacttatagcttctttatctggagaaacttttaaaaatacagctaatagttaggatggcaagttttatattaatttttccatagtaaaaaattgggaaaaatacagcaacatacaaagaacaacaacatagtagtaaaaacacccatagactcgccacatagaattgaaggttttaacattgactcttttcttcatatatcactgttccctgggggttttgggtattaggtggaaacttgattgtttagtcctggacgccaggattgtgtggccatcttttcccttctcttacatagtcttggagaagctaccatgatgttcatgatggaaagaggcgtagctctcctctgttcccactctcctttttttttttttttttttttttgaggcggagtctcgctctgtcgcccaggctggagagcagtggcacgatcttggctcactgcaagctccgcctcccgggttcatgccattctcctgcctcagcctcccgagtagctgggactacaggagcccaccaccatgcatggctaatttttttgtatttttagtagagacggggtttcaccgtgtgagccaggatggtcttgatctcctgacctcgtgatccacccgcctcggcctctctaagtgctgggattacaggcgtgagccactgtgcccagccttacatgttcatattctgtttatttccatagtcaccacgggaagatgggaagatcctgactttgggcagagcacctgagaggaccccaggatctaggtaccttctctgcgtgcagtttctcaaacaagtggagcttcctctccatccatggccctcggaggaggaaagtgcctgcatagcttggggccagctctggctactgtgaaaggacatttgatcctctctgctgttcagttgtgctctcttctcctggtgtggtctcttgcttcagggcttactttgtggttagctgagtccagtaaggtgaagagtcttctggattatttcagtggcaaaaagccttttatttccttctttagctttcgtaataacaggccgtgcttgtcttgcctaatacccttagaacatgctgtcatgttcttcaacttgcggtcatagagacacaattccgactcttcctgtgctgaacatcagctgaaataacatgccgtattgatccagttcatgagtgagaagtttagtctacacaagccttttctgtcttgctctttgcagaaggattgcgtcagcctaaaaagcggatctttttgtctccatccgctgccacaaagctgttgacggaggctatctgcccaagttggctgccttctctagctcttatcagtaaacttatctgcctcattgtgacatatctacaacagttgcttagccttattcaatcagtattggaagacaagtggaatcatctttcttctcataggaaattttttgaatggaaacttgccctcttaaatatgtaccgccaaaatttagccctgctgtcccacgcaaaggctgtacatgacctggatatcgtcatggggcatgtcctaactataatcatcattttctcaagtggatgtacatgacagatctttgcagctgtgtgtgaagagagaagggaggagagctatatgttttgttttgttttgttttgtttgctctggagaatgttgggcatatcctgttgtcagcattccgtacatctcaggtggccgcccactagctctgtgtttctgggagcattctcctcactagagccctcgcgtgggactctggatcttgtgcttgagtcttgtctgtttccctggtttggaagattctcttttctgtcatagaaaactcacagaagttggagtccagccctggtatggggctctgggctcaagcctttctgatatttgctgttttacttaagaaaagtacttatttgatctcttcccttcccccggggcagccttgatttgttttaaatgaatcatcagtcgtctgtccaaatctcactgtatctcagcgtcttctaaagacagtagcccttagagttgatggcagtcttgggctgacattctacataagtgaaacaatttgagaaatataaaacatgatcaaaataagagcaagagaatatttttatgtcccctttacatcagtggctcgcacccttttctttttcccccagtcagccaggagatgttctctactcctttctggtgtgcggtgtaggagtctggtggtgggtagaaggagactactgaagttggaaaatgcttaataccccctttctttttggagaatcactgttctatgaatatatcctcaagggacttgctgcagagacacagtcagaatcacagagggtctgacacggtcagaatcacagagggtcattcatgactcagtagatgtttgttaagcacctgtccttggctcgggactgtgttaagaaccaagggcatataaagacagatgggaggagaccctggccggggagaggaagaagcatctacataggtactaagtaccattcgctgtaagtgtaagacaggaggtgctaagtaccacacaggggttacaaataaagaagtcctggagttcagaggaaggactgattgcttctcatagaggggattgtgtaagatttctgggtagttgtggaaccgccgcctcctcccacatgaaggagggccctgaggaccctggaaggttgggccggttgctcacaaatcaccctcctgtctcctcctcccagtgtctcttcagtgttttgccattcattctcaggctcaaaattacttctcttttgtccatttgtatccacttaagcaatttttaaaaataattaaactttttttattgtggtaaaatatatataacataaaatttgtcatgctaatcatttttaagtatacagttacacagtggtttgaagtacattcatagggttgtataaccattaccaccatctagttccagaatgtttcgtcatcccgaattgaaactctgtgcccgttcagcaataacgctcattcctcctccccctgcccagcccccagtaacctctctgctgctttctgtctctgtgaatttgctgattctaggtacctcctagaagtgagatcatgtagtatttgtcctttgcttcatccatgtcatggcatgtatccaaatttccttctttttaaaggttggataatgttccattgtatagactacattttgatccgttcatctgttgttggaaatctgggtttgaatcctgggctcttaaagcattgtgcagctgggcgcggtggctcacacctgtaatcccagcactttgggaggccaaggcgggcagatcacaaagtcgggagatcgagaccatcctggccaacacggtgaaaccccgtctctactaaaaatacaaaaaaaaaattagccaggcgtggtggcgggtgcctgaagttccagctactccggaggctgaggtgggagaatggcgtgaacccagaaggcggagcttgcagtgagccgagatcacaccactgcactccagcctgggcgacaaagtgagactctgtctcaaaaaacaaaacaaaaaaaaagcattgtgcatcgtggcttgtcattgtcagtgtcacctatgccctctgtttagacttgaacacccacgcacgactgggctgatgtgctcagctcttgaggtctgtgggctttggcttcagacccaggcactcatcctgttctcatgtggaactagggcaggacatttgactcctgtacagtttcctgatctttgagctgaaggcagtaacaaccccgtgcagtaaggactgtgacgaggacgcatttagccctgtgcgcagtcccgtagcacagcacctgacacacggcaagtgcttaagcacagtggctcctaacaaaatcataactaagcccatttccccaaacatcttccttcccctttcctatcctatcctatcctatccgcttgagccctatcgtttgttccagattaatgtgcgaaagtgcgagccctgaggtcaggaggcacttctagtagccttgtctctgtccctggggcatgaaggatagctcattttcccagatgattctcatttgtcaaggaccagctcagctgtgccttctccatgcaaccctccctaagagcaaatgctccctgtcagaattcattttgcacttactgctactctgttatccactattttgtgtatacatttatgttatgtcttttaattccaagcccaatataagattcctgtcccaatataagatgaaagtgtcccaaaattctccttcagccttcctagttaagtcttaccaaggctgtcatagtatgaggtgctctcagcccctgtatttggaacagcctcggggagagagggcaccttgtcctgaaactgtctctaccagtcctagtcatgggtccttgtacaggtcaactagctgaattagactttttctacagcaaatgtaatgctagctgggtaattatttcttagggtttcagcttacaaaggcaaatgttggttgttactgtaaaaagtgcatttaaaaatcagtttaaaaagctataaatagagtatgaggtttagttagataaatgtggacccataggacaaaatttctcctgttctaatatcattcaaatgtgttcttgtgacttgggagaattttttcactagtagcacatacatgacttcaaaaactgcttcaatttcaacaacttcagtggaagaggaaaatgtgaatgtatgccacagaaaaccattcgatgcctcaaaaagtggctgtagagatgccccaaaccctgtttgaagatgcatattcaaagaactcaaataacatattaatgaaatgtggtttatttgtttattttatttttattttttttgagacagagtctcgctctgtcgcccaggctggagtgcagtggcgcgatctcagcttactgcaagctccgcttcccaggttcacaccattctcctgcctcagcctcccaagtagctgggactacaggcgcctgccaccacgcctggctaattttttttttgtatttttagtagagatggagtttcaccgtgttagccaggatggtcttgatctcctgacctcgtgatctgcccgcctcggcctcccaaagtgctgggattacaggtgtgagccaccgcgcccggcctaatgaaatgtgaatttaaaacagtatttctaaagtaatttagttcttcatgtgatttaactggagatgtagtttaatgaatacagaaactgctataagatatttgaccctgcatcctaaaaatttatctgttcaaattcgacatattgtgtttgagatctctttattttggggggcatatatgatatttgtgaccaatgtgaatggttgaggtatggtcctcattttactggttaacagttcaaagctttgtgtctcactctttctctgataactttataaggggatgggcagggagtggtttaagtgtagaagtattcagctggacttgaatatttcaataagtcagattaataaaatcagggcatctgctttgtttcttctttttacatccttaggaaattcaattggtgatctataagatcactttaatgaaaattaagtgggtttaagatttattatacttaattgggaagaaaaagccacaaggcagtgggtgggaataactgactccctgtggaaccacttgcatgtttgttatgggatcccaaagttaccccaaatctttctcctgatgctcagagtgaggagatgggcccagagcagtgaccacagtcagggagatcagtgggatagggtttggacagcaacctctgctttcctctccagctgggagactggcatctcttttgagctgccgtacctccctctctctagggagagcctgactgctcttttggttcaaaagggaatggcttaagcaaatctaactttagggaatttgccaagccagggttaaggagcacgaatccaacaggtttggagtggtgctttgaaagagcagcaaatggcctggctgctgctctcttgttcctccctgaagcctgagctctgcccagctagtgaatgacaaagggggcgctttcagcctctgtaaatagcctattgtacaaggggaggaggcggggcacggaatggcagcatcttgccagcttgggttgctgcgttaaggaaagatgtcaggctttcttaatttgccactgcaggggcaagggtgtcatttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatacaatgttaatgtaagtaaaagtttgcagagttgcaggggcagtgtgtgtgtgtgtgtgtgtatgtttgtgtatgtgtatcttcaagagaatgatgtccttgtgagtcacctctggccctgagccactattttcatggtacaaataaaatggtgaagaggtgaacctttgtgtatagtgggccttgaactcaccacgtgttcagaggccagggtgatacaataaatgctaacgtttttgtaagacattgagcatttaggtggacctcaggagggagctgtcataatacctgggagtgtgagtactggaaggactttagaaacctgacctcatggttcctaacctgggttgggctaaaggagacttgtgatagttatgtgtgttctcaggggagagggtcagtggcttagcatagttaagaattattagcataggttggatttagagtcacattggttggtgtcccgttcttgactaacatcctggggaaggcttataagtctctggccttggtttcttcctcatcagtttgcttttgtgatgttcagataagacactggatatgaaagcctttccaaaacactaagtaaatgctaattgcatttttagttctatccaaagtttgggtagacgggtaccaggattttggtttctgacagtccgtgcagttcagtttccatcaccctgcctcgctatgcctgtctctgcccaggtctatttaaaggaatctcctgtgctggatctttacactgggcttgtgcccagatttccttggccattgttaccttccccatccttctgtggttttagactccaggtttacagaaaacccagctgagcaaacccactttctgtaagagtggggaggagggtgcacaggagtggctgtagaggaaggagaagctggctgtcagtagccttatgtgttcccagctgggaaatactggctccttaagcctttaagccaattgaattatatttttggcaaacagcggcatgatttacatgcccaggctataaatttccttagatgtttatatggaaatttgattttgaaagaataaagaaatattcaaaccagaacactactggaataagaatacaatctgtctgagttttaccatttgttagcaagtgtatgagtcttagtccttcttagagaccccttagtctaatgcttatgttcacatacagcgttgaaagactatttcttgtgcctgattttctttggatgtaggtgtacctccatttttaaataccccaagtgccttttccttaatagcagttaatagaagggaaaagatttataatgctatcagtgtctgtttaagagttgttcttcacacatatctaaatgagctattgtcttagttctttatgcatagactatagttttcctatgtatagcattaatcagtttgttcagtgaagttggcttgcagcttgttacctggctgccatttaagaggcatgaattaaactgctatagtttgtcattatcacccactaaatataggaatttggctggattcaaacccttagtattatagattagtatctaatgaaatgttcttgtacacatgctactaaatatataattttctgaagttttttttttaaagtgttctttcttagatttaataaactttcttggtgtaaagcagtctatagcatggctactgctgatgcttaaaatagacaaattaatcccctgtgtctgactgtatttgtttacagaggaattatttaagattctcactcagggatgtgatcctgttgaacagcacctgcaaattcacacaatctaggttttatgggagttactctaggagctttggggagagaagagagaaaggcatggcagtgtgtgtcggggtgagtacttcctattcaggcctggagtgctgcagggtgatgaagacaactagaggtggaaggatttgagggcaaggcaagtttgcacattatattcccaaggctgctttgaggttgtggagttgcaatactgtttctgaaatctgaacactcagtgtcaataggacatggacttgatttgtctgcttatcccgcctggtgtacatcccttcctcagaaaggccttcccccgtgccttgcagaccttgcttgtttgatttttatcttccctgctagaaggttagcccactgaaagcctagaccaggtcatcaacactgtcttcccagcgcctggccaaagcctggctcacactaggtgctcagatatgcagtgacgggagtagctcaattcctatgtattcgtctagaataaatctgctgtcagcatgctctgggcaatctgtttctttcttggtatgccttaccttggttagacataccacccggcatcctatccttcatttcagtggtttaaaaaatatatgcccgttgtctcttattgggaagctgagcagaaagaaaacagtgtctgttttcagaaccggtcctggcagcaacactcactgatgcctgtccctgcccatgggtggagcagtggggtgactttgctgctggctgcccattggcctatcctccaccctctgctctcctgagaagtcaagtgtggattttgtctgctagttacctttagcccagtgggcagcagcgtggggctcggcatgtgacttgtgccctgagagaccttggtaggctgggggagcgcagctgagccctgctaacccccgcccacttccaggctcattgccctcttctgtgtctgcagtggggtgtcacctagtagtcagctgttggtggcacagatggtgagtggttttgttaagtgctggtgccttctttccagaaccatggcctgaagaaatctgcttatctgttctttctttgctgtcatggtaaaccttgaaatttcgtgtgtgtgtttgtgtgtgtgtgtgtgagtgagtacacttacatggattcattgtagcagagattgaatgagcagagcaaatacattatgttggttctggtagtattaatggcctgtaaaacagagaccattaaatttaaaattaatttcatttaaatttaaattttagcagaaaatttctgtattttaacaaagaaaaagagatgcaaatcaaaaccacaatgcatttctctgatgaccagtgatgatgagcattttttcacgtgtctgttggtggcataaatgtcttcttttgagaagtgtctgttcatatcctttgcccacttgtttgttgtttttcttgtaaatttttgttttttttcttgtaaatttgtttgggttctttgtagattctggatattagccctttgtcagatggacagattgcaaaaattttctcccattctgtaggttgcctgttcactctgatggtagtttcttttgctgtgcagaagcttcttaattttgtctgaacactccttgtaggcagtgtttttacctgcgtgctttacttgttctgcactcaggatgaatcacagagcgttggtagaggaaataatcataaaatctaatatttttgagcactttctaacgtgtgtgagatcattcttacctctttatgtgagtcatttagcagtcagaaaagccctgcgagataaggtgctatttccgtctccatttacagatgaggaaactgaggcacagggaagggaggtcatatgtcccaaatcatacagctcatatgccagggaggcagaatttggctctagcatctagggtctttttttttttttttcttttttgagacggggtctcactttgttgcccagattggagtgcagtggcacgatcccggctcactgcaaccctctgcctcctggattcaggcgattctcctgcctcaccctcctgagtagctgggattacaggtgtccaccaccacacctggctaatttttgtattttttgaagagatggagtttcaccgtgttagccaggctgatctcaaactcttgacctcaggtgatccacccgcctcggcttcccaaagtgctgggattacaggcatgagccaccgcgtccggctgcatctaggatctcaaatactattctgtactttctttccaacactgtgctgtattccctctttagatatctggtggttggtttaaagtttatgcacaccaatttatctgtttgtttcttttggctataatgtcttggggagtgtaaaagaaactcatcttaccagatagccaactatgggtttcccagcatttatattgccactgttgtcgtgtgaggagtacagaaggtgaaatttacattggtgtgtttaaccagtttgggaacttgttctgagatctgttggaagaaatagaaactgatggcccttaggtggtttgggcttgtacttccccttcactcatattcccattagccttgacaatgagagtcgagtgtttttgattaggtggatggacgagagcagagacgtagtagcaaagaagaaaatagaaacttaaatctacttatttgagtttttatgggaagaattcttcttgagtaaaatctttttaatatggttaatgaaaggaagagaatggggttttttcaatacaaggtaatggagaaatagaatgaaaatgaaatcctaaagtgtttttagaaaaatgacacttgacagccaggaaaagccccggatcattagattgtgggtttaatgcctggactggccgagcagctacccaattagatggctggccggtggaattttggagttctggagaggggtcctgcttccctggaacgaacgtgacatttttctctcccaacagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcggtgagtggagggcccagcctgcctcgtgcgttttctccgcatttccccagatgagctgagccctgttgaatgtgatagccatcaagatcaaatatttgtttataactgcactttgtaaatggaaatgtgccaaattactgatggtggtaaatagaggtacagggcaaaatataggcacagggacagatgagagggtgtcggttgggtgtctacctctcgtcacatggaagatcattctagaaatgacattgagtttctacgctgtggtaggcactgtggtcagcctggaggattccataaggaaaaatatagcacagaacccctgttctcacagggattagattctggcaggaatgagagttttcaaacaaatgttaccaaaagaatgcactcgtggtacatctgacgcttagaacatatccctagcctgttggaagggactttgggatttcaaatagaatagggctggagtaagaacttgacggaagaacacggctgcagaattcggggcaggacatgaagaaacaaccctcaagaggcgcgtctggctgggctgctgagcgccgtggttgtgtgtgacttgggcaaactggaggctgtgctctcatgttaggaaaatgaaactggaatgcgggcaattagggcttaataggagggatggcgtaaggaaaccttaggatcctttcaggaagattcttagtgctcctgctctccctgccttccctagtgagaaaggcagggtgtggagaagatgaagaggccgcatgctcactggtgcttccactcctcacctgttctttggttttctctgtggtcgcttgctttcccctacccaagtcagtcacccttcagtgtttcccgcattcagcagatatgcagaagaacattgtgaaacacaagatccccccatttactgcttccagatgtaagagatggaaggcctcccccacccccccgggctgactgccgcagagggagtgtgtgcccttccacataaagccctggctggagtcagcatttttgttatttatgggattctaggtctttgttttattttagacaagttcttggattcattaatgtgaaactcttaaaatatataaaagattcttcagtctaattcatgccaaaatataaatatagaatgactgaactacagctgagaaaagttaactttctacttgatttctatttagaaggtcagggtaccttaatatttcacctcagctaatcacataggctggggaatgagtggaatctcccttttcctaagggattcctgtgaggttctggcattccttctctactggcagagcacctgatgtgtcacggcagcgctgccatctccatgaagagttgttggcaagtgcagtgttaagacatgtataacttagcagtaactgtaagaaatgagtaattcctattatatgagaaattgtgggggcacttacgtgtggttttaaagctttagcttagcataaaggcattgtgccttgttaaaataattacatatgttctctctagaacagtttaaaacttgagatatgcagcaagaaatgaaaatctataattttactgcccagtatagaggcttcctgatttttctctgtttatagacattgatttagctctgattttcagaatttgtggggcttagaaatagatactgagcttgctttgcctttttaaaaaagaagttaaaagtttaaatttaaaagtagctctggaattctggtgcttaataattacagatgctttgatatagctagcatcatcctgtggacacctagggcagggaaagaggaacttgattcacttcataaggtaccggtgaagagcctgtgcatctggcactgctgcggggggctggtggccggagtggaatattgttgctgtgttcctactttgaaaacaagtaagcagggtttgccagttcccaccctcattctgcacccccatctcacatgcacagtttttatcaccctccttgtccaataaagtttacacggatactaaaatgagaagaatccgcactttttggtttggccacttctcatcacaacccacgctggctgtttcccagctactgatttttaaggcagtagcacagaggttctttgtaaattataccttctgaaatttccttttaaaaatcaggattgtagagctgggtgcagtggcacatgctgtaatccctgcactttgggaggccgaggtgagaggattgcttgaggccaggagtttgagaccagcatgggcaacatagcaaggcctcatctctataaatttttttattttaattagttgggtgtggtggctcatggctgtagtcccagctactcgggagactgaagtggacgaatcatttgaacccaggagttggacactgcagtgagctatgactgtgccactgcactccagcctgggcaacagagcgagaccttgtccctaagaaaaataaaaatcagggttgtaaagaggaggttaacactcatgctggtcacctctaatgaagacctaaattagagaacaggacagacaagctgggttaggaacagaatccaaaaagtgtttcttaagtgttggagcccggactgatcagggccctgtctggagaaccacgtccttgtgtctgtagtggcagctcacagtcataactgtgatgccctgcgtgccaaggaagagcttctatcttctgaaggattttgctgctgctgctctgtgactttgagcaatggatagaagcagattttgtgggtttgctttctttttacatcactgtcacagataatgcaagatttctggtgttagccagtgttccggtttagcctggctacatgttttagcctcttctctgagattgaagccccatggccccctagtgaaaacgatcttcactggagtgactggaaaccttttcggattggtcggagcccagacacacgtggttgcagttaagcaaagtacaggagcatgttggagcggaaagggaccagggaaaagagggatggggcagatgtgggactggactccaacttagaccaggcaaccttgggcaagttcaccaggattttctgaccttcagattcctcatatggaaaaccgaagtgacagtacctttcctccttcagtgttgctaagaggactgaagagttatgcaatgtctgcttggcccacaataagtatgcagcaatgttacttttttccctttgtcttttaatcttcatattttatacacaagaaaactgagtccaaagaggtaaaattatatcatacagttagtagaaggtccagaactctgttatgctgccttcattatagtagtagaaagttgtatattataactagggctttggggaagggggcagtaaaccaggatagaaagtttggatctgtccagatcaatatgaagagtcagtggcttgagcctctaaacccaggagcaggcttgtttgtttgtttatttatttagagacagggtctcgctctgttgcccaggctggagtgcagtggtgtggtcatagctcactacagcctcaaactcctgggctcaagctgttctctcacctctaactccagagtagctaagactataggcatgcaccaccatgcctggctaattaaaaaaaatttttttagagatgaggtcttgctgtgttgcccaggctggtctcaaactcctgggctcaaacaatcctcccaccttggcctcccaaagtgctgggattacaggtgtgagccacagcacctggcctagagcaggatcttttgaaaatggatatgcaggcaaatgagtctaaaggtagtgatggaaatggaaggagcaaaagggacaggtaaaataaaaacagagtctaagttctgttgggtataggatcagaaattgtcaagaatcgggtagtgggctgggcacagtggctgacgcctgtaatcctagcactttgggaggccaaggtggatggatcacctgaggttaggagttcaagacctgcctgaccaatatagtgaaaccccgtctctactagaaatacaaaaattagccaggcgtggtggcgtgtgcctgtaatcccagctactcgggaggctgagacgggaattgcttgaacctgggaggcggaggttgcagtgacccgagattgcaccaccgcactccagcgggggcaacagagcgagactccatctcaaaaaaaaaaaaaaaaaaaagaatcaggtaatggagaggactggcatgaagggggcacaggactgtgaaaacctgagtgactctgtccttccctcatcctctatccctgaaccaggtcagacatagatggaatcagagcaggagttggtgttgatgtggtttcaggtccacctatcagagtttgagagatttaggccatgaaccattatgaatatagatgagaacctttgtaattgctgaaggaggtagtagtgcaggcaagtcctgtgtgcaagacctgctgctcccagttagtacggacccctgtgacattcacagaagttcagaatgtctgagatgctctgcaggctaccttatctccgtctgcagctacacctccagtgatcacaatcagtgctacgctggcacagccagcctggccctgctctggattggaggcatcctcaagggctgcttgctgtggaagcagtttcgctggaccgagaggagccactggaattttgggtactgggccttagggtcacccgggaatgggaatggctgctgtgtggccctgtttgccagagggggccattggtgatgagccccatgcaagtggcatctgcccttcacctgctccttctaagccagcgggatggagaccctccagagagaatatgtgagttcctctccttatgagagccgtggtatgggcattgagatgactgacttgtcaaattagttcggaaagatttttgacaactactacaagatcataatgtacttgaacaaaaacctgtgatatgtgttatttgtttgtttttagatattggagaagggaataaattttagcaagtaaaaacttttttatgccttcacgtcttttctaagacttaattttaagaatatcagaacctggattaaggtttacttctggtgactaacccagttagtctatcacagattcactgtttagattgttatcagaccttggttccagcatgggttcatatcttacaatacacagaaccagttccttgggtataactgatctcgtttcctagttggatgactaaattccacaccaaacgatctcttgacctccaggtcacatgctggccggtggcccttttgcatgagagattgaaatttgtacatccatatgttagcatatatatggttagcgacttgctttagcattttaatcctatgcttcataaagcctgccacagaggatgtggcgctttgggtttcattctccacaagtcacagagaatagttatcagatctatattcactcagcaaggacttgagtttttctggcatgatgtgcacagtaccagggcagagaaggctgctgccctcagggagctccaggccagcaggaagtaccgctcggaccccttgtccttggcagagggtgagagccatcttgagactagagcagtcaatgcaagtgacttgttttcatgccatagaactacagctgtgggttcattctcaggtaaggatttggaagaagcaaactaaaggcaacatatccaggctgtgggagccacgctcaatcaacagcatggtttacaactcaaaagtcacactccaccagaggccttctcagtgtcatggcctgcatgaacaaaccacagacctccagctcacatgcacactgcaacaaggactggcatccttcatccatgtttagagggtgtatatggagcatattaccaagtaggatttccccgtgtggctggtggaatccctcatttccacgtaaccatacttcacacatgtacgcatgtaaaggcccacttgcaaactaggagaaataatttttgcaggagaagagagcagctcgttgattcataagtttttatgaagactcacaccagacttgtggaggtaaagcaagtgtgggcctatagggatcatgccagtggaaacgctaagggcggcgagacacccttctggacttgagtggctggggcccgctgtgagcgggagctgttgttgatctgggcaggattacacgtgtctgtgaggcagacatttagagacaagccttagtggaaactgccaggagtgggcaggaagggagctgtccaggaagggcagctggggttgagttggatggtggtgtcactcgccctcactgacaccagcctgatgggtctgaagaaggtctgtcacagtcagttgcaaggcagggcaatagatgaatgattttgaaccaggtgggaggtatcaggtgaacgctgagaggcagggacaagtattaggaacagtagtagcatctggttgtttctgcagtcatttgtaaatatgacctaataaatactgtttctacagtcatttgtaaatgtaaacctaattctcatctctgggaagctttggaacagaaatcagttatccgatgtgtatttaactagaagcctgtgtgagacttcagaagaatctcctgatccaatgctctggttacatccctatccttcatccttatggaaatctgggatgtttttaggcattaacttccatttattaccatatgtgattgcagattccgggtcagtgttccccatggcctgttattccatggtcttgatagcaacataattgtgcaaatggtcaaatgaagatgggagcaaagatttccccttttaattctacccctagcaactttgctgacgttgtgctcagagaattcctgaaaagtattccagcatttgaggacatttgcggcaagcgatcctggcagttggggcagtggggtggtgtattagtcagggttctctagagggacagagctaataggatggatatataggagtttattaaggagcattaactcacaccatcaaaaggacccaaagtaggccatctgcaaactgaggagcaagaaagccagtccgagtcccaacgctgaaggacttggagtctgatgttcgagggcaggaagcatccagcacgggagaaagatgtaggctgggaggctaagccagtctagtcttttcaaattcctctgcctgcttttaattttggccatgctggcagctgattagattgtgcccacccagattaagggtgggtctgcctttcccagcccactgactcaaatgttaatctcctttggcaacaccctcaacagacacatccaggatcaatacttcatatccttcgatctaatcaagttgacactcagtattaaccagcatagctgggatggagagactatgcttagagggggtgtttttatttagaaatgttattctggcagggtgcaaacatcagcattttcatgccttgaggtaacttcagcaccttttctaaaacttaatgagcttcttaataacaagttatgaaaaaccttgctaaattacattttcttacaaatctacattacaggaaacaattgagttgctttctaagagactgtaagacctgtctgctgacttagggacgcttttaggtggctgaattaggtgggaaaagtgttagagctggtaatgagcagtggtggttgggtggggtggcctgcagggtgagaactgaaggcagagtttctgatctttatgccaagaccaggccacaggagtattaagtgcctggcttaggaatttaaagaaagaaagaggttgattgttatatttaaaaaactatttccgggctctctttacccaggaagaaaaagctaaaggtcactacagatacgtagggaatatgataaagcaggtctgaaaacacaatttgattttgtacaaatgatgtcgcttctcacaggcttcattaaacagagaacgtgtttgatgacagaaacgcataaaggacggaaatgcgtgctgtaatatttacttatgtttaaaaatagccagatggaaccaactggtgccaaatgaaaaatgaccagcgtaggctgtgtttcttgacaaaacaccttcagcacccattgtccaaaagctgaccaaaggtagtagatgggaatgtggctccctttgaactaggcagaagtgaagcagatgccttgtatattcaaatggttggcatgtaaatttctacgggcagtcctattttctggaacaatgtgtatttgtaggaatttggacattgtgacttcaaattttcttccctttcattgaggcgggtttgtggtcagctgattttttttctggtgatgagatgttttgcgaagtaccgtgtcagcctcctacccctacccccgtccctcttcagcaaatcctctgggatagtggggagccgggaagttggaaactggagatggactaggaatgaaaagaaaaaaggttctgagggttaggagcaagtgttgaaaaatcagaaaacccagccaggcacaggtgacctggaccccgcctcctcaaggatgaaggatgtctccacacacagacgaaggaggtgtgggcatgtttgggacctgcctgtgaaccgccaagcaaaccttgacgtacctggatgtctcattgagctaggttcgaagctctgctccactatgtggtggacatgggactgagaagggaagcagcccccccaagtctgagcttcctcatctggagaggggctggcctttagcaggctccatacacattcactcacctcccatctttcctgcatgccagtgtcaggatagttctgcccttctgtgctcagctgggaggaaaggatcttgggaagtcagctagttcagtagtgagtacgaatagtgagcgtgaggcctcattgttaccttgtgacatttacagttcactgtattggggggaatctgggaattttaaaaatatctgtccattgtcatttagaaattattgtggagggggagttgcccaggggctggcctttaaaagacctagtgtaatatatcaaagatgtagtctgctagatatgagaattgatggccagagttcctctctgaaaggtcactggatggaaaagtagttttgtgtctttacaaaaagaagcacatgatggagttctgagcaggctaagatgcgtgtaaaatgtaaatgctgagaaggacgcggttggcgctctgtatccgtggattaaaaatattccatggaaataaatggatggtattgtctattgaacattgccagacattttttccttgtcattattccctgaacaatacggtataacagctacttatttacatcatattaggtattgtgagtaatatagagaccatttagagtatacagaaagatgtgcataggttatatgcaaatactatgccattttatatcagggacttgagcatctggatttgggtatcctgaaggggaacagctgtatagaccacatgttaggtattagaaggaacaaaaaggaatcatttttacccccggactgtggttctacatgctcctttgcaccctagagatggatcccgcattagaacccagccacgtctttggcagtctctttagaagttacttggctctgcctctcccccttctactccttgccctcctctctctcactctcccttctcactttcgccctgcgtccacctccctatccctctcctgcataaacagtagcaacacaaggggcatttaactgctatggctggcagatgcccatttggagatggagatgaatgagtctatgagtggtaaagcttgggcttctctacccctaagaaatcctcaacggcatcatttgcttttgcacttaaataggagagtggcacaaaataactggccatcgcgttcctgttagtcaaatattggtgagagttctggcctcggaaacctttgatatgcagatgttcacggttttcctgcccttcctgcccccaagggggacttgaacttgtttcctaattcagcccttgtggggagactgacctcaggaggaacctgagcttgtagagatgttgcggaatatactcatgaccaccgatttcactgtagtgggtttgactcactatcttttttttttttttttttaactgggaacactatgtaaccacattaaagaggtctatagcaggaggaataaaagactcctaaagcctgctgactcactggctcatgactgatttcctacacattcagctggggttgtctgctttgcttgccctgtttcttgagcccaagcgacccacacacactgcctgctgatcagtaggttatgtcagaaggccgtaagggccaaatttaagctatttttcatttaaataggcgtccctagaaatagctacgtggacttacctaatatagtatttaagtccccagcttttgaagtgattctgtcttgtaaaacctacaagcatttcagactccaattgttacagctttgcttcccagcactcagcttgcaaccccttgcttgtgtagatataactaaggttgctaacacccttttttaaatatagcatttctgttcaaaaaatagcaacactgggccaggcgcagtggctcacacctgtcatcccaatactttgggaggcctaggcggaaggatcccttgagcccaggagtttgagaccagcctgggcaacatagtgagaccttgcctctacaaataataaacagattagccaagcaaggtggcacgtgtctgtggtttcagctactcaggaggctaagtgcgaggattgcttgagctcagtcagacggttgagacggcagtgagctctgataatgccactgaactctagcctgggcgacagagcctgcccctgtttcgggaaaaaaaaataattcattattagaatgtgtggtcttttcatagagccacagattttgaagcacagatcctaatgttttgtgcccttccccttcttattcaaccccctttcttgaaattacagttatgtctgacaactgagtgacagtgtgaccttttatcccgtatcatcgagccttcaattagtgtctccttttgacagatgtctcatttactgcttcattttcaagcttttctcattattctaattgctaattggggtaataataaatatcttgccccaggttacatgtcaagatgttgctttattggggatatcattcacttctttaactttgatttagcttgtttgcctccatgtttctcggattccagaagattatacaccaccaaaaacttaaacctaactaaaaaattatttagctaaaagtttgttataaaatggtcctccagagcagtggttctcaaaataaaatttgggacattgaccaaggtggttgacctgtcttgaagggatatggtctctgtatgtccaaagctaaacttcatctcttttctgaagcctacccccagtacccagtcttctatttgattaaaggggacagtttttcttctcagccctccttctttctgcttacaccccattacctgttaaatcctgttcctgagtgctgcagcacgcccagtgccttggtccttcccggctcccaactcccactgccctatccaggtctgtaggagttggtttctccccagtctcttccctccctcctgttccacacactgcttacgcttcttgtagatttctttctaacccattagcccatcctcaccacttccctgctgaaaacttccctgctggaaacctgctgtccctaggaaggtgcttctcaaactttagcatcccctggagggcttcttaaagcacagattgctggatcgcatccccagagtttcggattcagcaggtctggtgtgatttgctttcctaaccagtgccaggtgttccgcagagcacactttgagaagcttggctctagaatgagcctgtgcacctgagatttcaggcttgcttctgtctgttcatcctgactctccctgcactcttctgctcagccagggttccctggagtccctgtggtcacttagagacaagacgtgggctccttcagaacaagcttgtgtcttgttcaccttatccccatctgcccattcacagctaggggaactcctctgcagagtgcagaaagtggtgttgcttttgaagagagagcactgaaaaagaccatgaatgcatttctgttgtgtcaagaggtatagaaggcacctttgtaagcagagcatcgtgaggacctccctgtgggcggccaggccacctgcatgtctaggccatgctgagacaaccacacttcaccatcatacttggtacttttcttatctcttttcacaccctctcattcttcctgttttctctcattttgtcctttccccctttctcttcctaccttagccttggtgccttcggtgtgtttggtggcttcatgggttgaaaaggcttctgatattcactacaaagccacaaaattgcttctgaatttcaggctatttgttggagtcaagactgaggtgatggaggacttgtactgtagttagagcatgttatcgggtgcacaagtaatattctacacaatcatattttacaggaaagttcctctttaacaaaaaataaccctggaagtggactcatgatgtctccattttacagaaaagaaaacagactcagcgattaagtaacaataatgcgtgacactaagcaaagatattctcccattcttatgcacacagagaataacgtttttgcttcataaagtagtgtgctgtagttagtaagcatgtttggaatcacagccataggtgttagaaagtttctgccgagagagaagacattgtgatgattaaaagatatggttaggtcatatttactccagaaaactattagcagtttgggatcaagagtgaaatacacacatgtagcacacagtagatattgacagaatgtctataaatgtataagcataaaaaaaagactgggaggaatttaccaaactactaatagtcatcatttttccttgatatacttctgtatcacttaaatgtttttaaacagtatatacattataacttaagggtggacaaaaagcaaaagagcttgtaggaagagaaatggataatcctaataaaaatagaagagtccatggaaacagatcaggcagtcatccccttctaaagggtctccctgtgagttcatcccctggcacccatccacttcctcctcagcgcggccctcctcagcctgccgccctactctgagacctagcttttccacacttctttttggtgtctcctgttttgtttcatcacaccttaagccagaaacgatctcttccacttttggacagctctctcctcttggtaccagaggttatcatatcacagtctaatttctccaagggtttccagactgttgtaaaagtgaaggcccctctctgaaattaaaaaaaaaaaaaaaggtaggctctaacgtcatagtcactgagcttttatttatcagtctctaaagactgctttttggctttctgtggatgtctggatgccttacagtgtcctttggccccagaggactcagcagctcacattggagacctgctacctgtaaagactactgctgctactgtgggaggctaggccctgccgccttatccatcattaggagttcttgcacatagcaaatatactcaggaagctaacagatgaagacgacttagagaaaggtgcacagcgatgtcaaatctgcacacctataaatgttgcacctaaaactaataaagacctgtgtctgcacatgcatatgttttgtagctgatgattttaactgttagagatgctatgcaagaaagtgaagtttctaacagatgatattgcgcttggtgaggagataaaatagtggaaatagtctcaaaaagaatataggtaacattttagaagtataaccaaatggggtttcatttccaccagagctgaacaggatcagtcctctgtgctgtggatggcagtggcttgagaactgtcaatgtgtgtagtggtggcagtttgtggctcttctcttgctctctttggccttatccggcaggaccagcacttgtaggtctgtaaacctgttttctctcttcaggcatctttctgacttagccgtggttccccgaagcctgtgtttacctccaggcgaatgattggtttacatcagcacatcttgcactgcagtctttcagcactcactcactgggcagctgttccgcaggtggccgcctagaggggtgcggataccacaggggcatattagactttatatttaatttttaagcattttattttttaatggacaaatacaaattatgtgtatttatggtgtataataggaacgagttcaggacatctatttttaataaaaatggtgaccatgttcactattagttggtgactgtagttaataacaatgtaccatatacctgaaattactaagagaatagattttaagtgttctcactacagataagtgacaagaatgtaaaggaatggatatgttaattagcttgatttagccattccacagtgcatagatgtttcactgccttctaacctgcccccctttcttttttgatagggtagtggtggtgcacgaagatccgcactacttgacagcgacgagcccttggtgtatttctatgatgatgtcacaacattatacgaaggtttccagaggggaatacaggtgtcaagtaagcattttcctgcatttgcgtggctcccgctcgccgtgtttcatgaagaacgagtggcctttcagaaatgcacatttgctcctatctttcgcctccttaggatcgctcaggcccctctgtgtccactgtaactttcccagagtcggtcccaaagctcactggaccctctagatgttccctgtggccctgggggctccatggtcaaatatgtgagtgtcacatcctgtattttatggtgagtcacatgttacaccagtgcacaataggctctgacgtttcctgcaataaagaggtctgttgaactgggcccaatccggcatttttcatgcttacttgaccatgagacccatattttgagaaagaaatactgacatcccaggatggcagtgttctgttaaagatacttgggaaatgttggctcatgggattacccttaattattaactgtagtgtaagaaaccctgtgatatccagcatacctcctttccagcctctgtccctcccaggcctcctgtatagggccctcaggtcatactgaacttcctgcagagccacgactacctctgctctctcccagccctgaggctttgtgcagttctattttgctttttagaaatggggtcttgctatgttgcccaggctggactcaaacttctgacctcaagtgagtctcctgcctcagcctcccaaagcactgggactacaggtgtgagccaccatgcccagacttgtgcacttttttttttctttggacggagttttgctcttgttgcccaggctggagtgcaatggcatgatcttggctcaccgcagcctacacctcctgggttcaagtgattctcctgcctcagcctcctgagtagctgggattacaggcatgcaccaccacgcccagctaattttgtattttttaatagagatggggtttctccatgttggtcaggctggtctcaaactcctaatctcaggtgatccacccacctcggcctcccaaagtgctggaattacaggcgcgagtcaccatgcccggccatgcacttttttttcttgatcataaagcctctttctacccccagcctgggtgcttgatgtattctttaatcttacaaaactcactgcatttcaccttttctctaaaaccttcctagtctatcattttcatcccctacctctgagtgaagcatttcttcccttttccctcccagcatgttatattccttctgcataactcctgatggcacagaggtgttcacctggcattctgcccccctagcccgagctccttgagaacagggtggttatcagtcatctcttttcacagcactgacagtgcctggcacacagtgagcgccccactaatgcatcctcagtgaaggagggagtacctctggtttctccacccctctttctattttagccacttcatttttgcttataccaggtacttgtctaaaaatggtcttggaatctgtgctttgttatttaaatcctctgatgcttagcttttatttgggccactgctagctacattgtaatctttttacggtcaggaaccatgtggtattgctggctctatccctcatgataggttgcatgtaatatgcactcaagaagtgcctattggccgggcatggtggctcacacctgtaatcccagcactttgggaggccaaggcgggcaggtcacgaggtcaggagttcgagaccagcctgaccaacatggtgaaactccgtctctactaaaaatacaaaagttagctgggcatggtggtgcatgtctgtaacccccgctactcaggaggctgaggcaggagaatcgcttgaaccggagaggtggaggttgcagtgagccaggattgcaccattgtactccagcctgggtgacacagcgagactccgtctcaaaaaaaaaaaaaaaaaaagaaagtgcctattgttttttacttgacactggtaacattggatgtctcagcttggcgagtttgtcccagtgttcccatagcacgtgcattaagccctattacaaaggaaaagcaagcttacttgtgtattatttaatttatgaacattctcaaagttggtgtcaaggtcagggtttgtctgtgatagtaaatatccatcaggtggatcagcctaacatatggcacatgaaacagtgtgtgtgtgtgtgtgtgtgtgtgtgtgtgtgtgtgtgtgctttgccaccaccacagagcacatatacggtaagtcctcagttaatgtctttgatgggttcttggaaactgtaacttgaaaaccactataatgaaaccagtttttcccataggctaattgatacgaacaggagttacattcccacagcgtatttctagtcacaaaaacatcaccaaacttctaaataaagaccacgcttcttatgttaaacatgaaataaatgtgagcgatacagacatttaggaacaattgataaaaataagatatttacctgtttattccagttaagggtcgtgggcggctggagcccatctgggcagctcaggatgtcaggtgggaactgccctggccaggacaccctcccatcgtagggagactcatactcacacccactcacactcacacactcactccgctcacccacactcactaggaccgtagagatgcaccagttcacctcacaggcacagctttgggatgtgggaggaacccagagttcccaggaaaaaccacatagatgtgaggagaacgtgcaaatgaaatgccgttatttgaggacctgctgtatacatgtaaatgtatatacattcatcgaggagcatggtgacttactttatgcttttgactctcctctgatctgaagacaagtcacataacttttctttggtcgcttgctccccctggaaaatgaaagtccttttatggatgtgtcagagaaggtgaaggaaagtatgtccagtcttcttgatctgtactcattgaagggagctgctttgcaggtctcgatttgcttccttcccccccccccccccgcccccgcccaggaggatctttttattctaagctttgattttcttaggctactgtagaattaaactgaaacaaaagagcaagacccagcacttggataaggggtcagaagtttgttgaatgatagaagcagcccgcctagagtttttaaacctagtactttaaaactgcaccaaggaagccatttataaagattgagctccctgcttctcagtggctctcatctctagctgcacttttgtgccatcggggagcttctaaaaaatactgaggcccaggccccatccctattcaactgaataaaaaattctagagcctgggtatagtagaacctggtatagtatcaagttcccctggtgagcctgcagcttaacggctagttctggagctggagctggcatatgttttctgtaaaaagcctggtagtaaatatttttggctttggtgccatatggtcttggttgcaactactcaactgcagcctcacacagaacaaaaatgaatgagtgtggctgtgtgccactatcactgtgtctacaaaaacagccagtgggcctgatttggcccttggctgcagtgcgcccgtctctgtttttgaggaataaaatcgcatcatttcatatggctaatgcaatttttttcccatctggaagcaacatctgattggactcatcttgtatggtgcttgttacagtctctgtaaatgggagagggtccgagaatagctcttcctgttttcatcaggactgtttttagggatggcaaagaagtcagtgtgtccagcctgtgtcctcctcagccacgtggctgattcctgaatctgcatgtgcagcacactgccgttgtctggggcatgatctgtgtgatggggccagccctgccttccatcctacttccttaggtcctcatgtcaaatcagagcctcctcacgaacactcagacctaatatgctaaagccagatgcactatggtccccttttgcttctttgaaacctgaataggaatcgggaaacatctcggtatttcctaacttttgcttcccagataccgcttcacgtcacctcattttgcatcttttctttgtttttgtttttctgcaatcatgacttcacccatgtaactaggattccaggtaattcttgatacctttggtcatcaaaatttggacacataaagaattatattttcctttccgtattctgaattagaatgctttagacttcttgaaaagttttgatgaatacctcttctgaaaaggtatctgtttaccactacagcaggttctctttaccactcatctgctgactcctggtctaaaccagtagggtgttaaagaggaatcacaaattaagtgcccttaagagttggatattgccttttctcccctctgtccccctctcctgccccacttaaacaaaacagaaataaacaagcaaagaaaaaatcagaccaaaactgagggagaaaacatttccaatctgaagccaccatttcttatctgaggactaaagtagagtctagctgatgtttagtattagagtgcggttgggatacaaattaaaatctaggaatatttatgtacgttcagcccatctgttgttttttctctttttttagataatggcccttgtttaggctctcggaaaccagaccaaccctatgaatggctttcatataaacaggtgagtttgtatgagacaggctctgtggactcctcttgcaagcaggggtgcttctgtatgtgcattcttggagccggaaggtttctccagagtgtatgtgctggaccagctcagagccttgccgtaagcatggggcatccaaggagaaacttgacacaaaggtttggggagaacaagttaaggaatttaacaggtggttcaaagcattgtatttcaaagctgatgtggatacattgtgaagtcaagtataatttttaagataaaattctagaaactctcccggtccccctggcggcatagcattatttctctccacttgaggggtactagaaaaactcagaagctggaacgtgggaatacatcttcatttcacagatgaggaggacctgtctcaggaaaagaggtgactcacccaaggttatagctggttagtggcagaaccaggaccagaagcaaggcctgcagcctcttgtgtaggctttcctagtgcatgctgctgaccctcaaagctgtccttggccaactcaccacctgtgtgacacttacccccaggcagctgtagggaggaacacagatgttcggggaaggcacttgtgttactgtataagcacaaaggaagctgggatctgagtatggtggcccttgtcggtctctagtccccacccatcaacggctacagctgttgaaacagcggctcatgagtggcagtagcagtgcaggaagacgttgctgtttatttttatttttatcatgattacaatgaatgtgggtgccacagctcttccccagtccacacggcaccccggaacaggcacgtgctccagacaggccagctctgctgcctgctgcttccacacagctgtccaggaaaggctcccgtccctggccccccttctcctgctctcggggcaggtaatcatgcggattcatgaatacaaatgcacttcctccttctgggttttgtgtgaagggcagcttaggagctggtgtatttggggtgcgtctgtggaagggatcgttctctgcagcctcggagccacactcctgcagtagtgcttgttggttcttctcagactgaagtgcatgatttctccccgtccgtcctctggggtcgacaggatgcagaaggctttgcttgagaggtgttcatctgtctctcaagagaaggggaagcaacttctcacacctcccctgtagaaggagctaggggcagtatctcacatgattggaaggatttcccatttttattctgtcctgtcagagccaaatagtagtttcttgcacaaatagtagtttccaggatccctcattttcacaagtgtaagaacagcctgtgtgtgttgaacatgtgtgtgttgtgtgtgatggtcctgaggcatcatggaatcctctgtgcctcctgggttacttctgttgtttagtggctggaagagagaagacacgtccattgcagataggcgttttcaaggcagattgaaaatcactggggtttctgaaggtgtgaatctatgacttgcacacttcatttggaagcaggtgaagatacaaaactgaagccaactttggatttgtacattcaaatctttttttttttttcagtcatccaatgaatatgaccttttggtggctaggaatgccttaaagggttgtttttttttttttaagaatgtatgaccgatctagaaatataaatgtgcgtgtattattcaatcatatttaccagctatatagcatccaattgcaggcttttctcaggctctgattccttaaatgcaaccaagacttttgaactcgtctgtgaaggagagagtagtaatgagcctgtttgtgtcatcctattgtcaccttaccacgatcagtctgttccccataggcagggccaggatggtgccaaggcccagaaccagtagggttccaggccaggagtaggtatggtcttatttcctacgggtatgggtgtgctttaagagtactcttgagaatttgcgaactgagaataaagaaaataactccaggccaggcacggtatggctcacgcctataatcccagcactttgggaggccgacgggggcagatcacctgaggtcaggagttcaagaccagcctggccaacatggcaaaaccctgtctttactgaaaaatacaaaaatcagctgagtgtggtggcaggtgcctgtaatcccagctattctggaggctgaggcagggagaatttcttgaacccgtgaggaggaagttgcagtgagccaagaccatgcccttgtactccagcttgggcaacagagtgagactatgtctcaaaaagaaaaaaaaagaaagaaacaaagaaaagaaaaaggaaaagaaaataactgcaaagtttaagattttttaaaaattttagtttatttggggtaggaacagggagaggataggataaccctgctgaattttgcaaacctatcaatttttacttagttattataatatgcatttttatatttacatgtgttgcttatcattgtaatattgtcctaagtttgatagttttcataattataatatttactatgtagcattttcttagtgatttaccatcatttacttaatcatccagccatgattaggttttttaccctagagatttttgatgcaataattttgaaatatttgcatattgtttatatgtaggcttttttttttttttttttttttttgagatggagtctcgcctgtcacccaggctggagtgcggtggggtgatctcagtgcactgcagactccgcctcctgggttcaagcaattctgcctcagcctcctgagtagctgggattacagtttcacgccaccatgcctggctaattttttattttcagtagagacggggttttaccatgttggccaggctggcctcgaactccctcaagtgatctgcctgcctcggcctcccaaagtgctgggattataggcgtgaaccaccgtgcctggcctgtatgtaggcttttaaaaacctcctcctgagtttgaattgtttcctaagaatacgttctcaagaatggaactgtagaacttaaggataagagcttgctcttattttttataggtctctcaaaagttgctgtttctgtgtttataccaaataaacaagttttggctgctttataaataaaacaaatccatctctctatcatttttaaaattgtataaaactaaaatagaaaaaaatgtataaatagccctgccatataattgtctgtgacctgcagccattgggataagattaattttctttgcagaaggaaccctgcggtcagttctcttaattctgatttcttgtgaataaaaccttgtgttttaccaaaaaatctatcaataaaggaatacctgcatgttccctctccgtttctgtgtgcagcattgcttgctggctgagatacaagcctgccgtctggtcagctttgtttctggagttggggcccaatgctgcttctgactttttcctctccattttaggttgcagaattgtcggagtgcataggctcagcactgatccagaagggcttcaagactgccccagatcagttcattggcatctttgctcaaaatagacctgaggtatgaaccagtaggtacttgctatgcatgattttgagaattctcagatataagagcctaacttctgctagagaccagattttgtagtctgatttctactaaaagtatagctttacgttacaccttagaaagttacacatatgaaaacctcaaccagggccgctgggcacagtggctcacgcctgtaatcccagcactttgtgaggccaaggcgggtgggtcaccagaggtcgggagttccagaccagcctgaccaacatggagaaaccccatctctactaaaaatacaaaattagccaggcctggtggcacacatctgtaatcccagctactcgggaggctgaggcaggagaatcgcttgaatccgggaggcagaggttgcggtgagccaagattgtgccattgcactccagcctgggcaacaagagcgaaactccgtctcaaaaaaaaaaaaaaagaaaggaaaacctgaaccagggccttttaatcgcctttaagagaaaaaagaaatcacttttttggggggattattttagtttttttaaaccaggttcccaaataaaatccttagaacagataactaacaaaggagtctttttactttaagagtcacctctgtggttagaaaaatggcattaataagttatagagagactcagatacatttttgtcaatagcaggttcctttttttcctttctgaaaggtatgaggctttccctctggttggtttctagagtttaaaataccatgggtgatggggacagtactcactgctagccagccttcctttgggcagtctgtcattggtggtctaagcccagcacggtttctgtaaaccagtgtgtaaaagtgtgttagtccattttcatgctgctgataaagacatacctgagactgggaacaaaaagaggtttaattggacttgcagtttcacatggctgggggggcctcagaatcatggcaggaggtgaaaggcacttcttacatggtggcggcaagagaaaatgcggaagaagcaaaagcagaaacccctgataaacccatcagatctcatgaaacttactatcacaaaaatagcatgggaaagaccagcccccatgattcaattacctcccccagggtccctcccacaacacgtgggaattctgggagatacaattcaagttgagatttgggtggggacacagccaaaacatatcagaaactgagtttaaatgagcagctcttttggaagtattgcttatggtatgactcaatagattagtagatctagctggcttagaaaaatggaagcatctggcttgaagaaatcgaatttattcttatacctgcttgtgtccagaagacatgctgactcaatccctgtgctactgacttttttttttttatataaataaagatggcttcttagagttttgtggtctttcaaggggaaaacagcattctccacagctggactgtgactgggcttgtagaatttagtttttttcatcccaaatgaacacatcaaaatgtttgttttgatggaattttatcatgaatctagaactgcaaaacaaataagaaataggttccttcctgtatttatgagttcattcaacaaatgtttgctgagcacccactatatgtcagacactgtgttggggtgccaaagcacagtgactcggcctctcttcctgaggtaccacgtaaggcaagacagacctaaacaccggtgctttctctgtcaagtggtaagtgtgggcgcagggcagaaggattatgggagctcagtcaaggagggctccctggaggtggcacctgagtagaatcttgaaggaaataggggcggggaggccaagggaatgcccacgttcacacctgtgtctgggagtggagcattttcatgtggtggagtggcaggaaagacagccttcctcatgcgtcacatgtgcctaaggagctgggacctgatttctatgttgttggctgaaaattccttctgggaaaaaaccgaaactcagaagcctagttccaggccaagtggatgtgagtgggttgtgcccccttcccccggctgtgcctttttctgtcctgtgtgtcagagttctgcagatgatttcattagaaaggtgcagccggaggcagtggggtacccctgggtatggtagtgaaagagtgatctttcacctttgtccagtaggtagggcagtggctatgtggccagtgccttcagacacatcttactgcatcttgcatgtggcagtgtggccagttattgtctcacttctttcctgcacttttctagagggattttatcaaaacagttttgctgctagacaaggtacttcttcccctattccagggcatacagtgccctgctgccagaggggtcttccttgagccccacagccgctgttttgctgagaaactctcagtggctgctccgtgctctccagccagaaccatctgtgccagtcagatcgctctcactacccctgcttttgatcctgccatcccctctgttagcatctccctgcctccctctgtctctgtctctctctctctctttctttctctttccaaaggcaatctcagttacaccctcccagtagcatctgtagctaccttggccgatggtgggctttcttatctctgggtcagtccctgtctgataattattgctaattatcttttaacatatttgcctcaattcttcaggcggattttaatttatctttctttctctctttctctcctttcctttccttccttttttcttttctttctcaatctctcctctttctctctctgtcctctcatctttctttctctctctctctttccttccttccctccctccctccctctctttgtacatgcatacatacatacatacaggatctcactctgtcacccaggctggagtgcactggtgtgatcacagctcactgcagcctcaacctcctgggttcaagcaatcctcccgcctcagcctctcaagtagctgcgacatggtgtgtgccaccatgtccagataacttttgtagaggcagggttttgccatgtttcccaggctggtcttgaactcctgggctcaactgattcccccaaccttggcctcccaaagtgctgggatcactggtgtgagtcagtgtgcctggccttaatttctttttaagaagggggcatgtgttttgttctcattctgaatcccttatagcacctggcacagagtagtagctaacacagatgttaattttgctgcgtcaaatgttttcactttgaatctctcttgagtattgttctccttattgattacatgatgacatcctgttttctctccctgacctttactgtttgtttagtgggtgattattgaacaaggatgctttgcttattcgatggtgatcgttccactttatgatacccttggaaatgaagccatcacgtacatagtcaacaaaggtacgtctgtgatctttgcctggattattggcatagttattggttaggttcagtgactttacatttgcttacatttgatttgacaaagattttacatgtaaatatatatctacctttttattcaaagaatgtagtacttcaagtatccttgtgctggatatgacagagtgaatcttttaacatcccagagcttattcttcattgtatctcttcatttacagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggtgagtgccctgcctccttcccttctctgaaggctttccctggggccgtgttggctcacacgtgctatccagtgctatctagtgctatggtgcagtcccagcgctggccggttgcctccgcaacccatgaaagagagcagaaacttctgtctcattgctggaaaaaggattctacatgtgtgcccagtgttaacacatcacaccttacccaagtgctttcagcactccaatatttattccagagcactgacaagctgtgcccggaaatgccagaaatgggaattacagcttcaggcaggtggaactttcagtttctgtgtctcctttgggctttaatgccttttacttactaatttgtctctaatgccaagccaagtatagaaatcagcctcatcgttcttttccctggatggctcgtggagagtcttggtgaatttccaacatgcatgtttgatttggtttgttttcatattgactcttaagagtcataccaatcacaagtttaaaggcagccattccaggagaatgagcgtggtggtccatgctcagcttgggtgcttgatgtcagatgatataagaagttgatccccgtcagttggacttggattagagttccatccaaggaacatggccggaggaagatcttttcatatacatatcataacaagtcataggaaaacagagtcagtccttctctttctgaaggtgttagaaatatttttctgaaactgttatagataggattttaaatttttatgtgtagttttcctcctcctacaaagaatttgaggctataagtaaggatctgtagaacctttcctgaggaacccagtaggcacagggaagcgcgggtgttctaacagaaccttctctcttgtgcatgtgtgcgcccctgcccaactctctctctcagtagcatcgaacgtgattccgcaagtgctgacccgggtgcttccttgttgaattggggttttatagcttcttacctagtgtttccccacttctgtttttttacttttaaccctcttttactataatgtaatctctttttcccttaccttcccacagatgcaagaatttttctggtgttttttgactgctgtatgataaagaagtaatgttgaaatttaaaaattatttagttgattgaagattataatataaagtttatattaaaatattaatttatagaagacattgttttacacttacctgtttaatatgatctgtacttagtttttaaaaatattctgagcaaaaggtgaagagatcgccccactgcactgcagcctgggtgacagagcgagactccatctcaaaaaataataataattgcagtatttttcctaagtgatactgtaagagagatgtaaggctgtgaaacttttgtggcaacagtgcactaatttggataatgtttgttcccaataaattaagagccaaattgtatgtaactggtgctttattttatttaacatcagtttttgaagaattgggcatctccagaagttatgtaagaatttttaatagacaaatagaaatctggagctaataaaggttattttgaaaaaaatgtacagaattattgctttagcttttggctgacctctaattggatatattagttcctgttcttaatcggtggtctgtcactacatcatttaaaatgtaattaagattgaaaacttaatgtatgctgggcagaaactcactaagccctgagcacacccatctaatttccacgtgaattgaacatgttcaatggcgtgttcaatggcatgttcattccatatcctcattcaagctgttccatttgaataggaaaagaatataaatagttcatttgttaaaattaatagatattaaagtggccaccaagactgccctaatgcagtaaaccgaaccccatcagtggtagtgactggaagcctgccgctgggaaatgctgtccccgcgcaatgcttctgtcattcttaaccttcaagtccattcaggaaggagtcttagagggtctgctgtggcctgttttataattgggggctcccaaatcctatctccactctacgaggggagatatttgagcagatatttgagcctctccaaaatgcctagcatttcaatcgagcagagattgatttttcttcttcccagattgcagatgtcagttgtgcagaatgtgggggtgaggtagtgctgtgctctgatttgaggaacctacggagtatctgcagtatctcgttatggttaagaacagggctttattaaaggccctaataagaagtggaagtggggaccagaaatgcatggtaaagattttggctgctgtttttttaatacatcctatttcaaagaccagtcctaataccgtttatgtagttttatgtaagagaagaggtaactggaaaatggcttctcagaacaatgaataaatattttggttctggttaattaaaactgccatagtttctttaattagaaaattatgctgttttcgagccaggtgtgaatgaaccccacagtaaagccagctttaagtgactcgatgtgaccttatcctttacagttagaaaacgtttccatttaagactttttttctcttctaattaaggacctgggaagagccaacagacggaagcccaaggtaagcacaccgtgtcagaccctgctctgtcctctttgtagttttcaatatctagcctggtaccttgtggcttatagttctcttttctgttctgatttataccagctttttttttttttaatctttagcctccagcacctgaagatcttgcagtaatttgtttcacaagtggaactacaggtgagttttgagatagaattgcttctacatatggcagccattggtctggactctcccctacctcttttggatgacttatcagctaacagtagacggaccaaaagcagaagagaaggaagtggttcaagtgctgtcttcttgttgctctgtaagatcttctcagagtccaagagtgccggataattcctcaaacatttattgagggtgatattagattcacctgtcttcctaggacagactatatcggtggctcccaggaagaaaatttctggtttttcttctcttatgactacgtatataccctttaaaatgtgcccatattaataaaggtttttaaagataagtcagtgtaaggattgcaggttgcttaggaatttagtgttcaacatttggttttcacgatatatctaacagtagaggtgtctgaagccctaattatgtgaggtttctgggcctccttcatttctgtcattctttaactttgttctgcttcatatgtgctccacaggcaaccccaaaggagcaatggtcactcaccgaaacatagtgagcgattgttcagcttttgtgaaagcaacagaggtaactttttgggatgtcgtcatctttcctcattgattgacattagtccttgagaatgaaagtgctgaaggtgggcaccagtgtgttaggtccatgtggcatttagaaacgatgtgacatatgggtaaggtcagaactttaggcccaagtccaccttctctcttttttcactttgaacctaatcgccaacccttgccttatgataattaaggtgaattgacagatgaagttcactgcaacatttatatagagaaactctatttggatattgccctagaaacatgtccaagaaaggacagagaagagatggactctcttgtgtttttatccagcgtccctgtatttgggaaataatttattttaaattggcaatgatatgttaaaagtttttgaatgattattatctgttgtggtcagtgtgacttccattgcactagaagtagtaaagccttgcacttcagctaatttcccatgcttttaaagtttactatccagtgtcttagtctatccagtcacagcagggccccatctacattgggagttaggatgttgacatacgaatttagaagggggtgatgtgattcagtccataacaccaacagcctattccaaacttgccttttaaaaaggtgcttattgaaccatatgccttttccttatactcttttttacatttaacataattggcttttgcagtctctttggaagtattctgtagctctgatttttgtagcaggagcctgagcttaatggctttggggaatggacatgtttggtggctgcagaaaactgatctttgagggatcttgccacttactttacttggctcacactttccaaatgccctttttaaagatgtatactttctaaacagagttcaacatttagtaccttaccaaagtgaaattttaatttcctaattggccttcaaacaaaacttaaaatgcattggtggctcattgaggcaaatgattacagaactttgtttaaagtcagttacaatatcaaatcaattacaatatcagtatcttctcagctttgtaagatgtctaatcatgataatggacaatatttttgttctgagtcagaaagttgaaaagtatagatagaatggagtccgatttctcattatattaatataacaatttcatcctgagaagtactacttgggatgcctgtcagacttgaataaaatccagctgagattatagcatgctcagcccacatccagtgcttctggggctgctgtgtttgctcaggattgatgctttcatccattgtcacattattattaagggtgacccagctttaggaaaggaaggggcatggctcagaacttggtatatcatcccctaggtaacgacaatgccctcatttcttagttggtatgacagcagctgctcttgcacaccccctgttttggccagaattctttatgttaataacatgaatattctatacaaaccctcactgtgcctgccctaagtaaggcccattctgagggaaaccagatgtccaaacttaatctgtctgtggacccatcatgatcagcattttataggagagcaaattcctgggtgccagatctgaggttgcattaaacaaattgtgatatgtaaagtagggctttaaggtattaaaaatattgatcaaactcaaaatactctaaggaccttggaaatccaccttcttttatcttctttcctcctttcccttaacaacataaaatgcaattttatgttgaaatgggtcctgtatttcttaaggtaaaattgaacttgctgggtactaggatactgtagtgatgaaatactaactgattagagcatataatcccttaaccttccaatttgagcaaaattttccttgttttgattaaagccctgaagtggatttactttgtcatggggagtgacttccactttgtttgaataattaaagtattgcttttttttttgattcagagtctcactctgttgcccaggctggagtgcagtggtgcaatctcggcttactgcagcctccgcctccctgattcaagcaattctgctgcctcagcctcctgagtagctggaattacaggcatgtgccaccatgtctggctaatttttgtatttttagtagggatggggttttaccatgttggccaggctggtcttgaactcctgacctcaagtgatctgcctgccttggcctcccaaagtgctgggattacaggcgtgagccaccatgccccttgtttttcattttattctttggtgagaagaaattgcagaccataagcaaaagccgtttctcctcagtgttgaggtactatgtgctcagaaataaaatggaagtttactcagagtcttttttttttaattttattattattatactttaagttttagggtgcatgtgcacaacgtgcaggtgtgttacatatgtgtacatgtgccatgctggtgtgctgcacccataaacttgtcatttagcattaggtatatctcctaatgctatccctcccccctccccctaccccacaaccgtccctggtgtgcgatgttccccttcactgggagtcttaatgcttttctgccttgctggtgtctttgcttacagaatacagtcaatccttgcccagatgatactttgatatctttcttgcctctcgcccatatgtttgagagagttgtagaggtaggcatttaattttgttttccttgcttgtttgtgtatgttctgctaagttgttgtgttttacagaaagcacttcccttgagtgccagtgacacacacatttcatatttaccacttgctcacatttatgaacagttattgaaggtaagtgtggcgtgcggactgtcatccctatagagaattctctgctcagccccgttttagaaatggtgcagattatttgaaagaatataaattctttttctgagtatgaacaggatactggaatttaatcactcattttaaaattaggagttcagacttttgaaggatactaatgtggacatgagtccagaaaaaccaactataaaggtaaagtcattattaattcagttctacaaagcccagcgaggcttccgttctgtgagaagtctctatttttgattgtgcttgttcctaatgcacaagttggcttgcgactaattttttcagcaatattctaagtgcccttggagaaagaggatgatccttgagttgacctttgcctaggctccctgtaatcaactgtgtgactaattttaaaactgaccaagaaccaccttttttccttctttgacaattttggattttatgctgtaggaaaaaacaatgagcaccattcattcatttagtgagtagttactgagctctagctgtgtgccctctgctgtgttggagacagaggtgactatcagccgatgctttggatgacagctgccctgtcggatttgctcatcccaaaggatcgaaggcgattagatcccatctgccatctgttccttctacttcctgcacacctcagagtcttctgggtttataaagcaatctcacatgagttgctgtacctaacgagttttagaggtgtgcctagaaggcaggccacgctgaacaaaagctttctgagctgtaattgttaaacagtgaaccatggtgtacctttctcgtggtttctgcttctaagacagagaacatttgtacttcccttgtgtcatcttttgaatcttttctttttaaattttaaaataggcaaactgtcaggtccatatggcttgccagcatggtttgtactagacaggaaaaaaatcatgcagtgtattctagctgaatggcaagccactctggtattagataccctggtgtcacaaattcatcatacttggtggcctttcagaaacttctagttagattcaaacaaaagaaagtgagactttaacaaacttggactctaggcaagaagttaagtttttattttgagaataaattaaatgtaaagtttctggaaggctatatatatatatatatatatatatttgagacagagtctccctccgtggcccaggctggagagcagtggcacaatctcagcccactgcaatctccgcctcctgggttcaagcgattctccagcctcagcctcctgagtcgctgggactatgggcacccgccaccaagcccggctaatttttgttttagtagagatggggtttcaccgtaacgtggccaggctcgactggaactcctgacctcaagtgatccacctgcctcggcctcccaaagtgctgggattataggtgtaagccaccgcgcccagccactaaaaatatttagaatatgtaataccatgtcattcattgaacagatacttaccaccgcactaaaagagtagaacctctgtggtcatcactaaaaacaacatagcctggttttttactgagtcccatatcttcaggataaccaagagaaataccacatttccatgttgtacaatgactagtaaatgcacattttttttaagttacctatatttaggaaatttaagatttctggaaactggcctgaaatgctaaaactgaaatgttggatgttgtccatatgttgtgtaacccctgctgtggtgataaaatgtttgttttttccattacccctatagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgagtaagttccaagcagcgaagtcccaggactgagcactgacttggacgcaggggcttgggcttgaattgggctgtgccatgtgccatctgtatgaccctggacaatcctcccaatcttacagaacttcagtttactcatctgtaaagttagaatgcgtttacctctcagagtggctgataaggattataagagaaaatgcatgaacacactttgtaaaccatggtcacaacacaagcataatgtgggaggtcattttatttttacaataaacactttgagcctctgcttcctcatgtgtaacacggactgtttacctcttctctcctactgtttgtctccaaaagttgctaatgggatcacgtaagaatagtaactatgaaatggttttcttcattgtaaagctccttgcatggacatgtaaaacattacttaattggccacactgaaagaagtgactaagccacagcagagcccaagagaacaccagcccctctgcggtgggtatcattgcgtggaccgcacagccagggccaggcgcgaggggcatgagcaatctccagaaagagtgttcacttactctttattttgaggcaggacttttgttatctctcagaacgttcttatgtttttaatggttctttttaaaaggacaactttatcaacatataatactctgtataatttgctgatttaaagtgtgtaattcaaaggttttgagtactttcacagttctccagccatcactacaatcaattttagaacattttcatgacctccaagagaaacccttacctattctttatcagctccccgaccccctccacccttcagcatccgctcatctgtgtatttctctattctggacttttctgtggatggaatcatgccatatgtgctcctttgtgactggcgtctttcacaagcatccatgtagcacgtattagcacttcattccttttaacggccaaatagtattccactgtatgggtataacgcattttatttatccattccttttttttttttttttttgagacagggtctctctctctgtcatccaggctagagtgcagtggtgttatcatggctcactgcagcctccacctccagggctcaagcagtcctcccaccttagcctcctgagtagctgggaccgcaggcatgtgccaccatgcccggctaatttctgtattttttgtagagatggggtcttaccatgttggccacactggactcaaactcctgagctcaggagatctgcccacctcagcctcccaaagtgctgggaatacaagcgtgggccaccgcacctggcctacacattcctactcgatgggcatttggggatgtatgtgtccattgctcctgggtgtataccgaggtgtggaattgctgtcctgtgctgaccatgtggggccgttagaggaccggccaggctgtcagagcagctgtgccattttgtgttccccagctgtgtgtgagggttctgatttctccacactctttgactctggccatcctagtaggtgtgaaaactttctcatgtcttgcctcattagattttcggacaagcaaacaccacgctgaagcgatggctcttggactttgcctccaagaggaaagaagcagagcttcgcagcggcatcatcagaaacaacagcctgtgggaccggctgatcttccacaaagtacaggtaacacgtgactcacagccactgctcccatggaaaccgacttcgcttttcagagttctgggagggccttttttgtgagagggagagatgaaggtaagggagagaataacatgtttttgttaattctggcacacatttaaaaactaaggcaaagccattaaggaggcctcagtttctaagatcaatagtattgcagccatctagggggaaaaggagtcagggtagtggagcctttctcattctccattttgttgcgtttttccggaacaagcgtgtcactcttgaggtaatttttcaagcatgagtgataacgtgtaacaatatcatgccccccagaaggccagaattgtggtagttgccacagatctgcccagttgtgttctaattccctgaaatagcttctgcagaggtggggctgacttccatccccattgggagggaacagggcagtcacgggtggaaacaaaccgtagccctgtgctgccatcatgagggctgtgagttctccgtgtggcctccgtgtggtctgcagctatgggttagggaacggggtcccaagcaggcccccttggcggagaggccgccgacttccaggtgtgtaaccctcaccttctcccactctccctccctgaaagtcgagcctgggcggaagagtccggctgatggtgacaggagccgccccggtgtctgccactgtgctgacgttcctcagagcagccctgggctgtcaggtgaggtggatgtcacggcgcctgattctcccacactaggatgcccagtcctcttctgcaccaaaagtcatctgtactgtgtgtgtgtgtgtgtgttctttcttaattgacaagcgtatctatatttatggcgtaacaacatgatgttttgatgtatgtaatatgtaaacattgtggaatggctaaatgaagctaattaacatgtgtcttaccacccatacttttttttcccacgtggtgagaacacttggaatctaccctctgggcagttttcaagtatatgatacattgttgttagctctagtcaccacgtggtgctatggagctcttgaaccagttcctcctgatggagactttgtgtcctttcaccaacatcacccctatccttcccaccccctactttgtgtgtgtgtgttatgtttgtttggaagatatgttattattaggttgcttggagaagcaaccatatgtatattttttaccctaggcaggggaatgtgtgtgtctgccatttgttgaattttctctaggatcaggtgcaagacaacctttagaagcaggtatgcagctgtggaatgggtcacaggtgatgagcctacccgcacaccatgctgacaacctgtagtaaagggagaaaggaggatttggtggcagacggggcatgtgtggggtacatgtcctgtgaattggccaagggagttcactgctgctgggtggtgaccagtcacataggggttctccctcgcttggccactggaagttaaatagaaggtgtacctgggtgacggctggtgttggcgtaaagcacactggaccattgaatgaacttactgaacagaccatttgaaatgagatttcaccagtcagccatgacttgggagttagtgagacttcattgcttgtgcacttccagtaaaggtgtgattgtgctctccttaataatgttgcatctcttggtgccccagttttatgaaggatacggacagacagagtgcactgccgggtgctgcctgaccatgcctggagactggaccgcaggtatggctgtaggaggctcctttttggaattttgttattcatactgggttattggtatgtctggaattgggttaatcactgactggttcattaaccatcttaaacaaaagtgctatgtttctgatcattaggctctgggggcaaacactcttgtaagtcagggcactgtggggagaacacctcctgcaactgaggggtggcgctggggatctgactgtaaagctggtggcagcagagacttgcctagactctactagtgacatctgagaggggccctgtgttccagattgagagtgtctggcccaacagagcttcctagtaattgagtagggtctcgttatttgctggtcattttaaacaacaaatagttattgaatttgtactgtgtgctgtgctaggtgttgggactaccaataggaataaatacaagtcctttttctcaaaaagtcatttctcaaaaggaaaaaggaggaggacaaacaaaaataattgagcatctgtcatgggtaagcctctgtgatgggtgcttaggatgtacctaatgtcagtgtaaccccaacagtgtccctgtgagataagttctggtacttctcagaggaaattatagattgttgcttaagtaacacataaatgatgtatgagaatttacgcggcattatgctttggagccaggatttcaaccccggcctgactgcagagcttctgtgcttcctctgtgtcacctgagtagtaaattctacactgtgataaataaacttcccagcttatttggagtattataagtattagcaccatttagtaacatatattctagaacctagcactgtccactaacatcattgtcctggaattaacgcagacagtctgtgaatcttctttatggtatttgtttaatttttaacctcagtttccttaacagagaatttggaatactgatctctagaagctcaaattattaaaacataggaagaattatttgtgatatctaatgtgatatctaacatatctaatgtctgttgttgctgcttttggaaaagacagcccagtcttaacagcctttggcaagagagttaagttagctgtagaaataagcactgtcccgtcttagtaaaaactgtaagacatgcttcttcatacgcaaggaaataaaggccgtgttgatcagaaccaggtggtgcgtgaggtttgccaaagctgcatatgttctctcttcttacagagaacaggatgctaagaattctgtgtaagatgagtgcaagtaatgggtgggggcgatcggagggtggaagccgagtgaaggtttgagagaggctgcttccaggtgtttgtaggaaccttcacatagaggccaaattactcataaataactcagagcatcacacttggaaaaggtcctgaagacactaaatatgttcttccctagtctaagaatagactctcttaaattatactaggaagagaatggctgtaattgcagaaatcagaagtttatcccagccgtttttcttatgtggaatcctgtttgctatcaaaataatttgacctgaggttatgagtagttcccttaggaatgaccatttgcttatttaatatacaggccatgttggggccccgatgccgtgcaatttgataaaacttgttgatgtggaagaaatgaattacatggctgccgagggcgagggcgaggtgagtgaaaaccgtcagtcattttccctcgctgccatttcctgtgatcgctggcctttgcgaatgctgtggtatttcccaacagctcaataaagccattgaacttgacttcattggtgatcctggagtctgccaggcttctttctgagggtacatttatgttcagctctcggggagtgggcaggagggacactgatgcctgtcttcctctgccaggcctcatagggatttgggctggagagcctgcaaagaaaggcccggtggcctcagttcctgggacgaaggtcctgcctgttgattgccctgggtacctattagtgagctgctggctgctggatgggaagcctaattacttaaaagtgatttcatcccctgcggggctttccaacagctttgagccagaacctagggcaagcatttgccctacaaatcggccagagctgaggtaattcaggaagggaagtaggggcactggagatccctcgcagaccctggtggggctctggtaactccctctgcatcctggagtttagggcttccagctaaaggttggggcagacacacacgtacacacatgcacacaccagttttctctggaaaaaccccagtaaatgctgttcactgatgatcttcttttctttaggtgtgtgtgaaagggccaaatgtatttcagggctacttgaaggacccagcgaaaacagcagaagctttggacaaagacggctggttacacacaggggacattggaaaatggttaccagtaagttgccgcctcctcaggtcacaaacagttcagttccactgtggggaagaaaatgtcttatctactgtgcagctgccatgtggcagtggcaccctgaattttctctttcccttcctccttggtgagtggtatgatgtagactgttccatttcctgcaggggacagggttacacttagcatccttggttggattttcactttcacttcagcgaatatgttttgttctgatgcttttttgtttctttgttgtgtttttggggttttttttttttgagacggaatcatgttcttgtcacccaggctggctggagtgcaatggcgtgatctcggctcactgcaacctccacctctcgggttcaagtgattctcctgcctcagcctcccaagtatctaggattacaggtgcccaccaccacacctggctgatttttatatttttagtagagacggggtttcaccatgttggccaggctggtctcaaactcctgacctcaggtgatccacccgcctcagcctcccaaagtgctgggattacaggcgtgagccaccaccgcgcctggcccgttttgatgcttaacatcaattctggttgttgcttctcaaccggaatacaaagagacagtggcttttttacaatatccgtactgagccgtgatgttgaggcctcagttaaataagatctgggggaagttgtggtagacttccagcaatgtaggatgggtaaggatttgggaataaatgtgtttcttaggtttgtcatctcattaaaaatagggtgtttcacagattaggcgaactccttgaatttagttgaatgtagtctcagaaccatttactgtagagaaattctgaagagtctatcttaagagtgagaagcttgtgcaagaagcctgacctgtcctacctgttggtttgaccagtaatctgctgtttcgaagttattatgatgctgattgcaagccctaaaattacaaatataatttttattactgtgtattggcagattcttgtagattttaggtgcttatttctttggaatttgtattgattagaaaaatacctcccaaaattacttcagattttgcaatacccaaactatttagagctaaattaagtccccctcttccggttcaagagagattaaatgtcagttccaattctactgtggcactcacgaacacatcccatagtctctctggaccttggtttgctccttttgaaaatggagaactggtgtggaacaaaagaaccctagacactttctacagatgacttttggaggcatgagagtggccccggggtggggatggggtaaaagtgggactagggttttgcttacggcactactgggatgtggctggtctggtccagagatgctagagcacttccacagttgactcactcttcccaaagggccaagagcacccctccagacatcgaggaagaaaacaggaatttggcctttgtgtaggaaacatttcttgaactcttactctgtgcagagcactttggaaggaaaagttgtgttcctgctattaaggaacttgagtcacttggtgagccagatgtgtatgcgcctaattcagacaggaggctaaatgagccagcaaagccttgctagtgttgaccagtcagtggtgccaagtggtgacgctgaataagcacgggctctaggaccccttctctgtctctgcacttggccaaatagccttggacaagttcctcagtctctctaagcctttgttttcctctctgtaaaatgggatcataactgacctctgtgggatgttattagaattaatcaatagtgtgtattaaatacctttcagtgttgtactgggatccatcctggttggaaaccagccatcagcccattcataaccccctcccctctgatcaacagaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggtatgtgctttctgggtcttgaatcttgctgcatagacattgccattgcctggtactccaggggctttaaatgtgattggaagtttgagacgcctatcacttggctttcatgtctaatctgctagaatatcattgacctgttactgatttttgttgcttggcatttcctgctcaggaaaatttgttctctttaatttccacatttttattttacttagagaggtctgatgtaccaaggggaggttggataaacatactgggggacaggggcatgggtaatatatgtttccaattatgaaagaaaatattgacatgggttataagaaagtttacaattttcaaacatattaaacccagcctattgatgatatgcttcctaatcatttttgagcaaacggtggttgtgaaccaagaatactcaaagttgaaaatcaaaatcagtattgcagtgaaacatgtatggtatttgccaaaatgttggacagatgatgccaaggaagagaggatctggtttcctgaaaattaaccttttggaaagttgggtcaaatggtatttctagttctagatccctgaggaatcgccacactgacttccacaatggttgaactagtttacagtcccaccaacagtgtaaaagcgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctctacccactttttgatggggttgtttttttcttgtaaatttgtttcagttcattgtagattctggatattagccctttgtcagatgagtaggttgcaaaaattttctcccgttctgtaggttgcctgttcgctctgatggtagtttcttttgctgtgcagaagctgtttagtttaattagatcccatttgtcaattttggcttttgttgccactgcttttgatgttttagacatttgacccagcaatcccattactgggtatatacccaagagatttataaatcatgctgctattaaagacacatgcacacgtatgtttattgcagcactattcacaatagcaaagacttggaaccaacccaaatatacaacaatgatagactggattaagaaaatgtgtcacatatacaccatggaatactatgcagccataaaaaatgatgagttcatgtcctttgcagggacatggatgaagctggaaaccatcattctcagcaaactatcacaaggacaaaaaacaaacactgcatgttgtcactcataggtgggaactgaacaatgagaacacatggacacaggaaggggaacatcacacacgagggcctgttgtggggtggggggagggagggagggatagcattaggagatatacctaatgttaaatgacgagttaacaggtgcagcacaccaacatggcactaacctgcacgttgtgcacatgtaccctaaaacttaaagtataatttaaaaaaaaaagaaaaagttgttagattttaaaattattttaggatattttcttataagagaatgcacttatttttctttgagattgcagctattttcgtttgatctagaatcttctcattcttttgatttttaattttattgttagtagattataaagaatgggatattagagatttttctttaaaaatgaacctatatacattttatttatttattttcttaaagatagggtctcactctgttgtccagctggagtgtaatggcagtcatagctcattacagcttcaaattgctgggttccaggggatcctcctacctcagcctcctgagtagctgggattacaggtgcaagccaccacacccagctgattttcaattttttggtagagatggagtctcactatattgcccagactggtctcgaactcctggcctcaagtgatccccattggcttcccaaagtgctaggattacaagcatgagacaggcttcctttttttccttttttttttaaaagcagttatctgatatccatcaccttgtttacttgaccctgcttttaaaaaaataagtatataaaagtaaatacgaattagagatttgttagattggtattcccagtggttttttaaaaacattaattgcaaaattcctgatgcttaccacattttagagccaggagttcttaatctgggctgagtgaactcctgggggaggggggtagtatgttctgaatagatgagccataactttcatcatattctcccagggggccacaagatggaaaaataaagaaccactattttagagcatttggatcaagctatgtaataactcatttgtctgtgttaaaggcatttctcattgcaattgtggtaccagatgttgagacattatgttcctgggcccaaaagagaggatttgaagggtcgtttgaggaactgtgcagaaataaggtaaggttctgaagggtccagtctgtcctcatcataacttggcattaaatgtacctgtagatattcagggacctctaacagaggaagtaatttatttttcttacccttttaggatgtcaaaaaagctatcctcgaagatatggtgagacttgggaaggattctggtctgaaaccatttgaacaggtatgaccttcatctgagtgggtgaattcctgtaaaacaaattttccattaagatttttttacaggtagattatataaacatatggggtgacctaaagacatacatgaggaataaataatggagtagtttgacaggggaaaggtttttaaatcaaaagcatttattctcttttcctggatatcagaatatgatcccgaatcctatcctaagaataggatgcctgtcctttgttgagaaggtgcagcttggctgaaatgagaggatggattggatggctggagagtgttgatcccctccaaggcttacgtgcttttgagactggtggcccgtgtcctttttcctcttttaactgccttgtttattggcaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaggtgagtgaggcatcttttttaatgtcatgtttaatattcggaacagcctgtaatgtgcacaagcgaagagcaagaatggccctgggcctggaatccttcccagttgtcttcttttcttcttagtcaccctcctctaactcagctggcctcaggcactgacagacactgacccgagcctcccaccaggttgtctgtggcaaaagtcctaactggttgtggaaaagaaagtcatggtgtgaataacagagaaggtcctgaaaatgcagcttccttgctggaaaatgtatttcaggcgacgctggctgtaactggtgattccgtggtgaatgtaatcccactattgtattttagcactgtttagtcattctcttactgtagaattatttcagatgtctctttatagcagccaactttttcttgtttcttttcttctatctccaccctattccttctgttaccattttaaagattttcttttccacaggtattaatgaatcaaccccctaatttcttccaagcctgttgtgtttaaatctagtttcctgtcttaaattctgtttggtgtgatgatgtgtacatcaagccatgtgcagatgctatcttgtccattcttccacttttatttattaagatccttatcttagcagggggcagtggcgtgcacctgtagtcccagctacatgggaggctgaggcaggaggatcccttgagcccaggagttcgagtccagcctgccccttaaaagaattttttttgagacagagtttcactcttattgcccaggctggagtgcaatggcacgatctcggctccccgcaacctctgcctcccaagttcaagctcttctcctgcctcagcctcccaagtaattgcgattacaggcgcacgccaccatgcccagctaatttttgtatttttagtagagacagggtttcatcatattggtcaggctagtctcgaactcctgacctcaggtgatccgcccgcctcagcctcccaaagtgctgggattacaggcgtgagccactgcacccggcaggaattttttttaatgaagatccttctcatgtcttcagggcttaccttcctccccttctctcctgatgaagtgtgaggttcttaaggcctttcctttctcccctctcccttagcactgaacacagggcttagaaactaatagatattcattaaataaaccttttgaacaaatacttgaaattttgaacaaagctcctcttgcaatgaggttgataataaacactgggctcttttaaaatcatggtgaaattcacataaagttagcaccgtcaccatttttcagtgtacagttccgtggcattcaggacatccacactgctgtgctgtcatcactaccatccagctgcataagctcttcatcttgccaggcaaactctgtacccattaaacaacaaccccccgttctcccctcccgttaaactcctggcagccaccacttattctctgtttctatt

SEQ ID NO: 12030 - DNA, 56551 bp, Human
agccaacaatagtatttttaattaggtcatcctgcctttacaatctctgcattttaaatactcaactaagagtacagccattatttgtctttcacccaaagtcccattcaagtgagaacaaaggaatgaataaataaggcataagtaacaaaacaacaaaaaaagaaaattagaatgcggtcaatttcatgcaatcatcaacaccaaatttccagaacgtagtatttccaaatttcccgaacgtaaatatgtatgtggaaattaacaaaatgtggcaaaacaaaaggtcacttaaatttgcacaaatgaaacagtcaacatggaagctgatcggctttctgaaatatgggacaagctcaggacttcaaaatacttcggcgttggaagggctaagttatgatgtattaaaatgaaaataaagtggggcgcggtggctcacgcctgtaatcccagcactttgggggaccgaagtgggtggatcacgaggtcaggagatcgagaccatcctggctaacacggtgaaaccccgtttctactgaaaatacaaaaaaaattagccgggcgtggtggcggatgcctgtagtcccagctactcgggaggctgaggcaggagaatagcatgaacccgggaagtggagcttgcagtgagctgagatcacgccactgcactccagcctgggcgacagagcaagactccgtctcaaaaaaaaaaaaagaataaataaaataaaataaaatagtagaaggtttaattaggaatatttcactctccatacctgaagaattcgtgatagccaggagtctacaatcaaaataacataaataataagataaaaataaaattaatttgaagccataaaaaaagaatgagttcatatgttttgtggaaacatggatggagctggaggccattatccttagcaaactatacaagaacagaacaccaaatacagcaggttctcacttataagtggaagctaaataatagaactcatgaacacaaaaaagggaaaaacagacaatggggtctcctttagggtggagggtgggaggcgggaaaggagcaggcaaagtaactattaggtaccaagcttattacctaggtgatgaaataatctgtacaacaaacccccatgacacaagtttacctgtataacaaaccttcccatgtacccttgaacctaaaataaaagttaaaaaaatactcaatgagcaacaatgtacattatttgaggataattatattaaaagcccagacttcaccactacacaaaatatccacgtaataaaatttcacttgcgctccttaaatttatacaaataaacaaaaaagtataataaaatagtagattctttctttagagatgacaaatagtgccagagaaaatgcctccacactctggcattgagatcatctccaggataagggtatactgcatgcctggtcaagtccaagtaaatatactcagaccatgaatctcagagatgaaacataggttcagaacagacaaagccacagagcttttgactaatggcccagtgaaggcaatgtctgcctgtatggtatccaccaccttatattctgtcccaagcccgtctatttggatgtagcatctggttcaaagatgaatttgaacaccattagacactggcttaatgaaaattcacttctcattcgtttctcatctgaaacataaatagaaatataggtcttaggcaggaggatttcttgatgccagaagttagagactaccctggccaacatagaaagaccccatctctatttaaaaaaatatacatatatatgtcttctcttgggctccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggtgagtttcagagtaaaagtgggttagaggggaagatagagaaatcccaaaataatcagggtgtctcttaacagtgtgactaggagattttagtggctgccaaggagattctgatctccttagtggaaaggccgtctttgtcaatgtatctataactttgtctctacccaagcccaagctagcttgtggggctcaaggtttaatatttgtattaaacctatagtgtgttatctgggattcatgatggtcccaaggttcttatcaaggagagacttagaggctggaatctgaaaggtaaaaataaagaatgaacctcaaaactgtgattgttgtggaaggaaaacatatgatagaaccccatatagaaatatggttactagtattttgttgaagatttttgcatttatgttcaacaaagatattatccagaagttttctgtttttgttgtatctctgccacattttgttatcaggataatgttggcctcatagaatgagttggggaggagtccctcctccaggatttttttcaatagtttcagtaggaataatactagctcttcttggccgggcgcagtggctcacacctgcaatcccagcactttgggaggccaaggcaggcggatcacaaggtcaggagatcaaaaccatcctggccaacatggtgaaaccctgtctctactaaaaatacaaaaaaattagccaggcgtggtggcgggcgcctgtagtcccagctactcgtgcggctgaggcaggagaatggcatgaacctgggaggcagagcttgcagtgagccaagatcatgccactgcactccagcttgggcgacacagcgagactctgtctcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgctctgtctgggccagaggattcaggcacaggaaggtaagtgtcctgtaaatctctcccagcccctttagaccctcttgggagctctaggataaagaaattgaagaatagcctgaagcaccattcttattttaatccccattctagttgtttctgctgtgcttctcttgcataatttctatctcactttgttatctccaaacccttcagactcattaatgctcaggcctggatttatagttagtccttgcctgtgttagactgtccatgaaggatctgtaatttactgaatgctcaaactgcaagaatgaggaagtcaggagtcatctgcccaatatccttccttatgctgattctattttgttttagcaacccacttcctcccgtcacttcatttaaaaggatgctgccatagtctaaccctactgaacactctagcattctgtagtactactgcagtactaagcatgaggcagtcttagtgtactactgaatattctgccaccccaactactactgccttagcctcctaatgggtgtgagccccacgtccatccatgtcttctctcttccagctccttctaaagcctgaattatttgtgtgttgaacaatactcattcttcctatccatgagcatggaatgtttttccatttgtttgtgtcatctatgatttctttgaccagtgttttgtagttctccttgcagagatctttcacctccctggttagctgtattcccaggtattttattctttttgcagtaattgtgaatggattctattcttgatttggctctcagcttagatgtttttggtgtataggaatgctactgatttttatatattgattttgtatcctggaactttgctaaagttgtttatcagattaagaagtgtttgggcagagactgtggttttctaggtatagaatcatatcacctgcaaacagggatagtttgacttcctttcttcctatttggatgccttttatttctctcttgcctgattgctctagctaggacctccagtactatgttgaacagaagtagtgagagacggcatccatgtcttttgccagttttcaaggggaatacttccagcttttgcccattcaatatgatgttgactgtgagtttgtcatacatcattcttattattttgaaatatgtttcttcaatgcctagtttgtcgaggttttttagcataaagggatgttgaattttatcaaaagctctattgagaggattatgtgtgtggggagggttgttctatttatgtgatgaatcatatttaagatttgtgtatattggccgggcactgtggctcatgcctgtaatcccagcactttgggaagccaaggcttgtggatcatgaggtcaggagatcgacaccatcctggctaacacggtgaaacctcgtctatactaaaaaacacaaaaaaattagccaggcgtggtggtgggcacctgtagtcccagctgctcgggaggctcaggcaggagaatggcgtgaatccaggaggcggagcttgcagtgagccaagttcacgccactacactccagcctgggcaacagagcgagactcctatatcgaatcaaccttgcatcccagaaataaagcctacctgatggtggtggattagctttctgatgtgctgctggatagtttgctagtattttgttgaggatttttgcatttatgttcaacaaggatattgtcctgaagttttctggttttgttgtgtctctgccatgtttttgcatcaagatgatgctggtctcatagaatgagctggggaggcattcctcctcctgaatatttttggaacgtttcagtaggtatagtaccagctcttctttatatatcagatgggattcagctgtgagtctgtctggtactgggctttttctggtctgtaggatttttattactgattcaattttggagctcattattggtctgttcatgtattcaatttattcttggtttgatctcaggagggtgtatgtgtccaggaatttctccatttattctggattttctagtttgtgtgcatagaggtgttcataatattctctgatgattgtatttctgtggggtgagtggtaatataccctttgttgtttctaattgtgtttatccggatcatctctcttttcttctttattagtctaactagtcatctgtcttactaattttttcaaaaattctactcctcgatttgctgatcttctgaatgctttttcgtgtctcaatctccttcagctcagctctgattttggttatttcttgtttcctatgagctttggggttgatttcctcttggttctcttagttcctcttgttatgatgttaggttgttaatttgaactttttctagctttttgaagtgggagtttagtgctataaacttcccccttaacactgccttagctgtgtcccagagattctgctatatttacccaaaaattccagaacagactgcttaatttccatgcattgtacagttttgagtggttttcttagtatttattcctatttttattccactgtgctctgatttcgcttttctggatttgctaaggattgttttttttttttttgaaatggagtcttgctctgtcgcccaggctggagtgcagtggcgcaatctaggctcactgcaagctccgcctcccgggttcacaccattctcctgcctcagcctcctgagtagctgagactacaggtgcccgccaccccgcccggctaattttttttgtatttttagtaaagacggggtttcactgcgttagccaggatggtctcgatctcctgacctcatgatccgccagccttggcttcccaaagtgctgggattacaggtgtgagccaccgtgcccagcctgctaaggattgctgtatgtctgattgtatgattgactttagagtatgtgccatgaggcaatgaaaacaatgtagattctgttgttttgggggtggagagttctgtagatgtctgtcaggtccatttgatccactgctgagttcaggtcctgaatatctctgtttgcctcaatgatctaatactgtcggcgggatgttaaagtctccccctattattgtgtggttgtctaagtctcttcgttggtctctcagaacacgctttatgaatccgggtgcttccatgttaggtgcatatatatttaggatagttaggtcttcatgctctttttttaattttttttttctttttctttttgattcagcagttgggctattacacactccttagcagattccgacttccgtggccactgtcctgctatggtcttcatgttgaattgaaccctttaccatgatttaatgcccttctttgccttttttgatctttgttggtataaagtctgttttgtctgaaattttaatagcagctcctgcatttttttttttttttggctttccatttgcttggtagatttttctccatttctttactttgagcctatggatgtcattgcatatgagatgggtttcttataggcagcataatgttgagtcttgcttttttttttttttttttttttgagatggagtctcactctgtcacccaggctggagtgcagtggtatgatcttgactcactgcaacttctgcctcccaggttcaaatgattctcctgcctcagcctcccaaatagctgggattacaggtgtgtaccaccacgcccagctattttttttttttattagagatgggatttcatcacattggccaggctaatgtcgaactcctgacctcaaatgatccacccacctcagcctcccaaagtgccagggttacaggcgtgagccactgcacctggcctcttgcttctttatccaacttgccactctctgcattttaattaggacaattagtccatttacattcaaagttagcatttacatgtgcagattttttcctgtcatcatgttgttagctggtttggttattatgcagacttgtttgtgtggttgttttatagtgtcactggtttatgtacgtaagtgtgttttctattggctggtgatggtcttttctttccatatttagcgttcctcttaggacctcttgtaaggcaggcctgatggtaataaattccctcagcatttgcttgtctgtaaaggatcttatttctccttcacttatgaaacttagtttggctgggaatgagattcttggttggaaattcttttcataagaacattaaatataggcccccaatctcttctggattgtagagtttctgctgaaaggtctgctgttagctcgatggcattccctttgtaggtgacctgccccttcttttttgctgccttttcacattttttttttttttttgagactgagtcttgctctgttgcccaggctgccaggctggagtgcaatggcgtgatctcggctcactgcaagctccgcctcccggattcacgccattctcctgcctcagcctccccagtagctgggactacaggtgcccaccaccacgcccagctaattttttatatttttttagtagagatggggtttcaccatgttagccaggatggtctcaatctcctgacctcgtgatccgcccgccttggtctcccaaagtgctgggattacaggcgtgagccaccgcgcccggccgacatttctttctttcatttctaccttgaagaatctgatgattttgtgtcttggggatgctcttcttgtgtagtattttgcaggggttctctgtttcctgcatttgattcttggcctctctagtgacgttggggaagttttcatgaacaatacactgaaatatgttttccatgttccttgctttctccccatctctttcggggatgccaatgggctatttggtctcttttcatgatcccatatttcttagaggttttgttcattaatttttattctttttcttcatttttgtctgactgaattagttcagagagccagtattcatgctctgagattctttccttattttgctttattttgccattaatacttgtgatcgcattatgaaatctcgtagtgtgtttttcagctccatcagatccgtttggttctttcaaaatgaccatctcatagattagcccctctgtcattttattgtaatctttaggttccttgcattgggtttcaactttctcctgaatcttgatgaccttaatttctatccatattctgaattctatttctgtcatttcagccaggtaaagagcccttgctgggaagcttgtgtggtaatttggaggaaggaagacactgttgctttttgagttgatggagttcttgctcagttctttctcatccatgtgggctaatgttcctttgagtgtgctgcaatttgaatttttttcttttttcttttaaccgtgatgtaatttgagcacagtcagtagacttcttttctggatggtttcagagggctggggcttcgcacagggtctttatttatagctaaattcttgtccttggtttcacagggaggtatattagcgagcatttttggtgttgaagtttgggctgcaatccggtaaatgatgcttcagcacaacggccagtaggtcattcctcatgattgccgctgtgctccctctcacgctctgaaagtgcgggctcctctcccacccaagtgctggctgcagatctgggctcggcactcccaggctgcacatcacagctctggggtgagctcagactttatgttccctccgtggcttgggggcagcaggggaagggaccttagcagcggttgtggcagacggcctttcacttgtcccttggaactccaccccagagagatgtggagccactatcagtgcgatgagccaagagtggggcgactgcactgtgggtccaagctaggggccctgcctagtgatgagcaggggggacaggtgggtcacaggggtgacagactggcctcttctccttagggcagtttgctggaggtgtggttgaagcactcagagtctttgctccttccccagtctgagggcagcaaggccagtaccaccgcagtggcagcggcagagtgaccttccgttgcctctgggagctccgccacagagaaacgcagactcacagctgctgggaacgctccgccagagggtggggctgttgtgccgcggaatcaagctggggcttggtgaagagcagggggttgagggctcacagggagaggagactgagctcctctccgtatggcgactgcggtgtgctggaagcatgaatgaaggccgggcgcggtggactcacgctcggaatcccagcactttgggaggccgaggcgggcggatcacgaggtcgggagatcgagaccatcctggctaatctggtgaaaccccgtctctactaaaaacacaaaaaatgagccgggcgtggtggcgggcgcctgtagtcccagctactcgggaggaggatgaggctgaggcaggagaatggcgtgaacccgggaggcgcagcttgcagtgagccgagatcgggccactgcactgcagcgtgggcgacagagcgagactccgtctcaaataaataaataaataaatagaagcatgaatgaaggccccaggctccttgcttcttccccagatcacgggcagcagaggcagaacccttgccatggcagtggcagaggggctgtcagttgcctctgggagccactccccagggaaacacgagccaccaccagtgagtgtgctgagggcggggcagctgctctgcactcccgagctgggggctctgcctggtaaagtgggggtgggagctcacggggaagagagactggactcctctctgtctgatggctgtggcataatgaccgggcccccacacatgaaaaagaattctgggaactcaaaaagccagtgtgtccccaccatggaccccttggattgtgtttcaaatttctcctcaatttcgaagagcgtcctggccatccagattctgaattctataaccctcgtttcattcatctcaatgtagctaagaaccagatttctggggaactatcgagttgccagagttcttgtgttgattcttttttttttcttttttgtggcagagtcttactctgtcgcccaggctggagtgcagtggcacgatctcagctcactgctgcaaccttcacctcccgggttcaagcgattctcctgtctcagcctcctgagtagctgggattacaggtgtgtgccaccacgcccggctaatttttgtatgtttagtagagcccgggttttgtcacgttggtcaggctggtctcaaactcttgacctccggtgatctgcccacttcagcctcccaaagtgctgggattacaggtgtgagccaccgcgcccggccttggtgttgattctttctcttgtgtgagggctggtgttcctttaactgtgatgtcggttgagtacagtcgcttggcttcatttctgggtgttttcagatgccaggactctgcacaggatctttatttgtggctgaatttttcccttcattgtatactggcaaaatttttcagtgttgtattttgaagtgtgatccagtaggtggcacttaaaagggttggccagcatacaggatcttagccacaaggctcttttgtagttttgtttcgttttttgtttcgttttttgacacagggtcttgttctgtcgcccaggctggagcacagtggcacaatctcggctcactgcagcctctacctatcaggctaagtgatcctcctgcctcagcctcctgagtagctgggactacaagcacgcagcaccataaagagaaaatttttgtaattttttttttttttttgtagagatggggtttcaccatgtttaccaggctggtctcaaactcctgggctcaagcaatctgcctgccttggccccctaactcttgtattttgacaaagtcggcagtagtgctctgtggttgtggggaggggtgactccctcgcctggtccattcttgggccttggaggagcctcctacagtcactggctctgcacccactgtttcctttgttaggattgttctgcccacggggctccctcaggcagggcatggtgggcagacaggctgtatccttccccggccagccctatggagggaggaccaccccgcacctctgcaggctgatgaaatcaggtgtttcacccctctgaacgttctgagaatgagggctcctcacggcttggtcgccacctaacgtggtgagtccttctcagcaagggtgattggagccacatgatctgccatctcagtgcttcccaggggaacacagagctactgggcatggtggctcacacgtgtaatcccagtactttaggaggccgagatgggcagattgcgaagtcaggagactgagaccatcctggataacatggtgaaaccccgtctctactaaaaatacaaaaaaaaattagccaggcgtggtggcgggcgcctgtagtcccagctactcgggaggctgaggcagaagaatggtgtgaacccgggaggcggagcttgcagtgagccaagatcacaccactgcactccagcctgggcaacagagtgagacttcatctcaacaaaaaaagaaaagaaaagaaaaacacagagctgcacaccccacagagttcaggcagaagggggtctgcagcgctggaagacccagcaagcctggcccgtctggctgcaagtggcaggggtgggtggagtcacccacttcaccatctgggtgctttccagggaagcatgcagccacgaccccgggcagagttcaggcagaagctgggccactatgctggaaactggccttgagccttgtggagtaacggcaggtggagccatctcactgctcccacgcaccatgcccgtggcctctgcgggggctgtggtaacggcacccgactgctctggggtcaatgcctgcggaggtccccctggcttcagtgttgcctctgcaaaaaccccagttgcagccaggtgcggtggctcacgcttgtaatcccagcactttgggaggccgaggcaggtggatcacttgaagtcaggagttcaagaccagcctggccaacatggtgaaaccccgtttctactaaaaatacaaaaattatccaggcatggtggtgggcacctgtaatcccagctactcggaaggctgaggcagcagaattgcttgaacccgggaggcggaggagctgagattgcaccactgcactgcagcctgggcgacaaaacaagactctgtctcgaaaaataataacaataaaaaataaagatggcaaccatagacactggagactactagatgggggggaagaaagggggttgaaaaactgcctattgggtactatgctcagtacctgggtgacaggatcaatcgtactccaaacctcagcatcacaaattatttaaatttttctctttttttaattttttttgttgttgttgttgagacgaagtctcactctgttgcccaggctggagtgcagtggtgtgatctcggctcactgcaagctctgcctcccgggttcacgccattctcctgccccaatctcccgagtagctgggactacacgcgcccgccaccacgtcctgctaattttttgtattttcagtagacacggggtttcaccgtgttagccaggatggtcttgatatcgtcaccttgtgatccacccgcctcggcctcccaaagtgctgggaatacaggcgtgagctaccgcacccggcctaaatttttttttaaataaagaatggtaggttcttcacaccctaatgtatttttacttctcccacagagaaggaaaggaatggcttccccatggcgagccacctcagtctgggctttcttttcttccaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggtaaggaaacatccagggtccacagccctggtgtgatttttttcttatttttaatagagtatttttcaagaagttttagatttacaaacaaaaaaaaattgatgattgcttcagagagttctcagccatctggcaccccacttcccccagagttaacatcttacattagtatggcacatttcttaccattaatgaacaaatatcgacacattcccagctacagtctacagtttatttacattttcttagtttttacctgatagtctttctctgttccagaatcccattcaagatttcacattgcggctgggagtggtggctcacgcctgtaatcccaacacttagggaagccgaggcgggtggatcacccaaggtcaggagttcgagaccagcctggccaacatggtgaattccccgtctctactgaaaatgcaacaatcgccgggcgcggtggctcacgcctgtaatcccaacactttgggtggctgaggtgggtggatcacctgaggtcaggagttcgagaccagcctggccaacacagtgaaacctcgtctctactaaaaatggaaaaaattggccaggcctggtggcacacgcctgtaatcccagctacttgggaggctgaggcaggagaatcgcttgaacccaggaggcagaggttgcagtgagccaagatcacaccactgcactccaggctgggcgacagggcgagactccatctcacacacacacacacaaaaagatttcacattgcattcaggtgtcatgcatctttttttttttttttttttttttttgagacggagtcccgctgtgttgcccaggctggagtgcagtggcacaatctcggctcactgcaagctccaacctcccgggttcacgccattctcctgcctcagcctcccgagtagctgggactacaggcgtccgccaccacgcctggctaattttttgtatttttagtagagatagggtttcactgtgttagccaggatggtctcaatcttctgacctcgtgatccgcccgcctggcctcccaaagtgctgggattactggcgtgagccaccacgcccggcccccgaaaatgctgggattacaggcatgagccaccgcacctggcctcccaaagtgctgggattccaggcgtgagccaccgtgcccggcaggtgtcatgtatctttaggtttgtcttggctgtcacagcttctcagatgttgctggttttccatgaccttgtcagttttgagggtagtggtccattattttcaagggtactcccactactggaaattgtctgatgttttgctcatgactagactgagttatgggtcattgcaggcaagaccacagaagcaaagtgccatttcatctcctcatagcaaaggtttaaactgtccatgggaacatgactgtggatgttgagctggctgttgttgaaagcctggctgaagtagtaactgtggccagacaccgtggctcgtgcctgtaatcccagcactttgagaggccgagatgggcagatcacttaagcccaggagaccagcctgggcaacatagtaagaccccatctgtacaaaaaatcaaaaaattagctgggcatggtggcatccacctgtagtctcagctacttgagaggctgagatggtaggatcacctgagcctgggaggtcgaggctgcagtgagccgtgattatgccactgccctcagcctgggcgatagagtgagaccctctctaaaataaataaattctaaaaaagaaaaaagaggctgggcactgtggttcacgcctgtaatcccagcactttgggaggctgaggcaggtggatcacctgaggtcagggattcaagaccagcctgaccaacatggggaaacctcatctttactaaaaatacaaaaattagctgggcgtggtggcgggtgtctgtaatcccagctactcgggaggctgaggcaggagactcacttgaacctcggaggtggaggttgcagtgagcggagatcatgccactgcactgcagcctcagtgacagagcgagactccatctcaaaaaacaataataggctgggcgcagttgctcatgcctgtaatcccagcactttgggaggccaaggtgggcaaatcacctgaggtcaggagttcgagaccagcctgaccaacatggagagaccccgtctctactaaaaatacaaaaattagctgggcgtggtggtacgcacctgtaatcccagtttctcgggaggctgaggcaggagaattgcttgaacccgggagacggaggttgcagtgagctgagatcacgccactgcactccagcttgggcaataagagcgaaactccatctcaaaaaaatatataataataacaataagaagaagaagaaaagaataaaggagaaaaggtctttctaatagctcactcttttctctcttaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaacacggttgggcacgatggctcacgcctgtaatctgagcacattgggaggctgaggcaggtggatcacctgaggtcgggagttcgagaccagcctggccaacatagtgaaaccccatctccactaaaaatacaaaaattaaccaggcgtggtggtggtgggcgcctgtaatcccagctacttgggaggctgaggcaggagaatcacttgaccagggaggcggaggttgcagtgagccgagatcacgccactgcactccagcctgggcaacagagtgagactccatctcaaaaaaaaaaaaaaaaaaaacacacacaacctgcccataatcacctccttcccagtttatagcacttccctgggaagcacagttccttgcccgtgaacacagtcttgctgactgatcagtgtggtgctggcgaagcatgagctcattgaggggatgcttgagggagtcccattttggcaagcgaaaaggaaaatgagctcccgtttcagggctctggggttgggatggaatggaacacaaccaccaaccattcatctccttgaattgtgtctccagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattacaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagtatttctaactttctttattgactgcttttcacactttatacaagttctggcccatatcttcagtttgttctgatttttttcaccaggtgtggtggcaggtgcctgtagtcccagctactccaggggctgaggcaggagaatggcgtgaacctgggaggcggggcttgcaatgagctgagatcacgccactacactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaactcatataagtcgttttgctgacagaaggaccttgtttggaaaaagcgttttcagaataataaagttcctgagctcttcagaaaagtattttattgtcctgtaaccacagtaacaagtagccaccaaaactgatttttaacccatcatcaatgacaactcatctctgtgaagatgctctttttttttttttttttttttgagacggggtcttgctctgtcacccaggctggggagcagtgacgtgacctcggctccctgcaacctctctttcccgggttcagcaattctcctgcctcagcctccccagtagctgggattataggcacctgccaccacacgcagataatttttgtatttttagtacagacgggtttcgccatgttggccaagctggtcacaaacttctgacctcagggtgatctgcctgcctcagcctctcaaagtgctgggattacaggagtgagccacaaagcccggccactccatacgttttatattgttatgttaccatcagtcaggcagctccttgcttctaaaagtcatccaatcagactcatttcagtaaacacccaagcatgagtgacaaccaatcaaagtaatatcttcccaatgaccacacttttccagatgacgtcaagccacagaaggccctgaaaatccaacaatctctgaagtatacatttcccaggctgagcgcagtggctcacacctgaaatcccagcactttgggaggctaaggcaggcagatcacgaggccaggagttcgagaccagcctggccaacatggcaaaaccccgtctctactaaaaatacaaaaattagccaggtgtggtggcacgcacctgcattaccagctactgaggaggctgaggcaggagaatggcttgaacccaggaggcggaggttgcagtgagccaagatcgtaccaccgcactccagccttggtgacagagcaagactccatctcaacaacaacaacaaaaatggttgaaataaaacttctatgtgttgaacgattcctcttttaggcatagagtttcagttttacaagatgaaaatattctggagatctgtttcaaaacaccgtgaatacatttaacactgctatactgtacacttacaatggctaagatggtaaattgtatgttatgtttttactacaatttttttttttttttttctgagacagagtctcactcttgttgcccaggctggagtgcaatggtgcggtctcggctcaccgcaacctccgcctcctgggctcaagccattctcctgcctcagcctccagagcagctgggattacaggcatgcgccaccacgcctggctaattttatatttttagaagagacggggtttctccatgttggtcaggctggtctcgaactctggacctcaggtgatccacccgccttggcctcccaaagtgctgggatcacaggcgtgagccaccacgcctggcctacaatttttttttaacttttttttctgagatggagtctcgctcttgtcacccaagttggagtgcagtagtgtgatctcggctcactgcaacctctgcctccctggttcaagggattctcctgcctcaacctcccaagtgtgggagatcagtcagagtagcagaagaaattataggaataggaagcagcaaaccttcttggaaggccagggaggttggcatagcttcagatagtttggctgaaagcagccagattctcttttcaggagccaaacagcttagggcgcagatacaaaggaatgcggagtattttatctaaatagcttgcttagtcatatggtcctaaaatcaacctttgatcattctcgggcaagatggccctctccagggaggtggcggggggcggtgaccaggttaattacccacaggtgtgttgactcaaagcctttgttaattaaatctgtgctaaataaatgcaagcgttgccagcttagaggggctgcactctctttggctcctagtgccggcagccccctggcctgctctttcactgaatattggtgtctgaggacgtgtctcatctgtcgtacagctgggatctgcagaacagatcccccccgcacccaagaagctgggattacaggcacccgccgccacgcccagctcatttttgtatttttagtagagacagggtttcaccatgttggtcaggccggtctcgaactcccggcctcaggtgatctgcccgcctcagcctcccaaaagtgcttggattacaggcatgagccactgcgcctggccttagaaaacttctttttcttttttttttttttttttttgagacagagtttcactctgtcgctacgctggtgtgatctgggctcactgcaatctccgcctcccaggttcaagtgattcccctgcctcagcctcccgagtagctggaactacaggtgcgcaccgccacgcccggctaatttcttgtattttcgtggagacggggtttcaccatgttggctaggctggtctgtttcatgcgcgtccgtgtgaagagaccaccaaacaggctctgtgtgagcaacaaggctgtttatttcacctgggtgcaggcaggctgagtccgacaagagagtcagcgaagggggataggggtggggccgttttataggatttgggtaggtaaaggaaaattacagtcaaaggggggttgttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatggcttagcttgggctcagaggcctgacattcctgtcttcttatattaataagaaaaataaaacgaaatagtggtaaagtgttgggatggtgaaaattttggggggtggtatggagagagaatgggcgatgtttctcagggctgcttcgagcgggattaggggcggcgtgggaacctagagtgggagagattaagctgaaggaagattttgtggtaaggggtgatattgtgggattgttagaagaaacatttttcatttagaattactggtgatggcctggatgcagttttgtatgaattgaaaaactaaatggaataagagaaggagaaaaacaggtataaaaggtctaagaattgggacgacctaggacatctgattagagagtgcctaaggaggttcagcatagccttgccagcaaagattatttatttacttcaagagttaagagtggcggtttggggatagcaccaggagatatcagctgtgatggcttggaaaaacagtgtaaaccagcagtgtaaacaagagcagggcatgtgtgagtagttgagaatggtgaataggagtatgactagacagaagatagtagggatgacaagttttttggggcacagtctaagttggtctggtgtctggaatgagactggggcttaataaaaagcagtgtctatacaggagctcaaatgggctgtaccttgtagcattctgaggacaggcctgaattctgagaaaagaaagtggtaaaagtattgtccagtcttttttaagttggtggctgagcttggtgaggtgtgtttttaaaagaccattagtccgttctacttttcctgaagactgaggactgtaagggatataaaggtttcactgaataccaagagcctgaaaaactgcttggctgatttgactaataaaggccggtctgctatcagactgtatagaggtgggaaggccaaactgtggaattatgtctgacagaagggaagaaatgacctcggtggccttctcagaccctgtgggaaaggcctctacccatccagtgaaagtgtctacccagaccaagaggtattttagtttcctgactcagggcatgtgagtaaagtcaatttgccagtcctgggcgggggcaaatccccgagcctgatgtgtagggaagggaggggacctgagcaatccctgaggggtagtagaatagcagatggaacactgataagtggtttccatgaggatagatttccaggatggaaaggaaatgagaggttctaagagatgggctagcagcttgtaacctacatggaagaggctatgaaatatcaaccgaatagaatgggcctgtgaggctggaaggaggtattttccttggtctaagaaccatttgccttgtgtgggaagagattgatgggtggaagtttcagtgggggagtaggtgggagtgactgatgagaaggagaaaaactggctgtgggggacagaaattggcatgctagctgcttgtctagctaccttatcagcataagcatagatgtgagagacagaagttggaaagctagctgcttgtctagccaccttgtcagcataggcattgtctagagcaatgggatctgatgacttttgatggcctttgcagtgaatgactccagcttcctttgggagtaaagcggccttgagcagagtttttattaaggaggcattaaagatggaggacccttgtgtagtgaggaaacctctttcagcccatatgaccgcatggtggggcagaatatgaaaggcatatttagagtcagtataaatattgatgcatagtccttttgcatcagtgagggcttgagttaaggcaactaattcggcttgctgagaggtagtggagggggcagagcggtagcctcaatgatagatgtggaagatactatagcatagcctgcctttgctggtgagtggcgattaggcctggtggaactgccatcaataaactaaatgtgattagggtgaggaataggaaagaaggaaatgtggggaaatggggtgaatgtcaggtggatcagagagatacagtcatgggggtcaggtgtggtatccggaataatgtgggaggccggattgaagtatgggccagtaacaatggtgattgtgggagactcaacaaagagtgagtgtagctgaaggagccgggaagcagaaagtatatgcgtcaggtgtgaggaagaaaatagatttttggaagttatgagaactgtagagagtgagttgagcatagtttgtgattttgagggcctctaaaactattaaagcagcggcagccgctgctcacagacatgagggctaggctaaaacagtaaggtcaagttgttcggacagaaaggctacagggtgcggtcctggctcttgtgtaagagttccgaccacgctaaccatgcctaggaaggaaaggagttgttgttttgtagaaggtgctggggcttgagagatcagtcagacacgatcggcatggagagcacgtgtgtttttatgagaattatgccgagataggtaacagaggaggaagaaatttgggcttgactgaagtaatgggggctgtctgtgaagctttgcggcagtacagcccaggtaatttgctgagcttgatcggtgtcagggtcagtccaagtgaaagcgaagagaggctgggatgaagggtgcaaaggaatagtaaagaaagcacgtttgagatccagaacagaataatgggttgtagaggcaggtattgaggataggagagtatatgggtttggcactacggggtggataggcaaaacaatttggttgataaggcgcagatcctgaactaatgtgtaagccttgtctggttttaggacaggtaaaatgggagaattgtaaggggagtttataggctttaaaaggccatgctgtagcaggctttaatccttttaaagcgtgctgcggaatgggatattggcgttgagtggggtaagggtgattaggttttaatgagatggtaaggggtgcatgatcggtcaccaaggagggagtagaggtatcctatacttgtgggttaaggtggggggatgcaagaggaggaagcaaaggaggctttggattgggaagaatggcagcaatgagatatagctgtagtccaggaacagtcagggaagcagataatttagttaaagtgtctcagcctaataagggaactgggcaggtggggataactgaaaaggagtgcttgaaagagtattgtctaagttggcaccagagttggggagttttaagaggtttagaagcctagctgtcaatacctacaacagttatggaggcaagggaaacaggcccttgaaaagaaggtaatgtggagtgggtagcctccatattgattaagaaggggacgggcttaccttccactgtgagagttacctagactgtgatggtcctgtaggcttctgaggcgatcgggatcgggcagtgtcagtcttcagctgctaagccgagaagatctgggaaggagtcagagagccttgggccagagttctagctgctctgggagtggctgccaggtgagttgaacagtccgattttcagtggggtcccgcacagatgggatgcggcttaggaggaatcccaggctgtggacattccttggcccagtggccagatttccagtacttgtagcaagctcctgggggaagaggttctggaggaacccctggcagctgcggttcaggcgtttggagttctcgtgtgctggagatgtggctggggtttgtctcatctggatactggagtggaggcaaggaattgcaactcagaaatatgttgctatttggctgcctctactctattactgtacaccttgaaggcgaggttaattaagtcttgttgtggggtttgagggacagaatttaatttttggagctttatttaatgttgggagcagatttggtaataaaatgtatattgagaataagacggccttttgacttagggtctagggctgtaaagcgtctcagggttgctgccaaatgagccatgaactgggctgtgtttttaaatttgatgaaaaagagcctaaacactatctgatttgggagaggtcagataaagaaaaaggagcattaaccttgactatgcctttagcttcagccacctttttaagaggaaattgctgggcagttgggggagggctagtcatggaatggaactgtaagctggaccgggtgtgaggaggggaggtgataaaaggattatagggtggaggagcggaggctgaggaagaattgggacccagctcggcctggcgaggaggggagatgtcagatgggtctgtagaaaaggaagattagaaagactcagcgatgcttggggttgggactgacgggacaggcgggagggaaagaaggaagatttgggacgagttgcactgggcatagagactagggagggaccgatgtgtaaaagaatgcctggatgtcaggcacctcagaccatttgcccattttacaacaagaattatttagatcttgtaggatggaaaaattgaaagtgccgttttctggctatttggaaccactgtcaagtttgtattggggtcaagcagcattgcagaagaaaataaggcatttaggttttaggtcaggtgtgagttgaagaggtttttaggtttttaagaacacaggctaagggagaagaaggaggaatggagggtggaaggttgcccatactgaaggaggcaagcacagagaaaagagagagtagagacatggagggaaggggttcaggggttcttaccttccagaaaagcgggaaaggggtcagggcacagaagtaagggattggggtgcagagacaagaggtcggggtgtggaaataagggatcggggtgcagagataagacgtcagggcacagaaataagggatcgggggattcttgccccctagaaaagcggtacttgccactaagggtgaaggagaaggggttggggggttcttgcccccccagaaaagcagagaaggggtagagacacagagaaggagttgggggttcttgcccccccagaaaagcagtacttgccactaagggtgaaggaccaaggcaggcatccccatgtggtcagacacctctgaaacgtgggtgaataatcagagaggtgtccctgcgtgattaaacaccaagggaaggctgccttcccgagtccatgaccggcgctggagttttgggtccacgaataaagcgcgtctcctgtctctaccagaaaaggaaaggaactgaaattaagagaagggagagattgaagagtggaaaggagaaagtggttgagggatagtgagagaggttggagaagagagtaaaaagaggctgcttactggatttaaaattggtgagatgttccttgggctggttggtctgaggacgagaggtcgtaggtggatctttctcatggagcaaagagcaggaggacaggggattgatctcctaaggaagatcccctgattcgagttatggcaccaaatttcactcacgtccgtgtgaagagaccaccaaacaggatttgtgtgagcaacaaggctgtttatttcacctgggtgcaggcgggctgagtccagaaagagagtcagcaaagggagataggagtgcggccgttttataggatttgggtaggtaaaggaaaattacagtcaaaagggggttgttctctggcgggcaggagtggggttcacaaggtgctcagtaggggagcttttgagccgggatgagccaggagaaggaatttcataagataatgtcatcacttaaggcaagaacaggccattttcatttctttcgtggtggaatgtcatcagttaaggcaggaaccggccatctggatgtgtacatacaggccacagggggatatgatggcttagcttgggctcagaggcctgacagtctggatcacctgacctggtgatccgcacacctcggcctcccaaagtgctgggattacaggcatgacccactgcacctggccttagaaaacttcttaaatattaaaatgtatgttatgtgtattttgccacaatttttgaaaagtaccttctggtgtttagagacagaagatgagtggttgcctagggccgggagagtgaggggatcgtggtgatgggcagctggtcggcatggggttctgaagggcagtgatgacaacattctaaaattagactgtgttgacggttgcaccaactccgtgaataccacaaaatttaaaccattgaattatgcacttttaatgggtaattgtatggcatgtaaattatatctcaataaagttatatttttaaataccaaaaaaaggccgggtgcggtggctcacgcctgtaatcccagcactttgggaggccgagaagggcggatcacgaggtcaggagatggagaccatcctggctaacatggtgaaaccccatctctactttgaaaaaaaaaaaaaaaaaaaaaagattacccggacgtggtggtgggcacctgtagtcctagctactcaggaggctgaggcaggagaatggcataaactcgggaggcagagcttgcagtgagtcgagattgcgccactcaggaggctgaggcaagagaatggcataaaccccggaggcagagcttgcagcgagccgagattgcgccactgcactccagcatgggtgacagagcaagagtccatctcaaaaaaaaaaaaaaaaagattagtaatatcctctgtgtcacttaccacttaagtgattgaatcacgacttgaaattcatcatctcaaacatggcttagagtctgtagaggggggacagtcccaggaatgctggtgtgggcttaaggctgaattaaatagatccagatggctcacacctgtaatcccaataccttgggaggccgaggcaggtgggaggctgaggcaggcggatcactggagctcctggagcgaagaaaggatgctagtggaaaaactggtgaaatcagaataaagtctatagttttattttttaaaggaggctgggcgtggtggctcatgcctctaatcccagcactttgggaggctgaggcaggtggatcagttgagttcaggagttcgaaaccagcctggccaacttgacgaaaccccatctctactagaaatacaaaaattagctgggcgtggttgtgggtgcctctaatcccagctactcaggaagctgaggcaggagaattgcttgaacccaggaggcggaggttgcagtgagctgagatcacaccattgcactccagcctgggctacagagcaagattccatctccaaataagagagacatgacaattaaataaattgtgtaatcttggattaaatcctaaaccaaatatatgtcactggtaaaacaagtggtgaaatttgaataaagtggatagatcagacaatagtgtcatatcagtgctatttcttgaccttgaacattaataacagaatgtccttggttttgggaaatataacctgaagtgattagaggtttagggcatcatatgcaaattagacacactttcttcggggagagagggagagggagagaggctgaatgatgaagcaaatgtggtaaaatgctaactttggggaaatctggatgaagaaattacagattttttttttttttatagacagggtaacactctgtcacccaggctagagtgcagtggcacgatcatggctcactgcagcttctacctccctgggctcagatgaccctctcacctcagcctcccaagtagctgggactataggcgcacagcaccacacctggctaatttttgcatttttttttcccccaggctcgtctcaagcaatccacccacctcggcctcccaaagtgctgggattacaggtgtgagccactgcacctggccagaaattctttaaactatttttgcaagtctggaattatgtcaaaattaaaagctcaaaataataaaagacaatattcttatatttctttggtgaaggtaactatgttatggctgagagggtggctgaggtctgaggatccagcctacataagtctcctccatagagggcatccaagcgctccgtagggggaaggataaagaaaacacccagagttatgacagctgtgtaaggggaaacgccagcaccgagtactgaatcttcagtaaataagaaggaggcgggctgggtgtggtggctcacgcctgtaatcccagcactttgggaggctaaagtgggctgatcacttgaggtcaagagttcgagactagcctggccaacatggggaaaccctgtctctactaaaaatacaaaaattagtcgagtgtggtggcacacgcctgtaatcccagctacttgggaggctagaacaggagaattgcttgaacccaggaggtgaaggttgcagtgagctgagattgcaccactgcaccccagcttgagggacagagtgagattccgtcttaaagagaaaaaaaaaagaattagcacatttgtttgcctcaagaagatacaactagtcttgtacagtagtcacatgtatccaccaggatatattccaaggccccagtggatgctgaaaactacatagtaccttacatgtatatatatatgtatatacatatatacacatatacgtatatgtatacatacatgtatatatgcatgtatgtatatacatatatgcatatatacatacatgtatatatacatgtatgtatatacatatatgtatatgtatgtatacacgcatacatgtatgtatacacgcatatatgtatgtatatacatatatgtatgtatacacgcatacatgtatgtatatacatatatgtatgtatacacgcatacatgtgtgtatacatatatatgcatgtatgcatgtgtgtatatatacatatatgtgtatatatacgcatatacatgtatgtgtatatatgcatgtgtatatatacatgtacggtactatgcagtatatatacacatatatgtatatatgtatacatatatgtataaatgtatatatgtgtatatatataaaaggtatatatgtatatatgtgtgtatatataaaatgcatgaatttcttttttcttactgtagatcttaacaacttctgcatagaatttttttttattaagtggagagttagttacttacttaaaagaaatgtttcttggctgggtgtggtggctcacacctgtaatcccagcactttgagaggccgaggcaggaagattcacttgaggtgaggagttggagaccatcctggccaacgtggtaaaaaccggtctctactaaaagtacaaaaatgagctgggcgtggtgttgggtgtctgtagtcccagctactcaggtggctgaggcaggagaattgcttgaacccacaaggcagaggttgcagtgagctgagatcacaccactgcaccacagcctgggcaacagagcaagactctgtctcaaaaaaaaaaaaaaaagaaagaaaaagaaaaagaaaagaaatgtttcttttcttattaagttctttaaatgaaaagcttttcttttcacttttattttattgaaacattataacactatctttgaagaagttagtgttatcattccattctgatgaaaccaattaacttatccaagcatatgtatactgtacacagagaagccaacgtcaaaacccctatttttatctttttagattcagcagatacatgtgcaggttttttatgagtatattgcatgatgctgaggcttgcattaatgatctagtcaccaaataggtagattttcaagccttgctcccctccttacccaatgtttagcgctctcacttataagtgagaacatgtggtatttggttttcttttcttttttttttttttttttgagatggagtttcactcttgttgcccaggctggagtacaatggcaccatctcggctcactgcaaccttcaccttccaggttcaagcaattctcctgcctcagcctcccgagtagttgggactacaggcatgtgccaccacacccggctaattttgaatttttagtagagacagggtttctgcatgttggtcaggctggtctcgaactcccgacctaaggtgatccacctgcctcagcctcccaaagtgctgggatgacaggcgtgagccaccgtgtctggccagtatttggttttctgtttctgtgttaactcgcttaggataatggcctctagctgcatccatgttgctgcaaaggacataatcttgtgatttttcaaggctgtatagcgttctgtggtgtatacatatcacattgtctttatccagtccacctctgatgggacctgggtggattccatgtcttcactattgtgaatcctgctgcaatgaacatacaagtgcatgtgtctttttggtagaatgatttattttcctttggctatatacccagcgatgggattgctgggctgaatggtaactctgtttgtagttctctgaaatatctccaaaccaaactgctttccacagtggctgaactaatttacacccaccaacagtgtataagtgtcccctttgctccacaatctcaccagcatctgttaatttctggcttttcagtaatggccattctgactggtgtgagatggtattgttgagggataatttaggaatcagagagaccgaggggttgaggaggatttattattattattattatttaggtgcaccggccccagtcagattaacatccaaaaagactgaggctcgaacagagagtccggttaccttttaagcattttgtggggttgggggagatctgtgcagggggaagcatattacagaagcaagaaacaaaggcagttattcaattgagacatgcatcacattattccttacttttcaagaaaaatatgttttacgacttgaggttatcctgtctagtgatcttgcagccgcacggcaagagaaacagggtcttcacaatgcctgggaaagggagagataaggctcactagccacagacagaaaaacaggcagttcatgtttaaaggactccacctctttctcttcctcggggggaactgggttttcttaaatacaactgagtttttgtttacacattctgtaatttcttttaattcctgttccagtatctcactgtgaaactccctatgtttttatacgattctcagggggtttcctctgggcatgattgggcacaacttcccacagtcagctctgggtacgacctccacattgcagaattgagaagttgacccagaaatgcattttgggctgagcagacaattgtcagagttgctggctagaccacagatgtgtcagagggaccacggcctttctgtaagctcatggtcagaggcggaggggagttgtgaacgttctgatgaaagcagtcaacgtgaaagcgctctggtgatgggcgctggtgctcacccaccacttcctgtgtatctatctccctggcccgcccggctcagtccccactgctcagcactaggccggcagaatctgagcgatgtcttccacactccctgccctgctctgcgtcggtgagttctggcgtggaaggggaatgggatcacggtgtgcctgggaggcaacaggtctcattactcccgtcttccagggctgtgtctgagtcagaggatcagcgcccagcagcgtgagtccttccttcaaagcccagggtcactcttccgggttcaggccaagctccttccacccaagcacggctggggagaggggacagggtgctggcttcccaggagagcttggggccagcagctgggtggagcctaaggttggggggagggggctccgctggaactccagcctctgattcccttccagagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacaggtaactgtccggttctctaactggagagtgatctcagtctgcatccgggatgcagcatcatctatgaactcttccaagccccactcagacactgcttgtctcggtaggaggctggaaggaggggtgatccccatcacaatccttgcctacaaggggttgtctgcagaccgtgtctctacgtcctaggagcagatgtgtcctcagtcagtttctccatgacacagattctgagatagatatttgtatgcaggggtatgactgaggaatgtcctcaaaaacaatgcctgtgggctaggcgcagtggcttacactttgcttccctcacccatcacaggtggtgggttttttttttttttatctgttttgagacggagtttcgctcttgtcacccaggctggagtgcagtggtgcaatctccagtcactgcaacctccacctcctgggttcaagtgattctccagcctcagcttcccaagtagctgggatcacaggcacccaccactacgccacattttgtatttttagtagagatggggtttcaccatgttggccagggtggtgtcgaactcctgacctcagatgatccgcccgcctcaccctcccaaagtgctgggattacaggtgtgagccatcacacccagccaggtggtggttttctaaaaaaaaaaaaaaaaattagctttttttttttttaacaatatggttgtttattattattatcaagtattatacatagttacatatacatacataattgtatgtgctatacaattaggtttgtttataccagcaacaccaaaaacacatgagcaatactttgtgctaggaaggctatgatgtcatcaggcaataggaatttttcagtttcattataatcttatgggaccaccatcatatatgtggtacattgttggccaaaatgtcattatgcagctcacaacagtatttcatgtccattcaaatatcttcttttgtgaaatgtctatttaaatcttttgcctatttttaaattgggttgcttatattttgattgattaggaaaagttatttctatattctgtgtcatatacttgtgttgaaatatatatattttttgtctgtgccttttcatttgctcagggtctttggaccttgtttggaggttctggcaggggaacacagctactcatttattcttttttttttaatttttttagtatttattgatcattcttgggtgtttctcggagagggggatttggcagggtcataggacaatagtggagagaaggtcagcagataaacatgtgaacaaaggtctctggctttcctaggcagaggtccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacatagcacatgtttcagagagcacggggttgggggtaaggtcatagattaacagcatcccaaggcagaagaatttgtcttagtacagaacaaaatggagtctcctatgtctacttctttctacacagacacagtaacaatctgatctctctttcttttccccacatttcccctttttctattcgacaaaaccgccatcgtcatcatggcccattctcaatgagctgttgggtacacctcccagacggggtggcggccgggcagaggggctcctcacttcccagacggggcggccgggcagaggcgcccccccacctcccagacggggcagtggccgggcgggggctgccccccaacctcccggacggggcggctggccggggctttttttttttttttttgagacagtctcgctgcagtgcagtggtacaatctcagctcactgcaacctctgcctcagcctcaattctcctgcctcagcctcccaagtagttgagattacaggcatgtgccaccacacccggctaatttttgcatttttagtagagacggggtttcaccatgttgaccaggctggtctcaaactcctgacccaggaggtcgagtcttcagtaagcaaagatagtgccacggcgctccagcctgggaaacagagcaagaccctgtatcatttttaaaaatggttttagacggtaaatcttctattgtgtgtatttgaccaaaataataattaaaaaaaaaaaaaaagctggctgccaggcatggtggcaggcccctgtagtcccagctacttgggagggtgaggcaggagaaacgcttgaacccgggaggcagaggttgcagtgagccaagatcgtgtcactgcactccagcctgggcgacagagagagactccatctctaaagaaagaaaaaaaaaaatagctggctgctcatcactgagtttctggtgtggtggccccaccttctctcatagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggtgaggaaatgctcaattccccacacccttcgccgccatgtcctacctggagccctgagggatccccagagagtgatggggagggtgtccaagggacgtccacttcctgggtgcctggttggtcatgtgaggaagaacaccagaagcaggaaggaggagggagcagagaaaggaatggtaaggcgggtggatcacaaggtcaggagttcgagaccagcctggccaagacggtgaaaccccgtctctactaaaaatacagaaattagccagacgcagtggcggacacctgtagtcccagctactcaggaggctgaggcaggagaatcgcttgaacccgggaggcgggggttgtagtgaaccgagatcataccaccgcactgcaacctgggcgacagagcaagactccatctcaaaaaaaaaaaaaaaaaaaaaaagaatggcaagaccggaggaaaccaaaaacccttacttttttttctttatctccttttccaggcgacattgagaacaccagccttgcacctgaagaccccacctttcctggtgagtaactggtccttctaagctcagacgagcgatcagagcctcccagtgacactaaaaacgtggcattcattcaaaatattcatcgaggccaggcgtggtggctcacgcctgtaatcccagcactttgggaggccgagatggtgcatcatttgaggtcaggagtttgagaccagcctggccaacatggcgaaaccctgtctctactaaaaatacaaaacttaggctgggcatcatggctcacacctgtaatcccaacacttcgggaggccaaggtggttggatcacaaggtcaggaattcgagaccagcctgaccaacatggtgaaaccccatctctactaaaaatacaaaaattagccgggcctggtggtgctcgcctgtaatcccagctactcaggaggctgaggcaggagaattgttgaacctgggatgcagaggttgcagtgagctgagatcgcgccactgcattccactccactgcacgacacagcgagactccatctcacagaaaaacaaaaacaaaactattatatatatatattcatcaagtgcatagtatacacagtgaactacactgtaacagtcagccaggcagatatcttgactctgcagcacttagattctagcaggaggagacacaccatcggtcaacgtcaggatagcacacaggagggaatgatgctatggaaggaaaagacaaagtagaacagacttacagtgattgaaatggcagctagcaatattaaataggtttgtccagatggacctcacagagaaagaaggcatctgagcaaatgcgttcagacttgagttaatcatgtggctgtcaggagaaaggaggctctggagagaatgaaatggcatctgcctgtgccctggggcaggaagataactggggtaatacaataataactatgaggccaggagggttgaaaatgatgtttggaagatgacggtgggatgggcctggggcgcacggctaggattacaggagtgaggcccggcgcggtggctcacgcctgtaatcccagcactttgggaaaccgaggcaggtgggtcatgaggtcaggagatcaagaccatcctggctaacacggtgaaaccctgtctctactaaaaaaaaatacaaaaattatccgggcgtggtggcgggcgcctgtagtcccagctacacaagaggctgaggcaggagaatggcgtgaacccgggagacggagcttgcagtgagctgagatcgcgccactgcactccagcctgagcgacagagtgagactccgtctcaaaaaaaaaaaaaaagaaaaagaaaaagaaaaaaaaatagtgagactttgaatttcactatgtgtgtatgtgtgaggagaaagaggtaatgatgacttaatgaggaaaatgaggcttaaatagaagacgggctgggccgggtggctcccgcatgtaatcccagcactttggaaggcaggggcggctggatcacttgaggtcaggagttcaagaccagcctggccaacacagtgaaaccccatctctactaaaaatacaaacatgagttgggtgtggtggcgcacgccagtaattacagctactcggggctgaagcaagaggattgcttgaactcgggaggcggaggttgcagtgagctgagatcacaccactgtactccagcctcagaggcctgtcatcccagccctttgggaggccgaagcaggcaggtcatctgaggttgggagttcaagaccagcctggccaacatggcaaaaccccgtttctactaaaaatatgaaaaaaattacctgggtatgtggtgtgtgcctgtagtcccagctactccagaggctggaacacagtgagactctatctcaaaaaaaaaaaaaatagaagacatgactggtgcaaagacacatgctcacaagtgctagaatggaattcctcgtcaggttcgtccatctgtggacccttccactttacctgctggatgaagctcctgggacccgcagggtgaggtgggaccttgtaaagctgcagaacgtcatggggtagacccaagggaaggagtgctggggtggaggaggtcaaaaccatcctcttttcttcacttcccttatcatcagcagacacttggggcacctaccttttaaccacagagacgggactccagaaaggtaagtagacagctggggccataggctctgaaggaaggggctgggcatagagtagacctaggaagggaatctaaatgggaacaagagggtgtccttggccaggcgcagtagctcacacctgtaatctcagccctttgggaggccgaggcgggcagatcatctgaggtcgggagttcaagaccagtctggccaacatggcgaaatcccatctctactaaaaatacaaaaaaattagccaggcgtggtggcgtgtgcctgtagtcccagctacttgggaggctgagacaggagaatagcttgaacccaggaagtggaggttgcagtgagccgagatcgtgccattgcactccagcctgggcgacaagactgaggctctgtctcaaaaaaaaaaaaaaaaaaaaaaaaaaaaaaaaaaaaaagagggtgtccttacatccctgtcagcgatcaccctgttctcctgcctacagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagagttttctcttgttgcccaggctggagtgcaatggcgcgatcttggctcactgcaacctctagctctccatccctcgggttcaagtgattctcctgcctcagcctcctgagtagctgggattacaggcatgtgccaccaccccagctaattttgtatttttagtggagacggggtttctccctgttggctggtctcgaactcctgacctcaagtgatctccccgccttggcctcccaaagggctgggattacaggcataagccgctgcgcccagccactgaatttcttctgtagacaaatcctatggtctcttctaggctctaactatttttgtaccacttactgcaaaccatacttttaaccactctggtcttttctgaaaagatctctccttctttaacaggatggccatggaaatatttttttcctactttggtctttttttctttcctttctctgcaggaagccattcaaaatagttaataaccaatatagaataggtctgtatcaaatggttcaggaggcattgtggcaacaaccagttgtagagaagcagctttataagtgaatcctgccaggcacggtggctcacacctgtaatcccaacactttgggaggctgaggcgggcagatcacctgaggtcaggagttcgagaccagcctggccaacatgatgaaaccccatctctactaaaaatacaaaaactcggccaggcacggtggctcatgcctgtaatcccagcactttgggaggccaaggtgggaggatcacctgaggtcaggagttcgagagcagcctggccaacatggtgaaaccacatctctactaaaaatataaaaattagccaggtatggtggcgtgtgcttgtaatcccagctactcaggaggctgaggcaggagaatagcttgaacccgggaggcggaggctgcagggagccaagatcgcaccactgcactccagcctacgtgacagagcaagattctgtctcaaaaaaaaaaagaaaaaaaaaaaataagtgactcctggctgcatcccaaccataccccaattccttctaaccacagaattattccatcttctcttccttttttttttttttctttttttttgtttgttttgttgggacagaatttcactttttttttttttaatgtaagttttagggtacatgtgcacaacgtgcaggttagttacatatgtatacatgtgccatgttggtgtgctgcacccactaactcgtcatttaacattaggtatatctcctaatgctatcccttcccccgagtttcacttttgtcacccaggctggaatgcagtggtgcaatcttggctcactgccacctccacctccagggttcaaatgattctcctgcctcagcctcctgaatagctgggattataggcatgcaccaccacgcccggctaatttttgtatttttagtagaaatggggtttcacaatgttggccagactggtcttgaactcctgacctcaggtgatccaccagcctcggcctcccaaagtgctggaattacaggtgtgagtcaccgtacccggccaccatctttgcttctttatccacaccttgccttgttcttcagggctctgcagagatatcatttcctccaagagtttccacaactccgacttcacaaagatagcacttttttttttttttgagacagtctcactctgtagcccaagctggcgtgcagtggcacaatctcagctcactgcaaccttcgcctctggggctcaagcgattctccttcctcagcctcccaagtagctgggactagaggcgcgcgccaccacacccggttaattttttttgcatctttagtagaggtagggtttcatcatgttgccctgggtggtctcaaactcctgagttcaggtgatccccccgccttggcctctcaaagtgctaggattacaggcgtgagccactgcgcccagccaagacaacactttcctcatcccaaagcacctgttaattccctgtaacagcacttgaaccctgattcggcatgcatgtccattttcctgcctctaccgtgaactcgtgtgaattgatctatgtcagatttagtggctgcattcacagctcccgcaactataacggggttctcgggaaatatatatcaaatgagtgaatgtatatacggggctgtggcacagcctgcaacttgagacttctcactaggggtcttgaaatgctgtctggacaccaccatcgctttcctccctgagaacttctacttatcaacccatttatatactcatcgcatgggtcctcacgccctcccattattctggtgcctcatgccggtcaaatttattctctaaatctgatttttccattaaatagcagcctggccaacacggtaaaaccccatctctactaaaaaatacaaaatattagccaggcgcagtggcttgcacccgtaatctcagctactcgggaggctgaggcagcagaatcacttgaacccgggaggcagaggttgtggtaagccgagattgcaccactgcactccagcctggtaacagagcgagactccctctcaaaataaataaactgctgactcgcgtattttttctttaccccaactcattccttacatgtaggcacctgtaatcctagctactcagaaggctgaggcaggagaatcgcttgaacctgggaggcggaggttgcggtgagccaaaatcgtgccactgcactccagcctgggcgacagagcgagactccatctcaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactggtgaacagtgaataaatggttgtatattcctaataagaaaaaaaaaaaaaaagacccaaagtacagcgagctgatgccgatctcatttcgcagaggtccgcctgctctcccctctccaagagtgtaatcctctgcttaataaacttatgccgctttgctatatgtgtgtatcacacccaattctttgttcgaaacaccaagggcctggaacttcacagctttggctggtaacggggagcaggggtaaagacatttaaaagctgcttgtgttaaccataatcgccatcccatatatcagacccccagaactaactcatcttataactgaatattgtgcttttttttttttttttttttttgagacgaagtcctgctctgtcacccaggctggagtgcagtggcgcgatcttgactctgcaacctccgcctcccgggttcaagcgattctcctgcctcagcctcccgagtagctgggactacaagtgcgtgccaccacgcccggctaatttttgtatttttagtagagacggggtttctccatgttggtctcaaactcctggtctcaggtgatccacccgccttggcctcccaaagtgctgggattacagacgtgagccaccacacccagctacttgtgctttttgaccaacatcttcctctcctaccacccccagcccctgataacctccacctactctcacttctaggagatcaactgttctattttttttttttttttttttttttttgagtctcgctctgcacacccaggctggagtgcagtgctgcaatctcggatcactgcaacctccgctttccgggttcaagcgattctcctgcctcagcctccagagtcgctgggattactgagccaccgcgcccagccagaagacccacgctccctaagacataacccacactggtggcctttgttctgacttctcacctgtgctccccacccgctagaaactggcttctctccccacacttcctctgaagctgtctgtgtgaccaacactaatgagcttccttcctggaacatgcagtgacccttttcagcccttctcattattgctcccccacagttgtatttgacacgttgaccacttcctcctcgaaggactcacttctctggctttctcggacacttcttgctactcgttttctgacggttacagtaccaacaggtttgcaggcacctccaccaccagagccaatcccagctactcgggaggctgaggcaggagaatcgttcaaacccgggaggcagaggttgcagtgagtcgagattgcgccactgcactccagcctgagtgacagactgtgactcctcaaaaaaaaacaaaaacaaaaacaaaaaaactacagtcttgctctgtcgcccaggatggaatgcagtggtgccatcttggctcactgcaacctctgcctgctggggtctagcgattctcctgcctcagccccccaaggagctgggactacaggcatgtgccgccacgcctggctaatttttgtatttttagtggagatgggggttttaccatgttagccaggttggtcttgaactcctgacctcatgtgatccgcccaccttggcctcccaaagtgcgaggattacaggcccccgcacccagcctaggatcctgcacctctctagcctagcagttctctgctgggtgattttgctctccactccaggggacatttggcaatgcccatggtaatttttaattgtcatgacttggggaggggttctactggcatctggtaggtagggtccaggggtgctgctcagcttcctacaatgcccagggcagccccagatggcagcagcaccaaggctgagaaacactggctcatgcagaaagcaaccaccttacacccttcagtgcagggacaaaggcagggttacgagtccacggaaactctccagtctcagcctacgtaagacgtggctatttttctttcttattgtttttattcatttatttttcttgagacagagtcttgctctgtcgcccaggctggactgcagtggcgcgatctctgctcactgcaagctccgcctcccgggatcacaccattctcctgggactacaggcgcccgccacctagcccggctaattttttgtatttttagtagagacggggtttcaccatgttagccaggatggtctcgatctgacctcgtgatcctcccgcctcggcctctcaaagtgctgggattacaggtgtaagccaccgcacccggccttattcatttattttttgagatagagtctgagccctttattttatttatttagagaccaagtctcgctctgttacccaggctggagtgcagtgtcgtggcctcagctcactgcaacaacctccgcctcccgggttcaagcgattctcccaccttggcctcccaaagtgctggcattacagacacccactaccatgcctggctaattttttgtacttttagtaagtaaagacagggtttcaccatcttggtcaggatggtctcgaactcctggcctcaagtgatcggcccgcctgggtctcccaaagtgatgagattacaggcgtgagcgaccacactggcctaatgtgtagttttttatctgtggcctcccttctgccctcccccttctgagactctgaagcccattacatcactctgcctttgtgtaccaacagcttagctcccactgagaacatacagagccaggcacggtggcggtggctcacgcctgtaatcccatcactttgggggtgctgaggcaggtgtatcgcctgaggccaggagttcaagaccagtctggccaacatggtgaaaccccatctctactaaaaatagaaaaatacatagctgggtgtggtggcacgtgcctataatcccagctactagggaggctgaggttggagaatcgcttgaacccaggaggcggaggttgcggtgagccaagatcacaccattgcactctagcctgggcaacaagagcaaaactgtcttaaaaaaaaaaaaaaaaagtgagaacatatggattctactcctgttagaataatggcctccagctccatccaaattgctggaaatgacattatttcattccttctaatggctgaatagtattccatggtacatagacaccacgttttctttatccactgtagggaccagccccacagggtcggtgggtctctccctgtgtgcggcgacgagagagtgtagaaataaagacacaagacaaagagacaagagaaaaggcagctgggcccgggggaccactaccaccaatgcgcggagaccggtagtggccccgaatgtctggctgcgctgttatttattggatacaaggcagaaggggcagggtaaagagtgtgagtcacctccaatgataggtaaggtcacgtgggtcacgtgtccactggacagggggcccttccctgcctggcagccgaggcagagagagagaggagacagagagaaagacagcttatgccattatttctgcatatcagggactattagtactttccctaatttactactgctatctagaaggcagagccaggtgtacaggatggaacatgaaggcggactaggagcgtgaccaccgaagcacagcatcacagggagacggttaggcctccggataactgcgggcgagcctgactgatgtcaggccctccacaagaggtggaggagcagagtcttctctaaactcccccggggaaagggagacccccccccccacccgctgcccctttcccggtctgctaagtagcgggtgttgttaattgacaccttttgctaccgctggaccatgatccgcttggtgacgggtgtcttcccagacgctggcgtcaccgctagaccaaggagccctctggtggccctgtccgggcataacagaaggctcgcactcttgtcttctggtcacacctcactatgtcccctcagctcctatctctgtatggcctggtttttcctaggctatgattatagagtgaggattattataatattggaataaaaagtaattgctaccggctaatgattaatgatactcatatataatcatatctaagatctatatctggtataacaattcttgttttatattttattatactggaacagctcgtgtcctctgtctcttgcctcggtgcctgggtgccttgccgcccacaatccactcattattcaatgggcacttcggttggttccacatctttgcaattgtgaatggctgagccagccattcttaactgggggtgattttgtccccatgggggtatctggccacatcccgagaggttttttggttgtcacgagttgcagtgggggcaggctcaggctcatccaagtccaggggtgctgctatacatcacgtgatacacaggacagtccttgctacggactgaattggtcccaccaaacgtcatgtacaagccctaccccagatgtgactctatttggacacagggcttttcagaggtaattaaggctggtcaggcgccgtaatcacagcactttaggagttctgtgtttattactggtaagtgggtaagagcccagtgtggcagctcacgcgtgtaatcccagcactttgggaagcgaaggcaaggggataactggaggccagcagttcaagacaagcctggtcaatacagcaagactccatctctataaaatattttaaaattagccaagcatgtttggcatgcacctgtaatcccagctcaggaggctcaggtgggaggattccttgagtttaaggctgcagtgagctaagatcgcaccattgcactccaacccggctgtgggcaacacagcaccaccaccatcttggctgggcacggtggctcacgcctgtcatgccagcactttgggaggccgaggcgggtggctcacctgaggtcaggagtttgagactagcctggccaacatggtgaaatcacgccactgcactccagcctaggcaaccaagtgagactctgtccgccccaccaccccaccaaaaaaaagactactatcttaaacaaaatcaaaatttttaagtagataaaatatttaggggaaaaaaacttcaattaaatatgcagcagagtccgacccagatgttttcactcccagcctctacctactatctttgtgtctttatttttagcaaattctacacgggaacttcatgtgcatgtagaaccctaaatgttgactcagccctacctctcatcacctgaccacttcctttattcacgctgtctctaccacccttcccatcggtgtgagctgtatcccgctaaacactgttaccacccacagcctgcattactaccagctgactgtagccttaaacaccacagtgatctcgagcatttgagaagacttatcttgacaagggctcacgaaagacagcaatgctcaacagcaagataaatgagggccttcatgggatcattcagtgctgaagccactcaacctccaggtttgggttagtaaaaagaactttgtcaggccaggcacagtggctcacgcctgtcatcccagcactttgggaggccaaggcgggcagatcacctgaggtcaggagttcaagaccagcctggctaacatggtgaaacctcgtctttactaaaaatacaaaaattagccaggcatggtgacgcacacctctagtctcagctactccggaggctgggacagaagactcacttgaacccaggaggcagaggttgtagtgagccaagatcgcaccactgcactccagcctgggcgacagaggcaagactccatctcaaaaaaaaaaaaaaaaaaaaagaaaagaaaactttgtcatacaagctttcaacctaaagcattagccatatgcccgtgtttttgtgcctgggaccatgacaactttccccatatcaatgctcttattttttttttttcgagacaagagttttgctcttattgcccaggctggagtgcagtggcacaatctcagctcaccgcaaactccgcctcccgggttcaagcgattctcctgcctcagcctcccgagtagctgggattacaggcatacaccaccccacccggctaattttgtatttttagtagagacggggtttctccatgttgaggctggtctcgaactcctgacctcaggtgatccgcccgcctcggcctcccaaagtgctgggattacaggtgtgagccacagcgcctggctgctcttattaaaatagtctcatcacctaccgcaagtgtggagagccaagtgaggagaggggtcagtcccttttggcagcgcctggaagccagtgctaacatcatggtgacaacttttcattcttaaggaaaattgcggagtgacttctatgcattttctatgaatgaccaaatacagggtgtggaaaagctgtgtttgccatggcaatgggaagccgagagaaacggggaggcgagagagacagagacatacacagagactcccagagacagccacacagactcacacagaaacagacagacaggctgggctcggtggctcacgcctgtaatcccaccactctgggaggctgaggcgggtagatcacctgaggtcaggagtccgagaacagcctggccaacattgtgaaaccccgtctctagtaagaatacaaaaaattagccaggcatggtggcacagggctgtaattccggctactcggaaggctgaggcaggagaatcacttgaacctgggaggcgcggttgcagtgagctgagatcacgccattgcactccagcatgggcaacaagagtgaaactccgtctcaaaaaaaaaaaaaaaaaaacgaaagaacagagagacacatacaaagacagagatagaaacgcccagcgacagagagacacacagagaaacacagacagacacagagacacacacacagaaacagacacagagacagagagacaaaaagacagacacagagaaacaaagagagacacacagagacagagagagagagagacacatacacacacacacagagagtaggaggcggcccgtgggagccgagcagaaccagcgtgaggcagggccatcttctgaattaaaggcaacagtgactgtaagcttctgctttgtgagtaacaggatagattagaacagggctggctgcctatggcccacgagctgtttctgggaagcctccgcaggtgccagccaggccctgcgctgcttccatgtccaaaggcacagctgagagctgatgagagaccgcggggcccacagtgccaagcatatgaactatctggcccgtttgtcaatgcgtgggttgatcacataagttatgatcacataagtcacaaagacacactgatcacatagatgcacctggcagctagtagaccacgtggtgcctgagttagggaagaaaagaaatagaagaatcaaccgaatcatccctgaacttcttagcaatacttcctcctagacgaagcacagagtaccatgtttattgcaggtttgctcctgagcatgtcaataaacgcagctgcaacgagagtgctctaactttattatccctgtgagaaagtacatagcgtcatgtgaagggggtgcgtgactcgtgcagaatctcccaaaaatagtgagaaaaccagtgtcaaatcctacctctcgacagactctagtgttaacatgtgaccctctgacctgcattcataagacatcttagagacccgaatcccgcttcctgtgtaattcgtagagcgatcccaggctgctcagcaaaaaaagtcacagcacggaggtgccgttgccccggaagcattgcaatcaatagtcagcttgggattcttttctttcacttcctccaacagcttcttgatttccaaattagtttcataggtcttcaacctggagggatcagagaacacaaatgttcccagaaattcattctcaactacccaggatgcctgaatatctgttttcaaacactcaaagcaggaaacgtttttgggattttctgggggacagggtcttgctctgttgcccaggctggggtacagtggtgccatcttggctctctgcaacctccagctcccaagttcaagcaattctcatgcctcaggctcctgagtaactgtgattacaggtgtgcaccaccacgcttggctaagttttgtatttacagtagagatggggtttcgacatgttagccaggctggtctcgaacttctggcctcaagtgatccatccacctcggcctcccaaagccatgggattacagatgtgagccacagcacccagtcagaaaggttttctaaaaagaaatttagacccacacaatggggatccttataagtctaagaaaaaaaagattatggccaggcacggtgtctcgcacctgtagtcccagcactttgggaggccaaggcaggcagattgcttgagctccgcagttcaaggccagcctgggcaacacggtgaaaccctgtctctaccaaaaatagaaaaagttagccaggaatggtggtgcacgcctatagtcccagctactcgggaggcggaggcaagaggatcacttgagcccaggaggcggaggttgcaacgagctagagattgccctactgcactccagcctggtaacagagtaaaacatgcctttaaaaaataaatttaaaaaatagataatcaggctggtgcacggtgactcacgcctataattccagcactttgggaggccgaggcgggcagatcacctgaggtcaggaattcgagaccagcctggccaacatagtgaaaccccgtctctactaaaaatacaaaaattagctgggcatggtggcagacaactgtaataccagctactcaggaggctgagacaggagaatcgctttgaacctgggaggcagatgttgcagtgagccaataccgcaccactgtactgcagcccgggtgacagagcgagactctgcctccaaataaataaataaaaaatagtggcaaatcaaaccttcagtagaactaagagaatgccagagtgaaccccagggttaatgatagcaaacttggctctaacgtggctgcagcatgcaagcctgtgtatgtgaacatgaggggtggtgattgtggagacactggcttgctatgttgcccaggctggtctcaaactcctggcctcaaacaatcctcccaccttggcctcccaaaggaggaactgaggaatgagaaaagaaatacgccccaaacatatgacataagagaccacagggggctagagatttgtcaccaatagtccttggtggcattacagacctcggtcccaccaacaagagaagcatgacactatttagctcaagtttcatgatatacccctaaaaccttaacccatttatgccagaggttacaattatttgaactgcagacgtgtgaaaaatcgtaccttgagcaggatataaataactcccacatgcttagcgttccaataatgcaacactgggcatcatgaagcagtttacatgcgtatcatctctacaactaaaataactcttgaataagacaagtgggctgtgcacagtggctcacgcctgcaatccgggtactttgtgaggccaagacaggaggatcgtttgaagccaggagtttgagaacctcggcaacacggccacacagtgcagcagagcaaaacgttgtctcagaaaagaaaagacaaaggcaagaagaaactaaaggtagattacgttaaaataagtcactgaggccgggcgcggtggctcacgcctgtaatcccagcactttgggaggccgaggtgggcagatcacctgaggtcaggaattcgagaccagcctggccaacatagtgaaaccccatctctactaaaaatacaaaaaattagccaggcgtggtggcgggcgcctgtagtcccagctgctcgggaggctgaggcaggagaatggcgtgaacccgggaggtggagcttgcagtgagccgagatcgcaccgcttcactccagcctgggcaacagagactggagtctctgtctcaaaaaaaagacagattcaaaaaaaaagacagactccgtctcaaaaaaaagactccgtctcaaaaaaaaataaaaaatacaaataagtcattgaaaagatatacacgggtcacaactaagggagcatctgtaggacgatcttctgaaaagctaagacccaggacagctctgggaactacctatttttggatataatgattaggggtgtgtgtgtgtgtgtgtgtgtgtgtgctcatgcacacacatacacacaagcttccagtctgtactccaggatgatttaaactctcagtatgcctaggactaagtgttttgggggaaagttggacaatattcaattcacagagcattttagaaaagtatctaatttttaaattatctcctaagctaggagtgtgctatagaaagatgccttaagttgatccctacaaagagtacacacactcccaaaaaaactcttctctgcatgggaaattcaccatgtgaaacagccatcccagggccgagcacagtggctcacacctgtaatcccggcactttgagaggctgaggcaggtggatcacctgaggttgggagtttgagaccaacctgaccaacatggtgaaaccccatctctactaaaaactacaaaaattggccaggtgcagtggctcatgcctgtaatcccagcactttgcgaggccaaggcgagaagatcacctgaggtcaggagctcgagaccagcctggccaacatggcaaaaccccatctctactaaaaatacaaaaattagctgggtgtggtggcgagcgactgtaatcctagctactcaggaggctgaggcaggagaatcacttgaacccaggaggcagaggttgcactgagccgagatagcgccactgcactccagcctgggggacagagagagactctgtctttaaaaaaaaaaaaaaaaaaaaaaaattagccagctgtggtggtgtgtacctgtaatcccagctactcaggaggttgaggcaggaaaatcgcttcaacctgtgagaaggaggctgcagtgagtcaagatcgcgccactgcactccagcctgggcaacagtgagactccatcccaaaaagcaaaaaccaaaaaggccgggtgcaatggctcacctctgtaatcccaccactttgggaggccgaggcaggtggctcacctgaggtcaggagttcaagactagcctggccaacatggtgaaacccctctctactaaaaaattagccaggcgtggtggcaggcatctgtaattccagctacttgggaggccaaggtgggagaatcgcttgaacccaggaggtgggggttgcagtgagccaagatcgcaccactgcactccagcctgggctacaagaacaaaactccatctcaaaaaaaaaaaaagaaaaagaaaaaaattagctggacatgttggcatgcctctaggcccagctactcatgaggctgaggcatgagaattgcttgaacctgggaggcagaggttgcggtgagccaagattgcgccactgcactccagcctgaatgacagagcacgactccatctcaaaaaaacaaaaacaaaaaacaaaacaaaacaaaacaaaaaacccatacctgagtatcttcaaggatccagttctttgtcttagaaccccaaagagcttaattatgccactcttccacaaatgattctggcccaggtccagagtttcaagcttctgattgctgaggagagcagatccaagatgctgacaatagaaaggcatgagggagcagctccagaggctgttgaggaagaacatggaaatccacgcattcactgagcaggtagtggctcaagcgtgtaatcccaacacttcgggaggccaaggcgggtggatcacttgaggccaggtgttcgagaccagccttgccaacacggtcaaaccccatctctactaaaaatacaaagattaggcagggcgtggggacagacacctgtagccccagcaccttgggaggccgaggagggtggatcacctgaggtcaggagttcgagaccagccaggccaacatggcaaaaccccatctctacaaaaaattagccatgcatggtgttgtgtgcctttaatgccagctacttgggaggctgaggcacaagaatcgcttcagcctgggaggcggaggttacagtgagccaagatcgcaccactgcactccagcctgggcaatagaatgagactccatctcacaaatatataacataaaatgaaaatacaaaaattagccaggtatggtggagccacctataattccagctactcgagaggcaggagaatcgcctgaaccaggaggcagaggttgtagttagccaacatatcaccactgcattccagcttgggtgaaagagtgagacttggtctcaaacaaaacaaaacaaaaaaacaagcagcatatttgctggggctccagtagtgaggaaatgcagaggggagtgagcggaagaaatccttgtcctcagagtttttagtgacagcagacatctcgatatgttctattgaagacaatggatgatggtattaaaataaacagggtagaggtaagtcaaacagagaggcattgattggctagacttatgctggtcatttaagtcctcttttggaaagtgatatgaggaaagaaactgaaggatggtagatcatgaaccagcatgctaactgggggagggaatcttgtaaataaaatactgagctagtgagaaagtagaatgatttatggctcataacttacacgaggatcccccataaggccctgtaggccactgtagaagcctttggttttgtttttttttaaggcagagtttcactcttgttgccaaggctggagtgcaatggcgtgatctcggctcactgcaacctccgcctcctgggttcaagcgattctcctg

SEQ ID NO: 12031 - DNA, 34314 bp, Human
ccgcagtgtggagctgcgctcaagtctcggcaactttcaccatcttgacccgagagtcgggccgtttctaagacaatgtgaacaaagaggagcagggggagggaaggggggccccgcgggagggctgtgggcgagtgtgtgtgtgtgtgtgtgtgtgtgtgtgtgtgtgtgtgtgttggggggcgccgcgctccgcgcccgccgccactggggatccgggcgcaggcaggctgtcccgggcgcagagcgcgccgcctccagtctctctggcgggcccggcccggcagggcccctggcggcccccggaggcgggtttctttgtccctgactcccgctgggcgcgaaggccgccggcggctaacagaaacccgagcccgcgcaacggagctcaggcttccacgtgcggccccgcagggcagagcaggaaggagcggctgcagccccggggcgccccgcaagcatccagtgcccggccctcccagctccgcggcgggcttcggacggtggagtgagacaccagaactcgcctttcgcttccccgagccgatgcacggcttgggatggcgccgctcgtcctaagcagcgtggtttgagggcgagaagacgcctactggagcgctcccctccacccagactcccgaagacgcgcgcccgagtcgaagtcggggacagagaaggttctctggcgcccccctgccgactgctttgcggccgccgggacccgagcagcggggcgggacctaaacatagccccaacccaaagatgcccagcagaacgctccaaacaaaacagaaacggtggccgcatctgcgtgtgtgtgtgtgtgtgtgtgtgtgacgggggagaggagttgatcttacctgaaacatagtttgcgcttctgtgtgtgtggccgaagaatggaagagaaactgccatggccatccgagtccattaaatcaactccccttccctccgactctctcaactcagtcatattctataatacaacgcaaggttacagagccccagtgaaaactagtttcccagtttcactctgaccctccatcaatgtagccagccagctagattgtaggttaccggcttctattctgcaggagaactttgagtctcgggagactcagggtttcttcctcccgcctctcgcagtgcatctttcatttgcttttctttgtaaagccagggctcctcgactgcctcccaggaagtcctgcgctctggcgcgccgcacctcgcctgccgcagagcggcgcgggcagtaagccgggcgctaggaccgcggggagcccgggctgcggcggcgctaccttaaacccagcccaatgccgctgcctgcgccactctgcgcgccggcgggggctgcgcaggaggagcgctccgcccggctacaacgctccgcgagccggcgcggcaacacctgttcgcggcagcctgggcggcacgcgagctcccggacgcggctctcctcgctcgccgctcgccacccgttctaagccaatggacatctgccgagcctctggagaatcctggatactagctttggacgcctaaagtttcttcttctttttgttttattattattatcattttttggaggggggaccgggaggggagatttgtcgccgccaccaacgtgagatttttttttccccttgaaggattcatgctgatgtctgcagagtcggttagagagtaaaaacagcgcatgccttcctggagtcaggatccgtaaattctgacgtagcccgtgcatcttaaaaatccctataataacgcctaggcatttaagttgctatggtcattctgatctcaaaccaaatggagaaactacggattttttttccttattacggtcggatgggatgaagaccttcctgcctgctaagagctggggatctatctatagagatacatagatatgtttatcaatatgtcagtgtgtgagtataaagtggtggtttcttagactatcagtggtttgaccttgaacctgtgccagtgaaacagcagattacttttatttatgcatttaatggattgaagaaaagaaccttttttttctctctctctctgcaactgcagtaagggaggggagttggatatacctcgcctaatatctcctgggttgacaccatcattattgtttattcttgtgctccaaaagccgagtcctctgatggctcccttaggtgaagttgggaactatttcggtgtgcaggatgcggtaccgtttgggaatgtgcccgtgttgccggtggacagcccggttttgttaagtgaccacctgggtcagtccgaagcaggggggctccccaggggacccgcagtcacggacttggatcatttaaaggggattctcaggcggaggcagctatactgcaggactggatttcacttagaaatcttccccaatggtactatccagggaaccaggaaagaccacagccgatttggtaggtataccattaaccctttagtgtccatgagatgacatgttgaaattataactaccaagaaggtggtggccgggtgggggacgtgggaagggttctcccctcctcccctctttctctgtatctctgtctctctctctctctgtcttgccagctccgaaaaaaaaatgcctccggaattgcagatctgctgctggcactgatgcaagtatacactgaaaggccccctacttttaatttaaaggggggcataatttataaatataatacaagtttccagttcttttgcatcagatacacgggtttaggaagtttcttttgaatggactgattgcacgagtttaaagctttaatcattaactactaagaacttaatgcagtttcttgaaggcagtgggtatcttgtgcccaaattaaggtttttttcctttccccctttcctctagtaagtatactacttgaattgtatattaagtgcattgtttattctcccctgtgagggtctgaaagccccataggcgaaggttgctgacggattgtcctgttgggaggactaaagtcatattttaggctccgtgaaaagcaggggcagaggcttgggggaaaatgacttgggaagaggcagggcgctcaggggtttttgtccttccagctatcaagtgataacctctgcttttaaatttccatagtgtgcagccctgtgtaggtctcctgcgtggctctctggtgtgagtgtgtgcgcgcgtgcaaacgctgcgagcgaattttaaagggcattccgaggatttcatttttcagcggagggtatttgtgactcagcactgagggctgcagactcgagggctggtggctctgcccactttatgcttgcacacacgtgcttgccggggcaccctgagcccaacggcacgaagtcaactaacacagtcccaattgggtggactcttgagttttttccttacttaaaaaaaaaaaaataagcgccagtttgggcaactagactgttggaaggagttaacttctgagtgaacccacctgacaacacttaaactaggtcgtaaaaaacaaagtcctctggtgatttttcttcctcatgctttagtgccagatgttgaacacaatctaaactgtatgtttagcttcgtgcggctgcggatgatgccagaaggtgaggaggacttaggcctgggctggggatggtcccagatccacgaggcccaggatttgctcctcatgctcacccctgagcctaagcccacagctgagcctagtagtgtgaaattgctccggccgtctccactcgctgcttaaaaaaaagttatagctctttgctttgcaattattcagttgaaatataactatcccctccccaccccagaagtaaaggtagattctggttgttgcaaagagaagactaaactttactaaaagtgccgtttccatctggcctctttaagggctgccaccctgcctagcgttcgataccagaacaacaggcagtgggcggccctgggtgggcgagcgagcgtgtccggggccgcggcggccacccgcagggtgtcggggccgcgccgaccgaagcgagcggcgtgggcggccggcctaggtgtgccaggcggccggagctccagccctcccgcgctcgcggtcggcaggtgcccgctcggccgcccgggccccgcggcgcacttagcggctgcccggccggctccgcgcggtcctaaacgcgctcgcgttccggctccctttccgcctggctcgggtgcgcccttcagtgctgcggggaccacgggggccggggggcggcaggcaggggctgacacacttctggccgcgtttagggaatccggtttttcattttggcccaagttgagccccttcgctttctctttgtgtgtgagagtgggtctggcggggctgacagccgccgccctgggctgcacggtggtttgcggtgtgggaacggctggaggcgcgcgcagcggcaggagagttggtggcggggacagaggacgggctggaggtcggacccctgagctcccctgtcccattccgtgtccttcttctgaagcacgcagccgggttttggagactcgaagggctccgtggtgcccgggaggtgggtcgggggcccctggccggagccgcagggaaaggagtgggggtgggggggacaaagggccgcggaggcgggcggagggggcggcgtgctattgttaaccgctttccgagagcagagctcgcgagctcgccgatcgcgatctggctttcccgcgcccccgcctccgctccggcttcacaaccgggggagcccggggtgtgcgcgggagcgcggcgggggcgcacggctgcaggggcgccgcggcgggcccgagccggttttattgtgtggatcagccgagcctgtctttgagagaccctattagaactccggtgcagcacgactgggccctggtgtgcagagattatgggatattctagttggcgcttcttcacgcaccccttccctccatgagcattttttttttttgatgcagtcacctttaggataggacgtttgccacatgcagtcgagtcattagaaatcccgtaactctgccactggagagagcgcggatgcaagggcgggggccacgcgggaggggagggcaggagaggcgcattctagggtgagcggatgaggacagcggcgggctacagtggctcaatagaaaccgttaaacaaaaagctagacccctcacccctagaggtcagagaaaggtgttgtcagggaagtggcatctccactccttagacgctctcggtacagtgttgggggggatgtgggggctgggggggatgtgggggctggggggaggggctaggggtagtgttggatgggaggggagcggaagccccggcccaggttggggactgggggcgccgagccgctagctagcccgtcggcctggcgtcggccgagggggaagggcgctctggcgctccgctgtgccactcactctggctgggatggagttgagtgggtggctgtgcgcagtgggggtggggaagcagggtgaggcaggagggttatttaagtctttcatccggttgcagtgagaagcgggcccccggggtgacagcagtgccgcggtctcccgctgctgccgctgcggcaggtcccaatattagcaacctccgcagagcggtggtgcgtgtgccgggagcctcctaccctcgccttcccagccccgcccggaacgaggccgcggcggcgctaggacaccgcggctcgcgcggggagggcggagggagggcacaggcgccgggagggggcgagggggctgcggtgccccggctctggcacacctggcgctcccgcgcgccgccgcggcctcaccttcggccctcctcctcctccggcagcagcctctcctccgcagcccggctcccctctggggagttcgtcctcacactcagtttctctagaaaagagtaactgtaggtggggggtgcggtgggtttacaccttgattaaaatagaaggtgcattttctacctgaaatcaaacagcagaaggaaacgcgctggaaaaaggatttttgccgcccccatgcagccgcaggtgactgcagctgctggcaagcttggcagtgacacagcagcagcagtgcagaggacgtgggggtgggggagtcttactgttccagcaggagctgcagaggtgacaacttaggtgggaccttgaaggagcctttttttttttttttccccctcggattggtggtgtggagataagattgaacaaggagaaaaggaactcgcaattgtatctctgtgcagtaggctgggggagcgagatgtcttgtttcatctgtatatctatatgcctatatatagagctcacttttaaagcactccagccttgctagatggatagaaatgtgagcagaaaatcatttggggaaatagtaatgtaaaataataaaaacatgaacgctgggcctgatctgctatttaacttgtttaggaaacctaagtctgttccctttttggctggggttaggtagctctgaaaggccggtcttcatcaggacctcagatgagcacccaaactggggcttccattcaaattgggtcaggtgaaggttttactagaggggagaaatatgatagtatgatttttttaaacaggtgtttaaaacttatttccagggttttgaactttaattctgttctatgtatctgactcttcaatgtctcaggaaaacactgggtgtttaaggagatggttttaggattgcttcaggttctggaaaaattagtggagttataactcccattcagttagtcatttcctatataaactctatgagatgtgctcaggttgctacagatccgaacttaccccggtgcaggatctgagatggttgatctggcagccctggttcgagcttctctgggtgagcaggaagctctgcagggaagaggcttaatcattaattttctgcagcctcatgccctgcccctctcgacagtctgcctacatttgtgtggtctgaagagtgcggttctgtaatgcgttgggggctcttaagccagagaaccatgtcatgagggccagagtggagcagctctgactgccttcctctcccactgccttgcctggccttggaggtgaggcccagcacagatgggctctagggggcggtgccagctttgggataatggtccatgtgaacagaactggggcagcccatcagctctggggatagtcactaatagtgagtctggggcaatgaggaaggtccggtgtggtgattttcctgaaatagtccaggcattgacctggtctctcatggaccatggatgatctcacacctcatcaaatccaatggggtcccaatgagcatatcctcatttggaactgttgactgctgtggaagagaacaaagaaatgacagcagtcatcgaccctgtgcttcccatgtcaccctatcactacccattactgtgggccgtctgagctaaggatgtcaaggctgtgtctgcccaaaatgagcgacaggctgccatggtacacatgtgtgtgccacagttctaattttaggcacaaactcatcattccctcccttcctcctcccctcttccttccttcttttctttgctctttccttctttccctttctctctccttgatcattaaacattcagatgtctctgcacagaaggcttctcctggctgttattgatccagccccctctgctgcccagtcatgtgagcagataacatgtggagtgggttgtactcagggagtgtagttggaagcacttgcctggcaccagctccaccccagagagagctgaatggacctggttgaggttatagaatttattgtggacaagagggtaccaggaatgatgaggtttctggtctggttggggtgggatcctgttgcggggttgctagatcttcctgaccttacaacagtggaattctttgcatgggggagaatgactgtgactcctacgttcagttggtctgcttgtccttgcatcactgaggtgaccacataaaaagctgggctgttattttgacgtctctatttttaaggaactgcggagaaatgggtggtggtttgaggtgatgaaatcttttccacctggggtctgtaggtagttccttctcgcttggatagctttttggagacttatctcaggtatttattttcttgggaagcctctgacttgccttcagaaacccagatgagctgcccatctttggactgcccataccctgaacagctccctctcaactgcatttgccacactgttgttatatttatctgtttacgtgttcttcttcccaacagatggtgagcaaaaatttgagggtaataggacctaggctatatccggttcatctttatatactcaataaatggtatggtgcttggcttataataaaccctcaataatagcttcttgaatgaaaaagtgaacgaatatgaattacagctgtcttgtcaatgccagaaaaagaaacgagatagatatcttgatatcttcatttctaaattatatagtaatactttcagaactcagctatatgaaaatggtacagaaatcacagaaacattaaaaaaggtaaaaccaaatgtaagatgtgcataatagttaaggaaataggttttggagtccagttgcttgggggctaattattaacctccttaaacctcaatttccccatttgtacactggggattagaatattgtaatgcctagagttgttctggggattaaatgagagacggcctctcatttggcatagactaaatgctcaagaatttttactattacaattatcattgctgctgctgttatttttttttcttgatgttctgcagaccagccagtgaaaaggttttgtgaaatcacatgcaccttattctttgttggacctgatgggcaacactggctaatattcattattagtcctcagctactccgtgtgcagggaaagcagaaagatcatcacatgctcccttagaagctgcaaatattttttagttttatgattaaacctttccttattgacctggtaaattaaatcattcagacctcaaaaggggccaaatgtttcctgcatttcatcttacgacgaaaattgaacattaattaactcattacattaatttcagggtatgtatgacccacattttggtgtgctttcaggttactaagaagatattcacatacatgtgactgctaataataataaaatgccacaattttagttattttgactcagaagaatagtacaatgaaataaaatgcatcaaaaagggagtgcatctcatgaaaaatgaatctcatggaaatattgccttatttatattcccatttgcttttgaagtagggaaggctagtaataaactggcttcttttgcatgtattctccatcatagagtcatagattatcagattcaaaacacaatttgtaatttcactttttttgatatactgtttaacatcctattaaaataattacattaagcacaagataaatttgttacattttgtccttataaaagaattaggaatgcccctttagaagaaatagctcttcttttttacatcaccttgaaatagtttcctcttgagttaatcctttattagatttatgctgttcatgtcttcttttgattgcagtaccagtgtattttgtgagagttgcagaattaattgttgaaaaattcatgtaagtgcttttttattagtcacatgagactgactatagcacattgttaccctaagtttttttctgaactcttaaatgtaagtaaaatttttaatatttgaaagtatttttaaaacaagaactcaatatttgatatgcattaatgtaaggtctacataaaatgtagcactttaatttacaataaaaaggaaaaaatggctgagtacaaataatattagcagtgtccagacaggcgcggtagctcacgcctgtaatcccagcactttgggaagccgaggcgggtcgatcacgaggtcaggagattgagaccatcctggctaacacagtgaaaccccgtctctactaaaaatacaaaaaaaaaaaaaaaaaaaaatttagcccagcgtggtggctgtcccagcctgaagtcccagctactcaggaggctgaggcaggagaatggtgtgaatccgggaggcggagcttgcagtgagccaagatcgcaccactacactccagcctgggcaacagagtaagactccatctcaaaaaaaaaaaaaaaaaaaaaattagcagtgtcctaaatatactgtgggctaatcatcttataaccacactgtagttacagaaattgaaactgctgttgtgtggccataaaattctggatttatgcccagcttaggtgttattcttagtgaggtaagcaaggggaaagaaggaagtaaaataagatcattgtgtcgatttgattttggaatacagcattccatgcctactttaaatcaagagcagtatttatctcttcagaatattattattttaattgcttaactatctctttgaggtttagataagtatagcaaaaaccaatactttgtttaagcaaaaataattgggatgtatgtgggcagttttagttttctagatagagttaaaaaaagttaacacaatagagagctggataattttctgtataaaccaatcaaggctttagttagcacttcattctcttattttgagagactattctctaaacagaatacttttttttttttttgctacttaaacaggtatttatttctcccagttctaaaggctgggaagtccaaaagcaagatactcacacacagatacttaacttcatgtttataaagtggaaataggttgtcttttctaaaaaagtattctgtttagcgaatggtcttatgtctctcaaaataagagaatcacagacagatgcttaacttcatgtttacaaagtggatgtaggttgtctttgtcttaaattctactctttgaagttaattagattatgtacacactggtttttctgtcctattacttcttagcatatctatgtagatactaactttttaatttttaaaatgttttgttttttgtgtaagtcatgttggtaagtatttttgtgtcattatgataagatagaatttagttgaaaatcaattcttttacacagtgattttcaaagagaagacacttctttaactagcgtggggttatccaagtggggagctgggcttagtgtcctctccaaaaccccagggatgctgggactctaaggacatgctctgtgatctgatctgtcctctgccttctaccctttgtctacaggcattctggaatttatcagtatagcagtgggcctggtcagcattcgaggcgtggacagtggactctacctcgggatgaatgagaagggggagctgtatggatcagtaagtactggagggacttcatccagctttatctccatgtttgatttgaacagctgtcttttctctggattaaaaagggccagaaatgcaactgagtctgtttggaaggcgagtgtaagtttttactttttgaggaaagccattttatttttattaatagataaacagctctgcaccttcactagaccaaagttgctaagaaaatgctttatttatatgccaaaccatcttaattatcaagtaaataaaaaaatttacaagtgtgaaaaatcccatctctttgtattgaatgagagttatttttgaaatgaattgaaatgatctcctcctaagctttgccaagcattgtaattaaaactagaaatagaccatgcagtgaatctaaactctctctgagctacatccaagattttcattatgcagagaagaagggagatggaaattgttgtcagatatttttgtacgtgaataagaatattacgatattgtaattatttgcaaatgttatgaatttctttttttcccactccacatccccactaggttgtaaggtcctcatgggagacagtgaagaagtatttattgtgctctgccaggtgccagacaggcactgttataggtgctgaggtgtgaatgagacaaagtctactcttccactctgtggcggggactaactttccatcatggtatcactttactcctattaatgcagtacctaaaacacagtgtgtggtacgcagcagggacttaatacatttttgctgaatgtataagtatgaataatatatactaacttgggttttcaactttcaaacttgtaatgaaattaatctgtagcgtttctttctctctttcttttcttttctttcttttttttttttttgagatagggtattgctgttgcccaggctagagtgcagtggtgtaatcattgctcactgcagcctggaactcatgggctcagaagatcctcctgcctcagcctcctgtgtagctgggactatgggtgtgcatcaccacacgtagttaacgaaaattttttttttttgtagagacaaggtcacgctatgttgctcaggctggtcttgaactcctggcctcaagtgatcctcttgccttggtctcccaaagtaacttatcgttgcaattactggtggtcaaatgagaatttaatccatgttttctgaaatatgagaactttagtttacaaaaagttgaaaatgaaaagaagcttagaatgaggaaagatttggagttctcaatacacagaaatgaagggcaaaactttttctagatataattttctaccattaggcttgtaaaaatatgtatatatagatacacacatacatatatataaaatgctaaaatgtatttgtaagtataggattgactttagctttttaaacacagtggatggtttaggcaaaattattaactccctacacaatttttgtgaatacctttaagtgtgaaaaaagataagatacaagataaaggaaacttacattaaaaaaatagaaaatgatcttttttgtcacaacttcagttttttttttttttttttgcttttaggtatgtaatgtgggtttgagtgggtcacagttgaactcaataaaatgctttttttgtgtgtgtagaagagaagttctgacttttagtgtgtagatggaactttatcacagtggcctccaaattttttgatcacgtatccccaccaaaaaaattttttttgaatatgcatctcaacatatgcatttcaaataaatatacttaatttgagtatgcatctcaaatattaaattattttaaaattgtttatctcaaagtatagtttatatatgttattttataagagatacagcaaagtaaacaattttaaagaatagaatgaatgaggaaacctaaatagggccctactatttgttccccactccaaggatcaccttgcacacccctctgaatttttcccagttgagagctgaccagtctttcagatgaaatcaccagcatgattcagactcctgtggtttattggttgacaaggagagcatgtctaattttgtgttcagcaaagctgctggtaggattgttgcccaggctgtctcatctctccttctggatgatttaaatggtttcttactcatgccttcctgcctggcacaccccagttcctagcacagtgcctggggcagcatgagagggacattgagtgtagacccacggagtgccagtgacaatactgtgggacacggcagccaggtagacagctggagagcaccatctttccccttttctgggaagcccagctgtcttcttaggttttctgtgactcctggctgcctcaccttgggctttttgagcacacacacagtgcgtgggcaggaatagacttgtcaccactgccatacagctgcacatcttgccgacagtccagtcatggagtcccagtcaggcaaagggcaatgaaagaaagggtaaaatggctcttcttccgtgtgtgcttgagaagcacacatcttctctcgtgaagagtgcccaggcttggaaactgctccaaggaagggtggctgtgagagacacttttccgtattatgctttccttgcggaaacgtcttcagctgcttccttgccttcctagtcttctgtctccaatccattctccacactgatggcagaagtaccttcaaaacccagacaggagtgtcacttgtgcacagagatcccttcaaattcttgcttttgaaggatacagcccacgttctttaatgtggcacccaatgcttaggatgaaccgctgcctggatctgctttgccaggagcaccctgtgtgcctctttgcctatgcaactcgagtctgtctatttgctgttttccaaacacatcatgcagtctgatttatacttgtggccaagtgaatttctctctcagatgcctttctcttgccttctccacctgaagaagcaggactctttatttaaattcaatggaaatattacttcttctgcaaaaccttcattacacccccagttctaatcctatttattctagttagcatttcttatgttttcctttgggccctaggaatactttgttcccattattacataagtcacagtacagtttacagtgtggtcaattgtatttctctgttccctaatgtatctaaagggcatggaccacattctttttttttttggtttcctaacacacagctatggctcttgtacatagtaggtgctcgatgaacgctcattgggttgaactgatttaaaaattatgattatttttgtcccgcattggatgcatagatgtggcctcacagtatctcgcttgtatggctgctgtgtacttaggtctccagttgaaggaggaatcaccatcttccatttctatgcataattggcctgtgtgtgcctgtgttgtctctggtgtgtgtggcctgagggggaatgaggctgaagctggaggaaagataatgtagtgtcaagggcatggttaactctcattctgtatctgctacgaagtaggcaccaggccctctttctcctcttctgtaagatgaagagctcgagttagacatctggaatgtttcttcccagtctggatggatcccaagaattctgtagtttgaatttctcagccttctttctcaagtcttctctgtgtgacccatgatgttctctgtgcacacaaaatgtttgtgcagtgagacctttttgtctcttttgtaaggagctgggagggaggctcctgggcagcaggttatttccctttggtctgttcctccagcaggtgagggggaaggtgagagtgaaagtcttgttcctcaggggctggaatctcatatttcccactgggtttgtggttatcatgcctcgtgtggcagtgagaatgaggagtgactaaaatatctcattttcattgtgatgagattgagagaaggaaagaaacgggcaatggttgtgttactaaatacactaacatttggagcctccaggaatctttatctgtgtgaagttgcatgaagctcagtaaactaaattggagattttttttttctaaacggttagaaactgatctcattacgaaagaaggtaaataggagatttggggaaatcactttcgtaaagtaaatgtgtaaatgtgaaattcatttaaagcgtattttcctattttgggattaattttctcttttcatctatgtagtttttgtttgcttgtttttgtcttcaggtttaccttgagagtagatctaaaaggtcagaggtaaatgggttaatacttcttcagaaaaatatacaggattctgatatcctattagaatgtggaaataagaaaaactatattgctaatgagtataacgatttgattagaaggagaatatgaataattttaacttggggatggtgtttgattattgtattcacgtgataatttgtccatgtatccgttcattcatttgcttatttatttcctatttatagctttgactcatccagcactgtgatgagtgcaaagcaatgaaacagatagctatacttgtaaataattcagggcagtgtgaaatttcccatagtagaggaatggacagatgttttggcatcccagaggagtgtttaaataactgcttggggaggttgagcggtagcatttaaaatgggtcttgagggataaataggagcctcagaaaaggaagggcaggcaggttaggtcacgtgacccttcaaatgtcacaattaaaatacgctgccaggttgaaatttcgagaggatgttagattacacacttggccaggggattagagtattcattaacattggtcacttttgttcttatcagaaagtttagaggcatggctctgataattacttttagagtcttaatctaaactgtttgagtattataaaaatacttaaagaagttttttgatggagtcttactctgtcacccaggctggagtatagtggcatgatctcagctcactgcatcctcctgcctcagcctcccgagtagcggggattacagtgcgtgccaccaagcctggctaatttttgtgtttttagtagagatggggtttcaccatgttgaccgggctgatcttgaattcctgacatcaagtgatctgccagcctcacccttccaaagtgttgggattacaggcgtgagcccccatgcttggctttcaagatactttaaaacatcaagaataattgaccataataaatgcctccttaaaaaagaatgccatgaaaaaattaatctccttcaagaagcttgcatttaacaaaaggaattgaccttttctttaaaaaacgtagctggtacaggtactaacattgtaaggatgttggaacatacagcatggagtctgcaaaagtgacactggaggatggcgcagagatgggggaggtgctaacatttctcgtttgtatccctttgtagcacttacattattttgcccagaattgtaattcctgctggtctctttgttagatgaaattttttggagtcagagtctttggctttataatttttctatttcttgaagaccaggcagggcaatttatgtgcagttggcacatggtaaatgtttgttgacccaattattcactccgtcatgaacacgcacatgcagtgtctactgtacatgagcatcgaatagtgatagcactgatacagggttgtgaacttgtagagtcagggtgtttccacaggaattagtcagctactgaaactgaaaatgagagaggttaagtgacttgctcaaaggcccaaaacttgtagatgcagagtgaggaccagcctcatgctgactgcctcagaccagtactttgcagccgttcctagcctcatcctgacaggtgcttcttaaaacaggtgtttactagtaggtttggttatgtttccaaggacacaacagggccctggtttatatggctccatgtaatcagtaaccaaggtatgatgggtttcaactctgtttccaaagcacagaaagtttcctttagtaaatacctcatttggggcagttttttctgctgggcagacacacatgagtcaaagaagtttcttgcatggtgttccatattgtggggcaggtggcaggagccctgtaggtccctctgtcccagaattgagagacatatccacctctttaaaaggagacaatgaagtacctcagatccttaaaatcctatatcgacttaggttatttttattatgttatttgaatatgtgcacacattaaactagataactagatataaattccttatacttctttgacaactataattcaaaacatttatatgccaaaattcaagttaaacggcaagatcagtaaaatgcacactgacacagtggatttcatatgaaggaagatgctccctgactgagacgaagatgctgcctcactgtaaatccagccttggcgcttggtgcagcttcctgtgagctcagggtgcctgttctgcagagcacctcaggatgacttgttcccctgccccacttcttcctatgtgagttcctgggacaacaaatgatctcatctgatcttcacttatctcagacacaccaccgatgtactcagtgtgccttttctttttcctgttggtcctgatggtgaaagtattgtagcactgtgtaccactgacaataattttaaaccccagtccattcttgggggacagttatgtggttgtgggatggtcatctgtgggctcctggatacccttaaaacaattctagtactttttcattgacctggaaaggcaaagtaaagacattcttggagggaacttgtggccccgcagattatgccctttgccttctaggtatctgcggtgccagtgtgggagaacactgcataggcacgaagctctgggcagggtcagagttggggacggaggccaacccatgcagttcatcagagacccccttgtctccgtcaggtgctctgcaggagcaatttggagccacttttgaacaaggagaatgaccttatgtgttcgtggaacaggataccacaccacatggcaaggaccactcagcttctgatttgtcactgtagtggttcagttccgattgctttgatgggagacgttcagacacgtcctgtacaaagaatgcagttcacacaaaggagatgaataggttcatttccttagtaacctacctgataacaggcatgccctggagatgggtggttttcaacggatattttgagtaattgagcattgccttatgctgtgtttcatatgtgcgtgaccaattttcaaagaattgaataataattcttagacgatatggagggcagcttctgctgtatgactgagtccatacatcgtcctggttttagagacgaggaggtgagattttagtggcttagtgacttgttgaaggtcacatagatgatgacaagtcaggatttgaatgtaggtaaattagtaaatcttgtctgatacatatgcatgttaagagtggccatccatttttgtaaataaaaatatatttactagaattaatcacatgaatatttttaactggaattaaccatatagtggggcaaggttttaatatttcttacacagatgtgattttggaggattttttttttttttttccagtagcctagttttaacttagtggttcatttgtttccttagcatctatactgctggccattagttagtggacaatcgtcttttaaaataatgtatctatttgattttagttacagtgttgagcatggtagctacatttactaattgtctaaggcatacttaaaacatcccaagctagtatagaacacaggtctggagattttccaggtttgggaaaggattattttaaattattagttgctcagcagagacatttcccgtctgggatgcgaatttggaggaatattgtcgtgggttcccaggaacatgctcaggaatcccggagcagagttttcctaagaacaggtgcagctttcgcacatgagcccaacgcccctctttcccacgctggattttactctcttccctgcttcacactgctgcattttctgaagtgcccctgcctgggtccctgcctgagaagcctgataagagagcctgagagagtagttttgggaagccctgagtcagatgcctattaaagctgccccattttgtaaagcagagctctgcgaaggcagggacttggtgactgtgcttcccatggtcctgccagtgcttaaaaccgagtcttgcatgcacttggcacctaatgaatgttgaacgaatgaatgtattgtcagtgggatcccaaatcatcttttttttttttcttacaaaaaatggactaggcagaccctagttgataagtacttgattcttgaataggtatttgagagctggaggagttgacatgtagacctgtggttcctgattttgagtataaggttccttttttgataaaaagtgttagggagccccacatgctagtaattgcacttctaagtgtcttatgattgaaagaatgcattatgacagcaattcctctgaattcattaacactttcaaatgaattcctcactgagcagtctgtgtgagggtctttcttgtctgtggcttcctgacagtgctgactcctgcttcccctcatcctgagccttgaggcacactggagaagtctgatcagcttgtaagttagggtctgcaaggataaccaggtgacagtggcttcagggacaacagaggcccaagcccagcgtctccaagctcttcctgcttcttccacctcctggcctcctaaatcctggcattccttcctctcacctctcccacatcacccctgttttcagaatggattgttcattgcatggaaccctggagaacccctcaaccagagcctcagtgtcatggtcagttcctgaattgcagagcttcctacttctctccagggtagcgtagtctctctgggttccctgagttaatactgctgcacagcctgattcagaatagggctcaaattggaagctctctgtaatcagtcacacattcgcacactcgctcacacactcacacactcttccatccacacataacacgcttacatgctcatgtacacattaactcttctgttcacacactcccattcacacaagtactcccatgcttacacactcatttgctcacacacattcttcttttcatagttcactcacacacactgacttgctcactcttccattcacagacatacccacgtgcttatacacacactcacttgctcacacccactcacacactagcattcacctacaacacacacaccctcatactcatgcactacctcacaaccccttgtttcttgttttctttcccaaagtcaacaagtcttattgattacctactaataatgcatgctgggtgctttgtaggtgctggaaatacgttgatcctcattgttcacagattctggtttttgtgaattcgcctacttactaaaacttgcttgtaacccccaaatcaatatttgtctgactttcatggttatttgtggtcgtgggcaaaaaatgtgagtagcatccatgcacacgctcccagctgaggttgaagaagatgctgttcttgtctcagctctgctggaagcaagggtcctctttgggatctgtttcgtgccatgtgccatgttttgtgctttttattggtgattttgctgtagaaaacatcctcagtgtaatactgaagtgcggtcaactgttgctaagcgcaagaaggctgtaatgcggcttaaggagcaaatatgtgtgttagagaagccgctggttgtgagtttgatgttaattaatcagcaacagatattaaatgaggtgtcattcaacagaaacacacataaaacaaggttacgtatctgttggctgacaaaaatcttatgaccagaggctcacaggaacccaaccctgtatttcccccgggagcaatggttcagtattctaggagactttatagaacttaactacctcaaataaggagaatcagctgtacctacaaatgcaaatgtacttcctcatgtgggtgatcttagagctgattcaggaagaacttgcaacttcattgagggagtcagacatgtaaaccaagaattataatttggtgtgatgaatgttagaattataaacaaaaggggcttggagagcttgcaggagggagcttaattctaggagtaggagagaatgtcaggattattcacagaggagatggagaaaaacaggcaggtgttctcagtagagaaaccttttcagccaagaaggcaactttgctgcagggtttagaaacatggaggcttctggatgtctccggattctgtggtctttcctctgtccctgcctcatctgcctcatcttgtctctgcttctgtttatcctagttgctgccagaggcatctttgctgacatgtggagagtcctcccctgtcagcatcagcagcccctccggggctgtcgttcagcgtcctggcccgagagatgccctccatccttacaaagtggagtgggaaccactgtcctgggccagctttggcagtggcctggtcgcctcacccctcccgactccccctcaccagggactgacttgaacttggtcagaaacatcatttgtcagccggctggcctggtgtgcctcagtggcactgtgacaaccggctgagaaaaatgtctgcatccctgacacccccgttgcagagggcttcccccgaggactaaaaggttatggtgctaagtgtgagagccacactcagagctgtcttcttcatgctgtctctaaatgcttacgatcctgacattaattgattcccttttaatcttttttttttttttgtaattcttcattgaaatctctgttgaagtttgctgcttctttgtaatgaagtgcccaaagcttaaatgcagtattctaagaacagacttgccaaggtcgtaccaaagacatccctgtccccatggtacatagcgtgattgttttgctgtagccctgaattatttttgcctatttagctgccatgttgcattgtgtgttcacacataatcagctgtccgctctcagctttaggttctcctgctctattcctttctttctccctccccactttgcttcctcccttccttttccccccttctttcgttttccatgtgaatttctgtgtttcagctatttttcttctggttgtgttgacttggcttgtattctttttccttttctctctttttcaagctgattttcattttgctgcgttttgatgggagactctagtctatacttgcatgctgaccagttgcaacttggagatgaagcacggttagtggaagcacaggccccgggatcgccactttgtcactcactggccctgcagccatgggccgtcttctcactctttctgagctgaggctatagaacgggctaacgatagacacttcatagctgggctgtgaggattagagaagatgacgcctacaaagtggcccatgtagtgcttgacttttgtgtctgctcagcacatggtcacgctcccaagtgtgtgggggtgacagaaatgctgtactcacacgagagacgcactgacactgtgtttcttgcgagtttgaattctgaaattaagacccatgacacagcctccgaagataaataaaaaatttcctccagatcccaacatgacattcctcaaattatatattaaaatgccaacaataaagccttatttaccaagattaattttacatactttattctcatgtgctgctcatgattattttatctgctcaattaaacaaatttcttttatgaggggtttaatttactttgtgattatacttattattttttaaatggtgaacttacaggctgccatagcacccaaaattctgtcatcagagacggtctctcagggttaaggcacaatttttaaaaaggtccatgccagcatattcatttggtgtcttggaggaatggaatgaccagatggtcaggtcaccttatccttgagagaattagacatagcccaccacagtgttgaggaggggaagggccatttctattaatctatcaaaaggtggtgtcagcataagggatgagttcccgagaaatcggggctgacgtgagtatagtgggggctaggagttggggcccaaggagtggggagggtgccagggacagcctcatctcccttgcattcttgcttaggacttctctgtgggtattgggtggacatgggggtgctgaggggacatgggcatccgctgtgggtatctgagaaattcaagagccacgtggaaatatcatatagtgcccagggatccctggcatcattgatcttcagggtgcgttttctctgccttgtgcttatgtccagctgctcccccagatttgagtgtgctatgacattgctaactttttgttttcttatgggatttggcttttcttcccagtaagttctctttgggcagttcatgatgtagggtttattggtcaagccgacagttcatgaatgagccctgtctattgaggccaacattgggaagaggatgcggcaggccccagagtgcaaggaagtagcgatgccttcgaggactgtatcctcccagtggtctcccggggaagagaaggagagcccctggggccaaagtggctgtcttcttccctgtcctttcctccttgaaacagcaatctcattctctgccgccttctggaagcgtgaacgcagtctgtgttttccatcctctgcccctccctgctgcactgggcaagttgatgcagcccgtttcatttggtttctttccctgttttccaactgcactgagtcccttttttcatttcctgttcaatatgtccttccagagttactgtggataactttgctttccacattttgatgtttccaagactgaatcactagaatcttaggcttacagggaccttagacatcttagtgcaattttttcatttttacagaggagaaaatggagccccgggaatgttaatcgactcacccacagttacccgagtatgtgtgtgtgttgctggaaggtcagcatgcctctactagggacactctgtgcatcttttagttttcaaaatctgtctttgagcttatactgtcattctatttgttaatctttcgttttctgtccttttatttctacaaatcatgtgctgaatttagtctgctttctctatcatagaaagtctggtacattaaaaaaaattctgccccttccagtatctcccatgattatcatgggaacaaagtagatgtagtcaattgtctttgtagcatgtctttcttgaatccttatttccttaattttacttctcagccttttagctttccatttctcctctgttgtctgccaatctgatccttcaagggcattctactctcagcttttactgagtaatgtttaatttgaagtattttcagcttttgcatatctttgatgtgcattttaagtgatcattgaattattttactactcttaccagacactagtctatgggggaaaaatgttatatgtgatttttttttcaacttgatgttgtaagatgttaaatttgatgaatttttcctgtaggtttgtttatggaatgattaaatgtacattgactaaacattaacacaagcaaaaatacttctcaaagtaaatattaaactttgaaaacttgaattctattattccctgagcaagactttctttcctctgtgggagtacccctctgaacatgtgttaaaagtttatgagctaatatgatttgctaaacaaacattcatttttataggcagcttccaaggaagacctctcaattgtctagtttgtcctgtggtatatttggcaggttctgtccttggcagcagactgggtaccacatggttggtgagcatgcagcactgaagatgtgtgcgtgtgtgtgtgtgcgtgtgtgtgtgtgtgtgtgtgtgtgtgtgtgtgtgagagagactagattcagcctgggacccatatcattgagttcccaaatattgacgtaagcagcttctgggaaagggtcttttctgttttccttttcgttttttgttttaggtggaggaggagtggagagaatttaggaattcttagtttcctatatactttgatgagacaaaatgaaaaatggcctacctacttggtttactttgtttatgtggaccagacacaactgattcaattgttcccacaattctggtggcaattttgatggccaggaatgtggatataaaagcagggcccatctggaatactggggaatttagaggttttggaaaacagggcttgaggtgagccatattgggttgggtctgggtgggagcttctcatgaaataaatagtgccctcttgcctcgtctgtctgtgtttgttgctttctgtgtagttggggacttctcccatgagaggagagtgaaaagacctggcttcttattaacggtcctttagtcattatatttaatcaccctgatccttgcaacaactcccattaaggctttactgctagattattaatgaggaagagtacatctgtacgagtaattgtggttaagggaggtttacaatatcatgactgtaataaacagtagatatgagaatgaatgattacattgaagtcattaacttatgaaatgtttgggacctctacagtgaagtcaatgtctgtacagtcactgatcataagctgatgtgttgtagtagtttataacatagcagcaagtagtctaagcggcccattgagtagaataaatgcaaacatgtggacaaaacgacaccacatgtttattaatatggaaattatgttttaaaataacagcatggcgtaagtctatacgttttcaataactattactaagtcttgacttttgaaacaactctggcttcattttttaagtgggcatagatacgaattgagcataatgttgcccatgtggattacactttttcaaattgtctaatatttttaaatagtgtcagtataagtttatgtgttataacattcctaagcattccctgggctgtactataattttcacattattatctcatactttggttttaataggatttggtaaaagttttgaagttttaatttcagtttttcccaccgcttggaatttgatgatataaaatgaaaagaggtttccatcgttgctaacatttaccggattttgttccaaagcatggactttagtagacttttgaattaaatccacattctccacccaagcctagtgatataatccaacagttcaaagataggtatgccataaacagctatagttaaataatctaaaaaaaaattaaaacatggaaacacaataaaacaagaattgatcactttatagtggaatactctataaaccgtctgcattagaaacatgtggtgagttttaaaacatctgagttctataattctagagtgtatagtttatttgaaggcagacactccttcccctaccccttcccttcatccgcacatctgtataagaatacaggttaatattttttgctatccaaatttgcattcatttacttattttttatttagagaaatgattttggagtagaaatacataacataagtattttcacctcaactaaatattgtatcactaagtactgaagtgtgatcctaaagagattatttctgtagatcttgctactccgtctaaaacaaaaatcacacattggcataatccccaataagaggaagaaattatttaaaagcatatgtatgatttagatgagtaacacagtctttataacttttcatgataattttaatttttaagggatctaaactgatctgtgtggcataattggtgtaattgcaggagctaaaatgtaccggtgattttgcaatgtcatgtttgcacaatctcatttaacttgttgactgaagttatataaccctcctgtgtatgagacaattggaattggactcagccatcacaaaaaatgctggctgtagattatactgtttttcttttgtttgtttttgatttttagagacagggtctcactctgttgcccaagctatagtgcagtgtcacaatcacggctcactgcagcctcgactcaagtgaccttcctgcctcagcctcctgtgtagcttggactacaggtgtgcaccaccatgcccagctaattttttgttttgtagagatgggggtctcactatgttttccaggctggtcttgaacccctggcctcaagtgatatttctgcttgggccttccaaagtgctggggttacaggaataagctgctgtgcctggccaatgatactgtttgaaattgaataattggctttattttctgagttatgtgtgtgcgtgaacgatgctctaatagcctgctagggaaatagggcagtgttaactggcagtgaaaaggtcagttcaatttcttagcatatttacttttttaaaaggggggttttcgtattctttaaaaaagtataaaatgagaatcttttcttaagcactgaaaacaatttcatgtttcattcttagatagtgatacctctaccactgcggaattttgttcacgattgctattttcctgccctctccactcattcctcctgcagataaatagaattattcaaaaattgcattttgaaatagacacataggactcttttttttttttttttgagacggagtctctctctgtcgcccaggctggagtgcagtggcatggtcttggctcactgcaagctccgccctcccgggttcacgccattctcctgcctcagcctcccgagtagctgggactacaggcgcccaccacctcgcctggctaatatttttgtatttttagtagagatggggtttcaccgtgttagccaggatggtctcgatctcctgacctcgtgatccgcccgcctcggcctcccaaagtgctgggattacaggcgtgagccactgcgcccggcccccacgtaagactctttttactatgcttagtgaaaagtgaaaagtggaagggcctggtcccaagagggtggtggctgtgctagggctcctggaaacttcttgctctggtggcttcattacataataacaagatcctgtggcacagaccaggcgcaaattgcttcacatctgggccttgctgtcccatgtattttaactggaaaagctgcatttgctgttttctaaggtttattcaggttctaagatgttaagatgttaatgtgatattaacaacactgttgttgactgggagcttcctcggtgttcagcactgctctctgattggatctctgtcacaaccctgcctcaagacacttattactaacctgttgtaaagatgaggttactgagacttggagaggtgagagaaccagttgtaaagccctgcagctagtgacgggtgaagctgggataggagcaggcttctcactccaacgtcaggctttcccatcacataaactcattatcttctgctgggacttttgtgtatctgtttctgatccaagaaaaaccattgtgctatgggtgtgctatgtatgcagaggaaatataagctagcacctcactcatggctcaaaaaggaggaggaagtgttctacatttaaaatacagtttaattccgtagtgtttgtaggtgatgtgatttcctgctggaaaaaagaaagctgacttttaattagtttttcttgtcccttgtagaactaaaagctcatccaatcccatcttttggtctgttttattaatgataaaaaaatgcacatatttgtttagaaatttcacttaattacagcaaaccgaaaccagctatttttagccaggaataatcttgcctgtgaggagactattatgcaaatggaagtaaggactaaaatagccattaatgtctttaacacacttaaacttctatccgtttcaatagagatgagagggaagtcacattcagcccaatctccccagctaaggaggaggttgggttgccccagaagagcacccctctaggcccatatgcagaggagggtgcaggagtgcctctctcctgtgcacccctcctgtggggtagagctgcttctcccggccaccctcaggtgagagtattccagtttggggtggggcttggtttctgcgattcattctgtccccatgaacacagcaccagaggtctaaagttttcccatcctttttgtctttgcctgatgcattgtctttcctttctgcttccccccatttcagctcacttagcaaaacttgtccagtgagatagtattttgctaaaaacctactcagtgcttccaaacacatagaagagcacttgtcaggaagtgccggccctcatgacctcttgagtgtggtttaagcctttggattagggaggggacctagagaaggtggcctcatgatgggctgttgattgattttgtcaaattctgtccctttctcctctcctttgctctcctgacttactctgcaaggagttggggatgatggattctacccaactgatatctgtgaattcattttattaaattgggtccttaactacatacttggaaagagaactgtctgtattttggtgatgtataaagtttactgtctgtcccctgggtctgaatgacagaaacgaatgtccttatctgtatttgcttgttttcttatttatataaggcgccaggtaggtaagagaaaagaaactatttctaacaagttattttcgtgtttactgttttaaacactaaagatatcgattttaaaagtttcagttgaacagtgagaagagcaaaaaggccagtaagtcctgtcaccttatttctctaggggccagcttcaatgcacacatttttgcctggggcgtgttcacagctttgggatgtggtgtgtgtgtgtgtgtgtgtgtgtgtgtgttatttttgttgttactgcccatgagttttgcaaccccaggagccctaggttgtggggttcaactgaaccccagctttcataaagctcgagtagagaggaagtgtagtccatctgggaagatgcagaacctttgtgatctggatcaatgcacgtttcttcttggtatctgtgaacctgagaatgtagcttttttagttaggggtctcttcttctatgtaaattcaaggaaaaggccggaatatttgcttttacgctggattcaggaaaactcagtcatgatagaagcattatgttttaaaatgtagactgagagttaggattctgcattagaattctcccagggacctgttaaaaatgcatattttgagaattgctgaatcagagttttaaaggtttggggctcagaagtctgcatcttgaaaaggcatctcaggtgattctgctatacacggaatgaagtttaaaaaccactcatagagagtagtaagtaaatgctgctgctaaaaagggcagaacatatctgacatcactgatcatgttgctaatgttgatctctgcagcaggtactttataaaatatatactggtgttaaagctgttatatctgagccttgccacaggcacaggctctccctcccagtgtggtcaccacatagctgctctaggaaaaatgggaacaacgtatgacattaggtgttccttgcatttgactcattcaaatgattggtatgtgcaagagtttaactagaaaacgtttagactctttagtgttttagtcattatgagttagagattagaatgtagttaaatttgtagggttaggcagtttttgcaaaatgcattaaaatggttaaaatgggctaaaacatcagtgttttctcatgggggttatattgtgtagcaacggaatgttacttttaatattgaatgtagctaattttgcaacatatttatttacctttttaaaaaattttaattttaatttttagttctggggtacatgtgcaggatgcgcaggtttgctaaatagataaacgtgtgccaaggtggtttgctgcacctatcaatccatcccctaggtattaagcccagcatgcattagctatttttcctaatgctctccctctttttctttttacaggaaaaactaacccaagagtgtgtattcagagaacagttcgaagaaaactggtataatacgtactcgtcaaacctatataagcacgtggacactggaaggcgatactatgttgcattaaataaagatgggaccccgagagaagggactaggactaaacggcaccagaaattcacacattttttacctagaccagtggaccccgacaaagtacctgaactgtataaggatattctaagccaaagttgacaaagacaatttcttcacttgagcccttaaaaaagtaaccactataaaggtttcacgcggtgggttcttattgattcgctgtgtcatcacatcagctccactgttgccaaactttgtcgcatgcataatgtatgatggaggcttggatgggaatatgctgattttgttctgcacttaaaggcttctcctcctggagggctgcctagggccacttgcttgatttatcatgagagaagaggagagagagagagactgagcgctaggagtgtgtgtatgtgtgtgtgtgtgtgtgtgtgtgtgtgtgtatgtgtgtagcgggagatgtgggcggagcgagagcaaaaggactgcggcctgatgcatgctggaaaaagacacgcttttcatttctgatcagttgtacttcatcctatatcagcacagctgccatacttcgacttatcaggattctggctggtggcctgcgcgagggtgcagtcttacttaaaagactttcagttaattctcactggtatcatcgcagtgaacttaaagcaaagacctcttagtaaaaaataaaaaaaaataaaaaataaaaataaaaaaagttaaatttatttatagaaattccaaaggcaacattttatttattttatatatttatttattatatagagtttatttttaatgaaacatgtacaggccagataggcattttggaagctttaggctctgtaagcattaaatggcaaagtccgctatgaacctgtggtaaattcatgcaagtagatataatggtgcatggatataagaaattctaatgaccctaatgtactaaaggcgacaatctcttttgtgcccatattattgtaaacttatgcacatcgctcatgacactgagtattcactcttcagactgcttgtttcatagcttatcccagaggattaaagataaactgggtctcaaactttgattctgtgtctgcaatatttcctctctcataagtgactccactattgtaacttcatggttggaaaatatgagggttgatatatgtcttacttgtttaaatctgtcgcagaatataccaaagctaaataataactatgctttcattttagccgatctccagaatgacagtattaacatcaaacattgtattgatttagaattctcaaaaaaggaaaaaaaagtacatagcacagactattttttttaaagacgtaagaatcagattaacaggatcatacttgtaaactttttttggttcacttggctatcaaatatgaaattatagaagtatcataggggtcattgtaacatcttttagagaaaatggctatcagtgtgaactgtcataattacgtggtaatagcacccttagtaaaacttgcaaaatgaaactaataaatcgttatcaataatgacaatgagggggaaagtattatacttgttgactgtgttttgttttttaaaatggtctccacaagcgctcaatttttttagaggggatattactatatagaatatcttttacaaggcttttataacattttatgctgaaaagcataagaatacgtatttctttagtagcaataattttggaacttgcccttgggcaagcgagactatttcttactatatactaaggagaaaagagccaaattcttaaagcaatatttaagaaaaaaggaatttataacaaattctcatctacatatgacactttctagccagttgtgttgagaagtgcaaagtgacggtttaaacatgtgttgggatttattgaactaattttaaaatttactattcaaactttattttgctctgatgcacattctctatgaaaaataaaagtgtgtcactggtgagtgacagctgttatgagctagaagcgcatgacttattgtgacgatgtcttgcctttctgtggtccaagttggagtacatggcaatgccctcctgctgatgtgcattaaggaaaatctaagtctaatatttggaattaagatatattttagggggaggggacagaagcaatgtaaaatagttgatttatgataaagctcagaatgtcctcttcatttattttcttgttttattttcctttctaaacagaaactgcatttaattccaaaaagtagtattcttatttattatttaaccctttgctgctgctaaaatgtgcacatattcaggctttagtttttccaaaaggcattttttttttggctgaaaaatattaaacatttgaccacagggaagaatcaagtttctaggatgtcataggtatactatgtagcactgaaaaaattgattttaggtgacagccaaaagtagtcttaaagtagcatgagaccttagataatcgacctaaaagaaagaaaattgtgaaaaagacaaaaatcttcatgcattcctataaaacgctactttaaggtctacttttggagttaattttgtttggtactttttttttttttaagacgagcaaattgttatatgcttttggcaattgatacaataaactgtaatggtctgtaaataaataaatattgactcatgcgatttatgtaaatagtggaactgggagagtggatggctcagggtttcggtgtgggcattgtctcttg

SEQ ID NO: 12032 - DNA, 40655 bp, Human
tgagtccttccagtgaatgatcaaacctgagggtggttcaggaacctctaaacttgcattgatatcagaagtcttggacattatgccttcaaattttgcagtttggctaactgctgtaagtcaagaaaaaaaggaaaagaaaaacttttttttctccttcgctccctagtatttctagaaacaacaacaaaaatgaaaagcaagtaagcaaacaaaaatatgtgcctctatgcaaattaaaatcacaatgagacttcacaccaactaaaaaagctataatcagaaagacggatgataacaactgttagtgaagatgtagagaaattggaacccacatacactgctggtgggaacacaaaatgttgtactcactttggaaaacttctggcaattcctcaaatagttaaacatagagttgccgtaagatgtagcaactcccctactaggcatgtacccaagagaaatgaaacataatgcccacacaaaaaccggtaaatgaatatttacagttagcataattctaatagtcaaaaagtggaaacaacctaaatattcctcaattgatgaatggaaaattaaaatgtcgtatagtcatacaatgggatattatttggcaataaaaataaatgaagtattaacatgtagtacttcatatcatggatgaaccttgaaaacattacagtaagtgaaagataggatgaaaaaggctacatattatatgattccatttatgtgaaatatcccgaataggcaagattatagagacagaaacatgagggattgcttaggcttgggcggggcttgggaggaaatgggtcgtgactgccaatgagtataggattttggggggttgtgacaaaaatgttctaaaatttatggtagtgatgggtctacaactgtgactatattaaagacaatttattataagctttatttatttatttatttttgagacggagtcttgatctgtcacccaggctggagtgcagtggcgcgatctcaccgcaatctctgcctcccgggttcaagcgattctcctgcctcagcctccagggtagctgggattacaagcatacgccaccatgcccgggtgattttttgtatttttagtagagacgggggtttcaccatcatggccaggctggtctcgaactccagacctgaagagatccgcccgcctcagcctcccaaaggtcggggattacaggcgcgagctacctcgcccggcctattacgcacgttaaatcgggaattgtatggtatagtacgtgaatgagaccttaataaagctgagttgtttgcgttatttatttgttttgaacctgcttggtaaagatgaactctgaactcaatgaaattgaattaccttagtgattcctcaaaactccctgttaaggctttccggtcctctgaaaagcgaaagtgggccgtgaccatcttctaaaaacgccaaaaaatatggaatggagcccgggatttcagagcgtagtcgctgggctcccaggctgagcccgctccgggagcctccagccgccctttccgatgctccggggcctccgagcaacccagcgggcagtcccaagccgagggctgaactccagggaggagcgctcgtcacgcccacactggaggccgtggcaggcctggaaacccgccctgcggggtcctaagaagccattcgagctcccgaagagcgagtcttcgcagcccttcccggcgcgctcgcatctggcgctgtccggagcccgctcgcgacgcacagggacgggaggcccggtttccacgggagaggctgcggactgcgggccccgtcccgaggccgggggagtgggagacacccggcgacccccgagaggcgattctggcagtggtggcggtggcggtggcggtggcggcctactcgccccctggaagcaccgccccgcctgggtggcgcgcgcgccggctcctcctcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggtgagtggcctcctgttgctgccccccgacttaccggcccgcgcggcctttccgccgccgaggccgcgtagcctacgtccctttttccaggccgcggtccccaggaaggcatggccaaatggggaaggtcacctgccgccgtccaccccggcgcttttcccccggccccggcacccggcctcgcggacccgccctccgcagcctcgggctcctcctagggccggagagcgtgcgacgggggaccccgccggccgcagggttcccggggccccaggggttctgtggctgctcgtgaatccatgcaacatccctgggatgtggatgttttgtcctcagtttttccgatgagtcaactgaggcacagagaggctgagaaactttgccaaggacacagcggtcggtggtgtgcagggtgcggcgcgcggccccgggcgggggcagacagcggggaagtggggtcccagccgccgggacccgccgaggcagctcggaactggaagatggcctgtgcgagtgacgggaagagccgctgccagaggattccaggaagtgactcacctggggaaactgctcagaacccagcgggctggcggtggtggcttagcggtattgggacgcctgtcccgtctacactgcttgtctctgagctcagcgtggcatctgctgattgctgctccaatgcaatcctttgctgttttctagtgggaaggatgagctaaacgacaaggcttgtgtgcgaggaatgaaggagaggtggataggtgtgatttatttcttggcggaagctcgcatattcagcgatccctgttctgcaaatgtggcacctttcttaaacagagagaatgcctccttgcctgcgcccagcactttcccgtttgcagtggctttctcacgagcattctcgtttggatctcccaaacccgaggcacagtgaggcgaggagttaggagtaaggagggttggttacaaaattggccgcacacctcttcctgtcctatctctgcaccggagatccgagcctccccgctgagctggtataaaataagatggtcgtttttcttagtatgctttaaatctgtacaagggtttgtgaatgagaaaatgtatctgtttaatttctcctttgtaaagctattagctttttccaacacctcctgttcctaatggggaaagagtgtggattcattacaaaaaataaataagagaaaggcaaaacttgacactctaaattctgaaagttttacatccgcaagagaactgctgcctcaaaagcgtggctttaaaccttggatcctttcagagcttgagtttatagagcataactttgcaaaaactaaagctaaacgcagaatgaaaattggaattccttatttgtaagacagtttcactgagccttgactccagtccttccagccccatcccgcggcaggtcataggtgagataataaatgctgtgtctgttcaggtggaccaagaagaatttatttttaccatcccgctttaatacgcaggattattatttcacactctaagtaatgtgagaatgacatgaatagttcacatggtgtcaccatctgtcttcttttttaatgtcataagaagagtgaaaagtgtaattgttcttgagatttgttaggagttgactgtggtattgttgggagagggagctgatggttaaactgtctgcccatacataattaagaacaaacttataacaattgtttcatttttaaaacaattttatatactagtgttttctatctagttacggtagtaaaattgcaggaaaaaagcagaaaatcacccacctcagcctccgaaagtgctgggattacaggcgcgagccatcgcgcccggccaacaacagctatatttttacagtaatctgctgataactggctgattaccgaccaaataaatctcttcagtggtggcaggttgaagctaaaaagaagtaagggatgcctatgagtcccatagaggtaggtgcatttgcgtaggagacacttcccaatgatgttaaaatcctaacatggagtcagagatcttcctcccagcatgatttatgtataacagtgaatattaggaaaaatctaaatgtctggttatagggaaacgttgaagttttgatgcagctatttgatgaagtattgtgaaaccttttcgttttttgacaaataagacattacaatataattttttaaaaacaggagacaatactatgcaatattatgtaatttgcatagggacagtgactagaacgatatggccgggtacagtggctcactcctataatcccagcactttgggaggtcaaggagagtgcataacttgaggtcaggagttcgagaccagcctggccaacatggtgaaaccccatctctactaaaaatacaaaaattagttgggcgtgctggcgcacgcctgtaatccccactacttgggtgtctgagacaagagaatcgcttgaacctgggaggcggaggttgcagtgagctgagatcgtgccactgcactccagcctgggtgactgagcaagactgtctcaaaaaaaaaaaaagaaaaataatgttgcattgttcacttattcagtgaaatatataatatatattgagccctccccaggctaagtgctaggaatatagtggagaacagaaaaataattggtatttttaatggagtttatgggtaggtgataggagaggtggttgtgaatcagataatcacacaaataaatctagagctgtttattatgtgcatgtcataaagaagaaatacagtgctgaaaagtgtgtcagtgtgggggcaggggagacagtgaaggctttcctgaggaagtggtatttgagctgagatttgatgggcgagtaggtgtcagatgaagtggggagaagagcattcgttgcaagggaagtaggatgtgccaaggtactgtggttggagggtttttacagtaatcttctgctgataactggctgattacccaccaaataaatctcttcagtggtggcaggttgaagctaaaaagaagtaagggatgcctatgagtcccatagagataggtgcatttgcgtaggagacacttcccaatgatgttaaaatcctaacatggagtcagagatcttcctcccagcatgatttatgtataacagtgaatattaggaataattccataattgaaagccagtatagctgaactgtagataggggtagaatagtgcaagaagagctttacttttcaggatttccttgtgattgtatattacttttatactaagcagtcatttcaaataaatattcaggtggccattcttttcatctgttgtagagctaatcttgcataaatgtgcattaagaaaataagattcaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagtgcaccagcatggcacatgtatacatatgtaactaacctgcacaatgtgcacatgtaccctaaaacttagagtataataaaaaaaaaaaaaagaaaaaaaaaaagaaaataagattcatttggatttggaatcagaggcagactaatgtattatttatgagctagacttatagggcacttttccaccagtgaactcagaaaaatattataggtgtgcaatttatggttccataagaaaacagtcaaagcagcaggccttgctgatagtatctttcatgcttacacttactccagtcattaagtttgggatgaagaagttaacaacagctaatcatttagttcttgtagattcattttaagagcctgtcatagttgttttttataaaaacttcctacagaggggagatttcaagtgctaagaatattttatgattttgttttaggttacaggaggttccagtggcatcgggaagtgcattgctatcgagtgctataaacaaggagcttttataactctggttgcacgaaatgaggtaaggcttctaggttcattattactgacttgcttcttcgacttgaaattagtcaaagaggctgtgctaaacatcttagcattcacacctagaaagcgcttcttccttgatgtgagatgtgtttcctgaactactgattctctctagtatttaggccaaacacttctctgttgaaatcaggtcggccccacaagtatttatttagtaccattggcatattaggcaacatcatcatagatactgcagatcctgagatgggagaggccaaggtctagttgaaggagcacacctggccattggaagccagggagggcccttggccaggtcagaagtgctggaagcagtgattctggagctgatacctgaaggtgtgtaggtgtttctctataatttttcactacgatttgcttaggacatgatatatatctctagtgaaatctatacaccatagaggaacctcgtccctccttagaagtttagcaaaatgtgtttttctgtattaagtcaacacagaatctgtttttattttttgtcagggtttgtttttgtcttgccaaagttgtttttagagcacaaagcagtgacactgtgcacgtgaactgtcatgacgtcctcttgctccccatatggggactggaggaaagtgaccacacagctggctcgtccgctgcagcaattctagtgcttgacacgtagtacatgctcagacatgtttgttgaatgaagaaatgaagggaggaatgatggagtgcctgggaatgtcagcatggcatacttccatggggatcttggattcacccatgtgcaaggagggtgatagtatggtaactcctcaaatgggtggagggctggacaggacccattaggaatggtaggccaggaagggccttgggggaaaatttaaataatgtcgcagacttagtcttggacctctataatttcttttatttttttcttttttcttgagacagcatctcactctgttgcccaggctggagtgcagtggcatgatctcggctcactgcaacctctgcctcctgggttcaagtgattctcctgccttagcttcctgagtagctgggactacaggcgcccaccaccacgcctggctaatttttgtatttttagtagagacagggtttcaccatgttggtcaggctggtctggaactcctgaccttgtgatccgcccgccttggcctcccaaagtgctgggattacaggtgtgagccaccacacctggcctggacgtctataacttcttttgcaaaccaagaaagacaaaattagctaccttttatttatagcttgacttttctaacaatgaatttgctttggcattgaagccaccttacataaatgaaaacacaaatttgatgaaatggcattttgtgagttttaaacaccagttttgatgcaagtaaataaaagtggaggcagagaaggccagcatttcaggcccccaggagctcatatggggcccttgcattgctagaaatgaatgaactgaatgaagaacctgtggtgttgagtaattcattcttttttttttttttttttttttttttttgagacggagttttgctctgtaacccaggctggtgtgcagtggcgctgtcttggctcactgcaacctccacctccggaatacctgggattacaggtgtgtgtaaccacacctggctgatttgtgtgtgtgtgtgtgtgtatatatatttatatatatataaaatatatatttttattatatatattatatattatatatatattttatatatatatattatatatatatatatattttttttagtagagacagggttttactatgttggccaggctggtctcaaactcctgaccttaagtgatccacccacctcggcctcccaaagtgctgggcttacaggcgtgagccactgcgcccggcctcactgtgtcacccaggctggagtgcagtgacacaatctcggctcactgcaacctccgcctcccaggctcaaccaatcctctcacttcagcctcttgagtatctgggaccacaggtgctcgccaccatgcttggctaagtttttgtatttttggtagagacggggcttcaccatgttgcccaggctggtctcaaactcctgagcttgggtgatccactcaccttggcctcccaaagtgctgggattacaggggtgagccaccatgcctggctgagaaattctttcttttctaatgtaatttttaattccagtctttgcaaagtcaagctgtatgtatctttagtcataggacaatattatttcattatagacatattcaggtttagaaactctgcatgccttttggaagaattcgcctctcctttggttcctctctattgcatgatattatttaagttactttttacagcaaattaagataatctgatatctgttttcttgagactaagtaaaacaaacaaaattaggaccttggaagaattacataattacacaggtaaccttgcttaagagtattttatagtagccaggcctagtttacccagtctatccagaaagtgattcttactatgtttgggtttatagtagaagaagaaaatattggacaaaaagcagtattgacagggagtcacacataccctcaactttggggagcagtacatattaatagagttgttcttgtcttatatcacaactaaataataagacatttattagaactgtagagtcagcctcagcaattagtactgttaactgggattttgaggtttatctgttttctactatctttctctaattaattttcaaacttttatcacttattcatagcttaacatacttcacaacttctttctttcataggctgtggcccagtctgtctatgcaatgtagatactgttttgtgtgttttctggaatttaatacatacatatagaaataattgctttttttctctcctttgcaataaacggacatgcatatagacggtcatcacgactaattattctgtattgctttcaggataagctgctgcaggcaaagaaagaaattgaaatgcactctattaatgacaaacaggtaaatctctgtcttcagaatgcattttctgtataactcagcacagctgtataaaggaaaaacagagttacttcacctgtgaatagttaattgaaagcatatatgtactgttttttaaaaggtggaattgtttgaatggtctagtaactcagaatatcacacacacgcaaaatgaatagactcccacacacattcatatctacaaatggtcaaataacagaatgttttactggcaaataatttcattttaattttttttttaatgaactttatacaaatgcttaagaggaaaggaatatttaaaatttatttggttatggaatttttgatgaataaaatgctatttatatttcagtataaaacataatagcaaattaataatcacacacccatcacccagcctaagaagtagaaatgatcagggtctctgaagcccccacagcagccttgtccctcttttcttgttcctagaggggcaaatgccaacccgatttttggtgttaatcctttctttttcttttcttttttctttcctttttttttttttttttttttttgaggcagtgtctcaatctgtcatccaggctggagtgcaggggtgcgatctcagctcactgcagcctcgacctcctgggctcaagcagtcctcccacctcagcctccctagtagctgagattatagacacgtgccatcatgcatggctaatttttgtatttttggtagagatggggtttcgccatgttgcccaggctggtcttcaactcctgggctcaagcagtccgcctacctctgcctcccaaagtgctggtattataggagtgagccactgtgccctgcctctttttctttttaattttaccatatatgcacataactctaaataataatatattgtttagttcttttttttttttttttttttttgagacagagtctctctctgtcacccaggctggagtgcagtggtgccatcttggctcactgcaacctccacctctcgggttcaagcgattctcctgcctcagcctcctgagtagctgggattacaggtgtgtgccaccacacccggctaattttttttgtatttttagtagagacagggttttaccatgtttgtcaggctagtctcaaactcctgacctcaggtgatctgcctgccttggcctcccaaagtcctgtgattatgggcgtgagccaccatgcctggccaatatacttagttctacttcttttattatatcattcttattttttaacagctttatgagatataatttatataccatacagttgacccatttaaaatatataattcaatgatttttaatgtattcatagagttgtgcaactgtcatcaaaatcaattttagaatgttttcctcaccccgtgaagaatctccatgtgtattagcagtcacttgccatttcctcccagcctcttctcagctaggcagtcactcatctactttctttctctatagatttgtataacttccttctttatgcttcttatgcaacttgatttcttcactcaatattattattatttatttcttatttatttatttatttttgagatggagtctcgctctgttgcccagtctggagtgcagtggcacaatctcagctcactgcaacctctgcctcctgggttcaagcctcagcttcctgggtagttgggattacaggcgcgcgtcactacgcccagctaatttttgtatttttagtagagacagggtttcaccatgttgatcaggctggtctcgaactcccaacctcgtgatccgcccgcctcagcctctgaaagtgctgggattacaggtgtgagccaccatgcccagaccactcaatattattctttaggccaggtgcggtggctcatgcctgtaatcccaacattttgagaggccgagacgggcaaatcagttgaaggtaggtgtttgagatcagcctggacaaagtggtgaaaccctgtctctactaaaaatataaaaagttagctgcacctgtaaccccagctactcaggagggaggctgaggcaggagaatcacttggatctgggaggcaaagcttgaggtgagcagagattgcaccgctgtactccagcctgggtaacagagggagactccatctcaaaaaaaaatatatatatatatatatatatatgtatgtatgtatgtatgtatatatatgtgtatatatatatataattttaaaaattcatttatgttgctgcaaaaagttggagtaaattttttttttttttactgctgcgtagtattctattgtatgtatagactacattttgttcatcagttcagcaattggtggatatttagtttgttcccagtatttttgttagtttgttttgttttttactattagaaaagctttcagtattctctttgtgcacgtgtgcaagaatggtacatacccagaaatggaattgcagagctgtagtgtatgcagttcttcaacctcaccaaagtggttaagctcccataagtaggaatgcggtttctgttgcgccacatccctgccaatacttggtattgacagactttttactttttgcctttctgatgagttttgaatagtatttcactgtggtattcattgactttttcccttctagaatgttagagatctttccatgtgcattaagtaaatttgccttaaattgctgcagcctaggattgaagtacaccagagcttattccgtcaggtccctgctattgagctgtttccattctttttattttattttgtatttttatttttgcaattgcagtctgtgctgcaagtaaaaatccttgtgtatatcttctgcacatgtgagtttttctctaagactgtggtctttacccccttctctgaagcccacaagcattggaaaaacaccagctctgtaaattgccccgttttttcccgtattcctgtaatatctgatagacgaaggagtatggtgtgaagtcatggagtcagtgttcagggccaaggccagtcttgcctgctgccaacactgtctccgctctgggcttcctcatcatgacaccttctacctcttcatctaccaaaggactttaggtcaggtggaaaacttacctttcacatcaaggaagggagatagggctggggcaggcgagaatgagcttgatccttctgccctgccaggcttctagggaccttttgtgtgtgtgtgtgacttgttaacatttttttgttctgagatttcacttgtctgtggcatagattttattattagtaactgatctaatactgcatgaaaaggcttgttttaaaattaatcatatgattactactgcctttttttttttttgagacggagtctcactctgttgcccacgctggtgtgcaatggcatgatctcagctgactgcagcctctatctcccagggtcaagcaattctcctgcctcagtctcctgagtagctgggattataagtgcccaccaccacgccaggctaattttttgtatttttagtagagacagggtttcaccatgtaggccaggctggtctcaaactcctgacctcaaatgatctacctgcctcggcctcccaaagtgctgggattataggcgtgagccaccgcgcctggccgattactactacctttaaaacaatgttttctatctgaggatgttgggataaaatccactctaggtatacattacaaccaagggcaacccctctagactagaatgctgcaggttatatttgcaaagagggctgtttccttttcttaggaattttgatcatttggacaggattccttcttgaaaggaatcagcactgaggcccttatatggaatatttccatcactccctagggttggcctgtgccctttcacagttccttccatcctccatgcctggctgtgggcaacccctgatctgccttctgtcactatagattagtggcatttcaagaggagcatttatatatttttaaaaagattcctcagagttttaactccaaaagctgccaagaaaattagattctgctaattgcatcatcagcaaacactgaaatctgttcattcaatattggcttccttctgtattcaatgaactgtcttttctttaaaaaatatctttaagaaatagtttggtacctgcaaaactttgatcactttttttcttttttaacaggtggtgctttgcatatcagttgatgtatctcaagactataaccaagtagagaatgtcataaaacaagtaagaggttgggctaattggaattcaccaatgtgcttgacttttgatttgttcttgccattttgctatgtggcttggaatggacacaacttctctataggtttaatagttttgtaaattttatttatcagcatggatttgctgctgagtggtttttcttctctgtttcttaatgcctgctctgctacatttttctaggcacaggagaaactgggtccagtggacatgctggtaaattgtgcaggaatggcagtgtcaggaaaatttgaagatcttgaagttagtacctttgaagtaagtaaaaatgtttgctcactgcagtagcacatatgctaaaagcagagcaagctacgggtaaaagctttaagaatcaattagatgaatgcattcagatgtccatggaagctttagaagactctagaggaaggctgaacaaggtgaagctgaacaaggttttcatcccagtgtcaggaccattgaagcttaagagtttagacattttacagctgagaaaaccagctaaaatgggaatggaccttctaatctgacacagattactgtagcagttcactgaggtcatattttcaagagaacactttgtaacctaagagatgccggatgttcctatcaaacatcagtattattaacaaggagaaaccaaaaaagttgaaggacagactcactagagttctcaaatcaagataaaaagatactgcatcttattgatgtttctatttttaatcaggtttaccaaggaacttctcttggtaatttatttcagcaccaaagaaatgaacactagatttgaaatttttattttttctttttttgagatggaatttcactctgtcactcaggctggagtgcagtggcgtgatctcagctcactgcaacctccacctctcaagttcaagtgattctcctgcttcagcctccctagtagctgggattacaggcacatgtcaccacacccagctaattttttttattttagtagagatgggtttacgccacgttggcccggctggtctcaaactcctgacctcaggtgactggcccacctctacctcccaaagtgctgggagtacaggcatgagccaccaggcccggcctgaaatgtttttaaaatggaaaacgttttttagttgccatcgcatcaacaatctttttcttccttttttttgagacagagtcttgctctgtcgctgaggctggagtacagtggcacgatctcggctcactgcaacctctgcctcccgggctcaagcggagtgtcctccagcctcctgtgaggatgaagctggggagtgtgttggtgtcttcgtgtgcgccgtctagacagactttcccttaaacctctctctttatctagacttactatccctagaaacagaacctccagtctcctgccaggctggaagaggggtacagatctaccctgtggagaggggaaaaacatctaagatctaactgcctttttttttcattgtcctacattatttttttaatttgaagtgaaattcatataacataaaattaactgtttttaaagtgagccatgcagagggattcagcatattcacaatgaggtgcacccaccccctccgcctagttctaaagcatatgcatcacccatagggcggccctcacctggtaagcagttgctccccatccctgctcacccccacacccaatctctgacaaccaccaatctgtattctgtctctggtcatttcgtatgattggaatcatgatatgtgcacttctgtgtctgacctctttctcttagcatcagtttttgaggctcatccacatgtagcatatatgggtgcctcattcctttttatagggtggtgatattcctttgtatggatcgaccacattctgtttagctattcatcatcgatggccatttgggctgtgtctagctgactgcttattaaatagactcttagtccctactcctgtctcagccccatgccagcccacccttccctccaccccagagactcttgcagctggagccttttggggttctgtagtagaatctggctttttagtttctccactccccgcttagcatttagttttttgtggtctgctaagttagttatccctcctcaacctgttcttcagcttccaaaaggttattgctgttatttttattcttattttctttgttcttgtgtgttcttgccttaaaaaacatctctttacggagattttagtaaggtttctaaagggagccaaagtaaacacaggcgttcagtgtgacgtcttttttcagatattcttttagaactttcttttttttttggagacggagtcttactctgtcacccaggctggagtgcagtggctcaatctcgggtcactgcagcctccacttcccaggctcaagcaattctcctgcctcagcctcccgagtagctgggattacagttgcccaccactatgcctggctaatttttttttttttttttttgtatttttagtagagtcgggttttcaccatgttggtcacgctggtctcgaactcctgacctcaggtaatccacctaccttggcctcccaaagtgctgggattacaggcatgagccaccgtgcccggcttagaacattttttattatcaaaacaatattatgttacgaaaacacacttttggaaaaaaaagagaatcccagcatcctaactcagtcacttatgatcttctgtatttccttggtcttccctctgagcatgtgtacttttacttaacctttgaagtaattacagttacagcatatatacagtctagcttctgctttttaaacttaaatagcatagatatttttccctgtcactcccagtgtttctggtcatcatttaaaacaattatctaggccaagtacagtggctcacacctgtaatcccaacactttgggaggccgaggcaggcagatcacttgaggtcaggagttcgagaccagcctgcccaacatggcgaaaccctatctctactaaaaatacaaaaaattagctaggcatggtggctggcgcctgtaatcccagctacttgggaggctgaggcaggagaatcgcttgaacccaggaggcagaggttacagtgagccaagatcacaccactgtactccagcctgggtgacaagagcaaaactccatttcaaacaaatacaaacaaacaacaataaaaaaatctaatattctcttgaattaagatattatgattgtatgttcatgttctgttcataatatgaaaaaaaattatgattgatctcaagttccacaattgaggtatttagtttttatttacatgatgatctaatatttttacaaatatttgaatatttgaaacattttaatgcaagtattattaaattttcgagttaaaatttaaggtttttaagagctcaggctaggcgcagtggctcatgcctgtaatcccatcactttgggaggtcaaggcaggagtactgctggagcccaggagttcaagaccagcctaggcaaaataaaaggaccctgttactacaaaaaatacaaaaattagctggacgtggtggcatgtgcctgtagtcccaggtcctcaagaggctgaggcaggaggattgcttgagcccaggagattgagactgcagtaagccaaggttgcaccattgcacttcagcctgggtgacagagtgagaccccgtctctaaaaaaaatgataatagtaaaaaagcaaaaaataaataaataaaaattaaaagcttccaagacaaggagaaaatacactattagtactcttacccatcataatgggagagccagtggttcttgaggtccaggactgtgctagcgcttgtgttttctcttttaatctttgcaacagccctatgcggtcatacccttgttgaccttgtttacagccaagaaaataagtagaatgtctgactttcttattcatcatcaaataggcaataaatgggagacccaaggcttgaaaccaaaactttaaatcaccctcctactctgtgtttttcttatagcttagaactaatagggctacaaatacttggaacctctttcctaaaactgtctttcagaaagtactacccacaaacatgcagtatactttttataaggagaaaactaactttgaccagttttcaggaaaaacattaactgctgtcatggtcagaatgcaagactagactgaaacagtcttcaaatggtaggtcctgagtcttcaaatgctaggtctcaaatcacatttcatttatatcatcatgtcatcattcattcattcagcaagcctgttgggcttcccagtcacttgagcttgcattgaagaactgaaatccagaaagcagactaaattctccatgtgcacagccttgaggcttttgacctcatgtggcctctttgttccctgcagaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtaaaagttgtattcatttttgtatttattcctctccgctcagcaatatacattccgctttagttttatagcttctttacatgtgttgttgtattaaattagagatttttaggtttgacattggtgaaagagaattggctcaaccctgagttttgcagttaacatttttcattgcatgaagactatagttaacgacagatgcaaaatggtaatgggatttttgcttgtttaacttaatacacaaaatattagtgatatcttcatagtgttattagtctaatactgtgtgaatgtgagtaaggttaaccagatattttattttatagagatttttctttaacaagaagtttgtccttatgactgaataatacatgaaattagtatatgtttgagggaagagcttgaatcagctgctaatttttagcttttagacaagtcatttaacttgctctcagtttcctcatctgtaaaatgggagggttggaataaagcaataatttgactctcccaatatttatatttttatatcttaaagaattgttgggaaaatgaatgctttttatttacatagttaatggaacattttgtggaagaaggatgtagttaggatttgcatcaaaatagcgtctgtcatgatgagtgcaactttacacctcagctgcttgaagccgacttccacattattgtcacacaggaatgcttagagagcatcacatacgtatctacccaaaaatcacatgctgaaaaaggcaagggaaagttctttctattgctgtgtacagtcatcccctcttatccgcaagggatgtgagctaagacccccagtggatgcctaaaatgttaagagcccagaagagtattcactgtggccaaccctcttatagtaagagtgtgcttttgggaatcctggttgatgatttagatcaggggttgacagaactttcaccaaagggcagacagtatatatgttaggttttaaaggctgaatggtgcctaatacagctacttaagtaggctatgatagcaggaaagcagccttactagacaatgtgtaaatgaacaattgtcactgtgttccaataaaactttacttataaaaaacaggcagagggccagatctggctcataggccataatttgctgacccctgtttagaagaccccataagagaccttgatggtgtgtgatagagcaccacattggtgagatatgggacgagcgttgcagtacagatgagctgctgggacagcgacagtcctgatgtgccgcgtagggactgatagatcatgccattctcataccataggaaccagccacagattttattgttatcaactggcctaatactcttaataatatatcgtgataatatgcttagccaataggacactgatgtctgtgaaatttcaaacaagaatactggtgtttcttttgaagtttttaactttgaaaagtccttttgtgaataactgttttatttatttttattttattatttttttttagagacagcgtctctctttgttgcccaggctggagcgcagtggcacaatcatagctcactgcagccctgagctccttggctcaagtgatcctcctgtctcagcctcccaagtagctaagaccacaagtgcacactaccatgcctggctaatttttaaaattttttgtagagaaggggtctcactgtgttgccaaagctggtctcaaacgcctaagctcaaacaatcttctggctttagcctcccaaagtgctgggattacaggtgtgagccagcacacccagccaccattttataaagttttgtaaagtatgtgagggagatgttgtgatgccacctgatgagaggaaaacccagttttcagtaaattcagtgtgttgctcaaagtcacatagttacttagtgacagaaatcacaacacgatccaagccttgaccccaggtctgctgcccttttgcagcagatgatgcatccagctagttgcttcacctggctagttgccccggccctttactttggttttagaatccttgtaggtgaaggggtggttgcgggatgaagaatctgcccattagggctttttgcagagctgtgtcagcattcactaatttagagcaaagtatataatctgggtggcctggtttcacttcaagtagaacagagatgctaaaaaagaggaaaaagaaagtggattgctggtacagacagagccccccaacctctgtgacaagtgtgatttgcatactgcgagtagccggcctgcacgctcaagtctgtatgacttctgtccttatttggactctattaaaaataccctcacttaaaaaaaagaaaataaaatgaacttatcccatgaaaaataggttctggggaaaacgaacgcagtcatcaaaatgtagtttgttcgtagtagaacttgcatcaaaccaattattgtgtccctacagtaattatagtagcattttttttgaaacctggataatttggtcaaggtaggtgtgttttctgtcaatgaaatcttatgtaattgctcaaactccagatactttttttttttttttaatttttattttctgaagacagagtcttgctttgttgccgaggctggagtgcagtggtttgatcttggctcactgtagcctccacttcctgggcccaagcagtcctcccacctcagcctcccaagtagctgggactacaagtgtgtactaccatgcctcaccgtttttttgtttattttttatttatttattttttgtagacatggggtctcgctcgctatgttgcctgggctggtcttgacctcctggactcaggtgatccacctgccttggcctcccaaagttctgggattacaggaggtgtgagccactgtgtctggcctgtaaatatttttgacaattctttggtttaattaactttgaagtctccctgtccacctccctttgcccccaaactaaggtaggaccctggcattgttaagggtactatgagtaattttaaaagaatgctttgttggcattttttagtcttttttttttactcagtcttttaggaagaaaggtaaagattttaaaagttactcttttggaaagcagacttctgaggtgggttatagctaaagatgtggtagcagagaccaagcccaaaaaaaacaaactgatgctcccttttctgcttttcttaccctgatcatgcccctctcctcccatctcttccttctgtggtctgaaagtaagctaaagcttgaattctggagtttcatgtaaacagctgtgatcttctttccagcatcccctgtctttgttttgatggaatagggaacagcacatcctatgtggattattttaataacaaatctgttcttttttttttttttttttttttttgagatggagtctcactctgtggcccaggctggagtgcagttgtgtgatctcggttcactgaaacctctgcctccctggttcaagcgattctcctggctcagcctcccaagtgggtgggattacaggtgcccaccaccatgcccggctaatttttgtatttttagtagagatggggtttcaccatgttggccaggctggtcttgaactcaggtgatctgcctgcctcggcctcccaaagtgctgggattacatatgtgagccactgcacccggcccacaaatcggttcttgaacaagtggtcagttgtctttctgtttgaggttgaggccagggagaagggaagaagtaatagtaggatggatgtggggcagagtcgggggcacagagaatggtcaggcaacagggatgaggagaagcagtggccgggcagcaggggactcagttagtgaggacctggctcatccattcttagaaagagtggtgatctcagggagctagcattgtctcataagaacaagtaaagccagcctaccctcatttttgtttatgacagggttatgagattggtagattaaaagaagatgtagatgtggtttagtatattcagattttagcaaattatttgaccaagagtttcaggaaactagaatcttaaccttatgctttgttcttagaacgatactggcatgtagaagtaattcagtaagtgctcgttgttgcatgaataaataaaataatatgtaaatggtgaggtgactagccactggaggtatccagccagagactgggagagtcatttggttggatggcatagcgagaatactaatctaggaagcgactggactggtttctcccaaccccagctatctgtgttccttcctcatgaggaagctgttctgaaaagctctgttttaacctttggcaatgcagccgtaaccttgagtttgagaagcactgctctgaaatcctgtcttccattagctttggagccagcatccttctttaccatgagagagaaggcagaggggcagcacagacgtgagtttctgggcagtcgatgtcagtctttatgtgggctgcctaatgaccactcgttggattttttgtggtgtttttctctggtctatgcacagcagagggcaaggctgggggagacaaggtttttataagtcactatctcaaaaacaagtggaagcgagtttctggctcatctgccttactacctggccccgatccagagctatttatgagcatggctgggccgtgaagctgcatgccctggcaatgcccggtggatgggctgtcccacaccctaattgtgctggaatggaacccacaaagacatctcactttcacgactgcactttccaggatggctggcctggatcttctgcttgcaggcctgtgcgtgcttctccttccccttgaagctccccttaaagccctcaaaactgtgcttcactgaaggaaccagggcgaaaaagggctgcataagatgagactctgggctactgtttttatttttttgttgtttttttgttgtttttttttttgggatggagtctccctcttgtcacccaggctggagtacagtggcacgatctcaactcactgcaacttccgcctcctgggctcaagcaattctcctgcctcagcctcccaagtagttgggattataggcacccgccaccacacccagctaatttttgcatgtttactaaagacagggtttcaccatgttagccagactggtctcgaactcctgacctcaggtgatccaccccctcccctcggcctcccaaaatgttgggattacaggtgtgagccactgcccccggcccctgggctactcttaaaggccgtcacattaggcagtggtgttgatttttagcctagggtacccttctgaagatgtgcagtggctgatctatcagctgcctctccacttccagatcccttaggtgtttcctagggacaaaaaagtgagccaataccaaataaaaatcatggcaaagagattttcatggtaggaaccattgctcttagagttgctaattagcagggcaagataagcatgtgcagcagggctgtggctgagcagtctgtgggagggggtgtcctggccaacagcagaagaatctgctggaattgttgggggtgtgtgtatgagtggggtcgtgaagcgtgaagtgtgcaggcatggtggtgaggcacacaagtgtaacaacctgctccaagtgtcagatttagaggagccacatagagtttcagataaggcagagggctttccctatgtgaatgcaggttgaggttgtccacaggggaggtacttggctggtctgacttggaggttctacccagtggttcttgttggttcagtggaggaggaagtgactcttgacctcctaatgtgcagaggccggttatacagggagctctggaataagcagacttctcagggacagttctggactgggtttggagtagggcacaagaaagggatagggcagcagattttaatgaccccaatgtattttgtggatgaaatcaacacaagagtatcagaagcagtctgaaggaaaaacagatgtacagtctggtgaagaaaggaggggcagactggtcccattgccttgataaagggcttggatgctgtgcagtgcgtgtgggaactggactctttttaaaacactgccctcgtcggacggctcccagggcctctgtctgggcagcaggagtggaagacactgcaaaggaggtgacttgccatactttagggccagctgttttctggggtccaggttagggtgagctttttgcctacattctggaatcatcatggagaggggtttctcaatgcaattggtgtagttccccgcctaacagaatcaccccattgttctcaccgctttttgggaatcagggcagccagtgcaggttggcagtgtaggacctcagtgtgtcttgtttactgaaggtacacgtgttgttttgaaatgcaggtgaagccatataatgtctacatcacagttgcttacccaccagacacagacacacctggctttgccgaagaaaacagaacaaaggtcagtatcctacatgtcccaatttgaacctctaatgtttactgcttttctgattttctttctactcttcagctcacactcgttttcaccaatcaacaatgtttgttgggtagagtgcctagctggtttctgatgaccttgagattctccaggcaaatattccttctttccttcctcttttccctcactttattttcttaaagtttaaatttctaccagattttttctctatagagacagggcctcactctgccatccaggctggagtgcagtggtacaatcgtggctaactgcatcctcaaactctcaggctcaagcaatcctcctgcctcagccacctgagtagctgggcctacaggcatgtgccaccacacctagctaatttttaatttttttgtagagatggagtctcactatgtcgcccaggctggtgtcaaactcctggcctcaagtgatcctccctcctcagcctcccaggtgctgagattataggcatgagccattgtacccagccatttccagcacatttttatcaaagaagtatgtcacacagttttagagtccaatatcaatcctttgcctcatctctcccattcccaattcctactccctagaggtagccatttattttaactaacatgtttatactgctttttttttttttaagatttagaaattatttattgactttctaccgtggaagataaaatttaagaccaggccaggcacagtgtggctcatgcctgtaatcccagcactttgggaggcctaggcaagaagatcacttgaggccaggagttcaagaccagcctgggcaacataacaaaaccctgtctctacaaaaaatttaaaaattagccaggcatggtggcacatgcttgtagttccagctactcaggaggctgaggtgggaggatcatttgagccagggaggttgaggctgcagtgagccatgattgtagtactgcatttcgacctgggtgacagagcgagaaccaatatctaaaaaaaaaaaaaattaaaattaaaaataaaaaaataaaaatttaaggccagccatggtgtctcacacctgtaatcccagtactttgggaggccatggcaggaggattgattgagcccaggagttcgagaccagcctaggcaacatagcaagaccctttccctacaaaaaaataagcaaaattagaattgttccagctactcaggaggctaaggtggaaggatagtgtattagtccgttcttgcattactataaataaatgcctgagattgggtaatttacacgtaaaagaggtttaatttgctcacagttccacaggctgtacagtctgctgcttctggggaggcctcaggaaacttacagtcttaggtaaagggaaagcaggtacgtcttacgtggtcggagcaggaggaagagagagaggggaggtgccacacacttttaaacaaccagatctcgtgagaactcactcagtatcacgagaatagcaagagggaaatccacccccatgatccagtgacctcccaccaggtccctcctccaacattggggattgtagttggacctgagatttgcatggggacacagatccgaaccatatcagatagtttgagcctaggacgtcgaggctgcagtgagccaagattgcgccactgcactccagcctgggcaacagagtaagaccttgtttcaaaacaaaaacattaagactcatatctgttccccattccctgtgtactcctcccatctctttagttaaatcaggtttagtgctcatattaatattatgcacacttggaccattctatagtgacatttcctttcttgccttttcatttgcttagctttgtaattatctataactaattcagtcccagattcaaacagaactgagattctccttttgatccatgtgagcacattggacattctattagattcattcttttttcctcagacatttctcctggggtcgtccccgttcctggtctgttctagttctgccacccagcggtggtgtcaggacttgtcttcacctcacactgcacgttcccttctcccctccctttgacggagcccatgactctcacttttttggtttatctgctcattttggtggagctataatattttccaccaattttctgagaaagggcacatcagaggtaatattgttttagaaacaacatgtctgaaaatgcctttatttttattttaaccttttttttttttttttttgtgatagagtcttgctctgtcacccatgctggagtgcagtggtgcaatgttggctcactgcaacctctgcctcctgggttcaagagattctcgtgcctcagcctcctgagtagctgggattacaggtgcgtgccaccaagcccggctgattttttgtatttttttttagtagagacggggtttcaccatgttggccaggctggtctccaactcctggcccactctggcctcccaaagtgctgggattacaggcataagccactgtgcctggccatttttctttattcttatgtattgttttgttaagtacagatttctagtttggaaataatgtttcctcagatttctgtgagcatttattgatttccagcttccagaatttctgtggaatccagtgctattttgattcccaaccttttgtatagaacctgtttttccatttatttttggaaaccttgtgtccctttttatccttatttaatggattttggcatgaaatcttctcatttcatatgagcccttttattttatcaacttttgttctgggacattttattatattactccttttatcacttctttcttcccaaagtatttcaagtgttcattctctctggagcatttattattcagatttttgaactttctggactgatcctctaatttccttctattttctctctctttttttttttaatctcttgggccttttgttctcccttctaggtttttattcgctttatccttaaacctttttgttgaaatctttatttctactgggttacataaaaattactttagatctcttttctctgaatatttaaaacagtttttaaaaatagcttcttgccttatttcatggatttcatattttctcttatgtctaaggatattcactctggatgtttagccttgtttttttgttgctgttgttttgtttgaaaatttcttctatatcttgtattatttatttcctcctactttctttttctctgttgttgttttttccggcttcctgaaatgtctgttgatccttgattgtccatatttaagagtgatgcactaaaatgccaattgtaaatctctagcttctcagctgtttactataggatgatcaggaggggatgcagccacttcattagaagattctcatatgccagcatctgctcacttttctcatggtttgatcagtttccctactgaggaatcatgtcttcttctgcctttgggagagtaagacttgctgtctgtgttgtgggaggcaagcagggcaggagggctggggagctcaccacctacgtgccaacttttgcttaatttttctgtttctacaaagtgccttataactactcttagtggtgagaattaagaatctggttagtaaattgctaatcttttgccatcgtagaggagatgacttggggtctgatgatttgagtctccattgcacttatcacagcttataacagaagcttctcatagcacttaaaacagacatatcttttatataaaatgactgccagtcatcctgagctgaatataagcttcacactttttcaatggaatattccctttgccttgacacatagtagttgcttttttgagcaaatgaataggtgaagcgggaagaaaggaattaatcagaacttaccaccttgaactgtggccaattttagttttatatatttttttctcttttataccaatactttgtaaatgtgaatctctgcagcataaaaattggcacttaaactccctagactgtatatttgtagaaagatgtttgtgatttaggttttttccccctattcttttctctttggctctgcctttttaaaaattactgctatttcaaagaagtaaatttaagccaaatgtcctgtcttagaataagcagagatcttctaagcagctttgcaacattcggtatgcagtcttttagtttgaagccagagctgacaaagggtggtgatttccctgttaaggtttgattctgatgttgattaagttggggttttttcagtaaaattttgggcagacttgttgggggtaaatacaattctacattgatgtgtgggccctttagggggcgccatagtactttagaatcttatgtgtatttagtgtggttatgccagcctgggggtctggaagaatgaatcgtggctccttcaaaacagcctttctcttaagaaaggttcataagaaatacttgatctttatgaaatactttactttcctattttaagaaaatataatctggtttttattttctttaattccttcaagcttacgtggtaaagtttacagtctcatgcagtttaaggcttttgtttgacacttctacttgaaattatttgacacttctaattgaaactaactgaaataatttttgagcacacatatgcaagacatcgcaaagaaaagccaaagataaataatttcttacaaaaaaggccctgcccacaagaaacttaggaggtaaaatgcaaatgcacaagtagctataatgtgtattaaaacagaaatgttcacagaagaaagagagaggttactgccagttaggtatttagggaaggctttttgagttaggtaagagttgagatggaccttttgaggaagaaaaggctaagatttggggtctgcagctccagcctggtaactagcatgcagcccatctagggaccactcagggttatctcctaagtggctccttctgtttcagtgtcctgtgcatttgcctcctcagcaagtcctttaagaagcatctgcagttgttgaatgggggctgggttgcgactgtccctgccttgggcgccaggttcatccccagggatcagccctctgctgacctgggaatatggtcagaatggagttgctggtcttgggagcaggcttgctctggacacaggtctagcctctacagaaaagcaccatcattcaggtgtccggccagcactgaggagtcaaagggggtctttctgaacttgtatccagtgatgtgttctcactctagctttgatggtcctcagtggagccaagactccgtatgttctaagagaatggcaaaggcctccttgtcttgtgttagctactgggtagaattttacgtagtaactaggtagacactgatttagaatccagatggaccttattctagaaataggaatctgcccaaaggtagaaaattggaattatttgtaaatcaggaggctgtaagaataatttatttttaatgtaatgggcaatcatgatattgttatgtacatgtttttccacttttagcctttggagactcgacttatttcagagaccacatctgtgtgcaaaccagaacaggtggccaaacaaattgttaaagatgccatagtaagtaaaatccttgttttctgtactatttgtgtttgtagtactatatttctgaaaagatatttgtccaaggacttacttcaaaacatcaattattagaattttttagtctgtcagatttgtcatatctaatattggactcaacttttcttcttttagacgctttattgactccatattagtgagtagcctcctgaaaactgattgtataccttaatctgaggaacaggtttactagaaggatgtctggaaacaccggttctttaaaaagaaaatgagactttcctatgagtgtaaacgatatatactatgtcccatatacacctggctgctttctctcccattcctgcttcccagtatcattttcccaaaagttagctaacgagaaagtgccaccagccccgtgggcctgtcctcctgtcttccctgttgatatgttttttaattcagaatcaaaaatggtattttaagaaatgatgtgctgttttgtagaagaacaacatatgtgcctcatgctttttgacaacatttctgttaatgcggaaaaatgcacatttatgagggatgtctgtaaaccacagacccacactgaatttggaaaatctataggaccattggaatgagaggtgtcagcacatggtggacagccttgaagtggcctaaatgctgtcacattagactgaactgagcagaatgagaatagtgaattctgttgaaatatatacatgtgtgaagaactttgtcctgagtgcattaaaaggctcaggaagatggcacaagtgagactttatttttcctgcttatctcgggtcaaagcaaatgcatttggtgttttttgttgttgttgttgttttgtttgtttgtttgttttgagacggagttttgctcttgttgcccaggctggagtgcagtggcacgatcttggctcactgcaacctctgcctcctgggtttaagtgattctcctgcctcggccttctgagtagctgggattacaggtgctcacaaccacacctggctaattttttgtatttgtagtagaaatggggcttcaccatgttggccaggctggtctcgaactcctgatttcgggtaatccgcacgcctcagcctcttggccaaagtgctgggattacaggcgtgagctccgtgcccagcccattcagtgtttctaatgatgctaaatagctcttagtattttggcagtattcatttagtttagtggttttcaaacttttcttctcttgaccactttacattcttacaaattgtcaacaaccccagagaacttttgtttatttacatggctatatttattgatatttgccatatttgaaatggaagctgtttgtaatatttattgattcattaaaaataacaaaaatggctgggcacagtgactcgtgcctgtaatcccaacactttgggaggccaaggcgggcggatcacctgaagtcaggagttcaataccagcctgaccaatatgatgaaaccccgtctctactaaaaatacaaaaattagtcgggtgtggtgacatgcgcctgtaatcccagctacttgggaggctgagacaggagaatcgcttgaacccaggaggtggagactgcagtgagctgagattgagccattgtgctccagcctgggcaacaagagcaaaactccatatatatatatatatatatatattcacatatatatatatataaagtcacatatatatatatataaagtcacatatatataaagtgactttttttaaacaaaatttactacttttcaaaacaaaagttcagtgaggacggtggcattggttcacattttcaccagttgctttaaggtctgcattaacagctggattcaaatagctgcttctgcattccatctgttgtaataatgttgttttgatggaaggatatacagaaaatctggcctgagacagatacggagttgggaaagggaagactattttactaggcttttcagataattatggacattcttttttgatatcaaacccaaactcaacaaatggtagtttcttaaaggttagttgcagtatagaattggaaactacatcaatgaatgttttgttctctgttacattaaattccattggtccgtcttgtactttgaatggatcttttaaccattcatgatttcgtaacattatgcattagtcatttggaaaatatgggttgactgagtgatcagaaaaatcgctttcatcagtattactgctgatcttatcataaaagtatgcagctgacagtctcgtgatggtggatactagtttttccaaatcttaattttttcttgaaggctcagatttcacattgatgacacgtggccagttgtttttcctgaagtgacacacttgcttgcttcgctttctgcacatctgccacatacctaagtctgaattactatagatttcctgtcaatggtctttcatataaaaattatgctctccagccaggcacggtggctcatgcctgtaatcccagcacttttggaggccgaggcggctggatcgcttgagctcaggggtttgagaccagcctggccaacatggtgaaaccccatctctactaaaaatacaaaaattacccgggtgtggtggtgcatgcctgtaatcccagctacttgggagtctgaggcaggagaatcacttgaacctgggaggcagaggttgcagtgagcagagatcacaccactgcattccagcctgggccacagagtgagattctgtcgaaaataaataaataaacaatacaaatgatgctccatgaaagaagtggcagtttagcccttgacttcaggagctgcacaaggacttttgttccaggcagttgtcccgccctggaatgcagtgctgcggaagcgcgttgggcgcattctcatttgtcacacagagtattaagaagacatgtcctcgagggttgccattgaacaaaatgatgaattttcctgctttatcaagaggattttaaagcaaaactgacactttgatttttaaaagaattttagaacttgtattttctttgtgtattatttattactgcgagtgcgtgtggtagtagaggtgacaatgactcctagtacagtttggcaagaaccccgtggttcttgcccatgtctctgcagttttgcagaggcaaaactgtattttccatacaacacactgtggaaaagacaatgaatgtcttagtgttattaggacaatcatttgtccttgggggcccgcaggggtccgtggactcacttgttgagaactgccatctgccaaggccgtgcgtccatttctgagtgctgatcaatgctttgtgaccattttatctcacttaaagtgaacgagcacactccactgtttctgatgtgtccgactgatttctgtccacattactaggattccctctttctcttctttttcttctcttttagcaaggaaatttcaacagttcccttggctcagatgggtacatgctctcggccctgacctgtgggatggctccagtaacttctattactgaggggctccagcaggtaagctctgcctaggctagcaatcagacaggccgatggacaagagaaaaactgcctttcatcaaaccttgatgagaagaggttaagggaaaactaagtaactttatttgacaatgtatttttatggagctatcaacttttcctcttcctccaccaggaatgagtaaataggttaaagatataacttcaggaatttagaatggcaagaagtcttcagtgccgggccttgcagatagagaaataaaacaccgtatctgctgttgaggtgttaacctggattttcacctaagaaccactgctccaatgtgttttgaaaatggaatactcctctagagtaaggggtagccttgcttaaaaagtactgggatattagactagaaaaccttttctaggtgaatcaggtcacacacagctaaatttagtgagacacgaatcatggattaaacagttgcttcgcttatagaatgtattattttgtccaagatacacagtgtttcattggtgtgctaggcactgtacttgctcatggggaatcagatggaaggcgacctctccagcttcaggggcatacagtcaagtggaatgcactgaccaaaaaggtgatagtagtccgggcgcggtggctcacgcctgtaatcccagcactttgagaggctgaggtgggtagatcacttgagatcaggagttcgagaccagcctggccaagatggtgaaactgtttctactaaaaacacaaaaattagctgggcatggtggcggacgcctgtaatcccagctactcgggaggttgaggtaggagaattacttgaacccgggaggtggaggttgcagtgagccgagatcaagccactgcactccagcctaggctacaagggccaaaatttttttccaaaaaaaaaaaaaagatagtagtgcagtgtaatgaagtaggggttacaatagagggaatgctctggaaagacaaagccatgggatagttgttaacaagtactaaattctgtgcagtcaaccacattcagacttatataaatgacttagttgttggttttcttcagggtctttcccaagccctcttttcttttcattctgtaatgtacctactgtctttgccattctcttagaggttgacactgtgttagatgtaagctctttgaggaccaggcccacacctcttgtttgccgttgtacccctaacagccagcgcctggcacttagtaggaactccagaatccctgagctgaacaaatgcatgaattcttttatgttttaatttttgggctggcatggtggctcacacctggcgtgttgtcctggactcccctgcttctgtccctcacgtcagagatcattgtcatccttgtcactcagttcttcacattcttccattctctgcaattctggcagtgcttctggagcccaggcctgggttgccgcagcaggccccctgcttgagttacacactttttgagccagaggttgtaaacgattcccatgggcctgtaaagcagttttgttgggtccatctggtgtgagtgtgtgtgtttaagattttaaaatagttttaaaattaggttttatataaaaggtccagatttcagacttttcttggaaaatcagaaggtttagctgcacagagtctgcattcttacctggcagtcatcagcaagcacaggtggcagctgctcctgagggaggagcacagtccctgcaaccactatggtctgcaaccccctgctcaggccccctggatgcgtttgagtgtaccctcacattttccacaccagttgtttctaaactgcaactatacattgcatgaaaacattcaatgactccttgataccatcaggataaagctttaaaaattccattgcacctgagtatggtggctcatgcctataatctcagcactttgggaggccaagtcaggaggatcgcttgagctcaggagtttgagatcagcctgggcaacatagtgagaccctgtctctacaaaaaaatgtaaaagaaaagaaagccaggcgtggtggtgtgtacctgtattcctagcaactgggagacttctgcttgagtccagaagtctgaagctacagtgagctgtgatcatactcctgcactccagcctgggtgacagagcaagaccctgtctctaaaaaggatttaaaaattaaaaaaatttccatcgcatgccataaaccacctgatctcctaccccacgtacctttccaggctcttttttttctttctttctttacccatcttcttctttttggaatcttctctgtgtcctgccaacttctaatccttcaggtctcaccttaaatattgttttttccggaagatccaaggactggcttcagtgctctgagggtgtagggaaaaaaacaaagggatttttctattctcttttttttttttttttttttttgagacggagtcttgctctgtcacccaggctgaagtgcagtggcacgatctcagctcactgcacgctctgcctcctgggttcacaccattctcctgcctcagcctccccagcagcttggactacaggcgcacaccgccacacgcggctaatttttttgtatttttagtagagatggggtttcaccgtgttagccaggatggtctcaatctcctgacctcgtgatccacccgcctcggcctcccaaagtgctgggattacaggcgtgagccaccgcgcccggcctgatttttccattctcttatgcacggggactcatgcctatggtcccagctgcttgggaggatgaggcaggagaatcctttgagtttgggaggtcaaagctatagtgagccgcgttcatgccactgcactccatcctgagcaacaggatatcagtaatcacgggtctcaaccctgaggcagtagtttcaattttacttgtctttccagcctgagaataagctcattgagggcagggactgtgtctctcaccacagtgttcacagcacctagtatagggtctcgctttcatgctcagaacataaattgcaaaccaaaaaagccttgattgtagtttggctatttgagatgctgcagtgggtctttttaaagctattataaccctaagactgcaagcaatatatattttattctgcttatggtttgaatttattaattggacaaatattttgttatgtatctgggctgtccagcggtgcagagcacacacattctgttctcacagcttactgacatttacagagttttcattatattcatccttagagcagactagaagatttgtcttagaaactgtttgttagagacctaggtaccttgaaatagtcttgtaccgttggatgcactaaaagctctctctttatcttgcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctgtctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaaaattaaaaagtgtgactttttctcggagcatatatgtagcttttaggaaaggctgatgatggtataaagtttgctcattaagaaaaaaagacaaggctgattttgaagagagttgcttttgaaataaaatgatcacctgttctttatgtgactctcccactgaacctgcagacattatttttataccacatgctaaggaagcccactcatctaactctgtagccctggaaaccctcttggcccctgaatgttgtttccaggttataggatctgtgttcattagtggattttgacagcaagtgcctctgatgagttttagccaacattccccgttgcatcctgctcattgttcacactcctctgacttgaggagagctgccttcaccttgatcttgtaacctgtcttccttgcatatacggtagcacattccagatcacttcggtgagaaaagacctctgtttttgaagaggaaactttcttaaattgtaaaataaaacttaaaaaacataaaaactctatacaaaaattgaagacctaaaaattatagcataccttttttttgctcttgagtttttgaagctcttgactttaaatgacttaactttttaaaaaataagatgttttatggctttaacccatgtttttattaagatctgagaatagcatattttaaacactgatagatacagaagaaattattatttaatatataaattgcttggaatgatttcattgcagcttgtaaggatgggttgatgccagaatggtttcataaatctttcagtcttacagagccaaagtttgcagattatatcgagttgcgttgtgcagctgctaaaatggaatcatagctttttataatttgcagaaaacaattgcattaatgtctggatgtttctcagttttattcttttctcataaatgttcctcgaatgttggcaccttctactgctgatctatattagaatctagtccaagaaagtgtctgatttaataacattaaatagttatttcaatatattttttcaaattatcctcatagaacctgttgcctccagtgagatggtaatctactacccgaataaatttaagagcacctgttgagagcccctgttttgcggtagaagacaattgtccctatcccaatttccactgaaatatgagagcagatttgcagagaccatcatgtcagagaagaaatttccttgtcagagatgttaaagggctacagtcccttagcaaagaaacttcgaaatctaagttggtttgtgtttttctaaatttgataccgtaattcatttggcagcaaaatctgacttgaactgatgtgagagtattgtactttatatttatgctacttcattgtgacttaattttccctgaagaaatatccatggatttgattataggttttcccttagatgctgtggaggtgttttgtaatattcaaaatatgcccatattgcctttttaaaaccccaaagattatgaattctgaaacacatccagcccagcgggttttggataaggggttgtaggcatttaagcagcctcacataatgggctgacttcatccaaaacatgaaaatattacaaggcaaattctattttttatattttttggttcaatgcttgaacaacttgtttttctgctgggggaagaaaaaaagaaccaaccctgagtgtgattgttacggaaactaatgactttgtttttaaaggatcacattgattcaacaccttctattggacccagaagtgcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagccataaaaatccccaaatatgttcaaggacttcataattgaaaaatatatagaaaacaatccttacttctttttacaaaaacaaaatcatgggaattattcttttctatatatttagttataaatctttctctgggccgggcgtggtggctcacgccagtaatcccagcactttgggaggctgagacaggcgaa

SEQ ID NO: 12033 - DNA, 101674 bp, Human
  misc_feature (1)...(101674): n = A,T,C or G
ccttcattgctctttagccactagcaggctaggtagggtgttcctaatctgcaaccggaatgtttctggtaggagccatttctcacccactctttgtcctcttttatcacttaaaatcacggaaggctgttctgaaagcggctgggctccttgtaacattaaaaaattattaaactcagaaactaattctgttttttaatcataaatatgaaaactaggaagcaaactgagaagaatgaaagaccaaatcagcggatctgaagcaggccactctcaggaagactcctgaggaataattaaggctaattttaaatatcacctcctgggtatcatcatcaccatcgttcccaggtacctgtctgagatagtccattttgaaatagatataccttaaattatgttaaaatgtactaagcacttattgagctcagtgatcctgaaatatgcctaacaataagctgcctagttgccacttattagctaggtttatgtctaggaggtctaggagggactatgaagaatatgagctgtttaattaggggtacttgtcatcactaatgaacaacaagaaatagtttgaaaacttctttgagatattcacttgcaaatgtcacccgaatttcagaaaagtacagtctctggagtaaagctattatacactcagagagactgttgtgctttgcatgcgttatatcatttagtcctcaaaacatgttgtcaagattggcattattatctccattttaaagatgagaaaattaggtgcaaagagcttcagtaacacactcaaactcattcaacaataaataactaaaaattgtgctatacacactttaagagtcacatgttcctcccccaaaattatgaaaggccatagaaggaattcaagaagtaggcttcatgacttatcgtttcttctcatctcagatgaattcactttaatctctcatgcccaaattgtaaaatatcattttgatcaccgtcaatattacacagacctgtttgaatgtgctcagctttttcagtaaaattagaagaaaccacaatttacaaacaggtatatgtgcattaaggaaaaaacaaaaaactaccatgtgattttagatatggatgccaattcttaaacattgtttattatttctgagctcaagtgcttagaatgtttaaaatgcaatatatttatgtggatttttttccaggatattggaacatatataaaatatgcttgtgcatatctaagctttgtatttatttcaggttatatgtatactgagaagaatatataaacagtgtatgatatttacatgttatttcattttttgagggaaattaacctccacaattattaactatgcataaaatgtaatggcagatatgacttatattgtataggactgactacaattcctctttagaaatagctgttctttgcttttataatactaggaaaagaggaaaagagttcttaaagaaatacaaggattcctcaagcccctcttccctaaaacatgctctatcatatctcctggattgactggaatatccttctctgcccccaccccatcaccctctcaatgcagtggaaaagtcggtgggtaattgggtccagattggaggtgtttaaatattcatgaggctggcaggggactgggagggggcgactgtctagaatgggggtaggggctgggggaagtgattagtcactgaaggctagagaacaattccgagaaagagacggagagagagggaagaaaaagacagatagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggtagagctaaagattttttacttcttgctgttgtgaaataacccgagtacagtatttccccgtaaaggcaaacaatttttttactgcttctgctctggccgtggtgctcgcgcttccttagcatatggtaactgatggttgcatcccagcttttattcttttctgtctttcatgctctggttttggaatgctgctactaattagggtgagggtagaaaaaacatgcctgtttggctagaaataatttttttttttcttattagtgaatgctcagcatttgaggtctctggtcttgagggtgtggacgtagaaaggggtgtgggggagatgatgtgggctctacctacaagatggggaggcatttctttatattatttgcaaaaagcagggttgaggaaataatattcagaactgagtattgcctctctgtcatacaattttctcacatgtgctgcggaagatgccttatttcgtgcatgcatgagcttcgaaggggcgcaggtatttatggaaaaacgtgcaggtcttatttatttagtatttatttttcaatgaatgaatgaaactgtgatttgatagattttttttttttaagagaagctaagacaactggggctgggggagaaattggccatgcagaaggggaaaatccccttcctaagatcagcagccgattgtgcaccagctggtcggaggagagggtggaccacgcccctaggagctccgatgggatgggaaagacagccgggtattacctgttggaaaccaggtcttttctcttatccccttcccttgcttctttcctgggattgtcagtgaccagagacaggctaacatcctggataataagtatggtgactcattttcatcaggaagagggacacatccaagattagcaagaatcagagcccctccttccctcccccactgcccaggttttacagccatttccaattgctcgcttatttcttgaaagacattttagaaacttgattggggtgagagtgggaaggaatgacgagtgtggtattccgcagcaaccgaccatgccatggcagtctccaaaagaagctttcaaacatttgttggaatgcatttgagtgattttggcaaaggttaaagagaaaaatgggtgtgggatacgggtgagtgtgtgcgtatgcttgactgtggtgggggtgggggtgtggtgggggcaatcttggtcaaagaagcccttcgcagactgattgccttaggggtggggtgcaagagatggaatttgggtataatttccagtgcaggtattggaaattgggcaatttgtaatacactccctgaatccgaagggggtggaagagagtggagaagaaacagcctgccagcttagcacatttagccagcgccctggaaggaagggtggggagtgaggatgaaggagaaggagcaggaagaggatgggagactgaagcagaatgtcagagcagtgggagtagagatttggcataaataaataaataaataaataagcagacatcctggattgtgtggggctatttgggggaaaaagtcggatagtgggggattgagttgggggcggtatttgcagcatctcctgaaactgccctatggttacagagattgatgcttccattggctcattttatcaaaccagggcattttctctctgtgtcctccttcattttaatatataaatgtaataaatacaggtgtctgggttaagaacactgtcaaagaaaagtcctgaggttatttcactggtgagctggggaaataacatttaggaaggtggagcactaagtaagccaaagccatccacttaaaaagctttaattttggaaagaaaaatattcaggttcataatttgttcccaccctatgtgtacatatgcaagtatacatacatctcctttaataaaggaaatcatgtatgatttttagaaaaggaattagggctaaaggaattcccttcccaaaatgaagacagctgccttccctggggctctatctcaccaacagccccaagcattcactctgatgtgcaaagtgatgaagctgaaattgtgtttagagttgtagaaattcgcatgtaaatgtatacagcatccacatacttcatatgctacagttgcatgtgtaagtggtttccacatgcctctctgtgttttagcatcatttatattcaagagaaaattaaaggtatagaaattgtcctactttgctcatgcattttataaatgtgtacttctgtgtgaaatggtcatgtctcttataaaccactgttgtgtatcattcacattagccagtatttaggataccattcaatcagactaaaggaaatggtgtattcagggcgtgggctcacactacactgactggcatttatgtagcatgagtacttaagtctcacgcaggttgcctgcttgtggatgaaattctgtatcatttatgacaaaatccagtggtgcccatccttctgctggcatctattcatcatcgtagtacttaacagggaataaaacaagggcaaaaacctgcaaaggtctaagctctgccacacccataaaatccagcagaaacgtgggaggggggctgaagggcttgcacttccttcctcttccacttgagcggcataaagaagcaaccttggatttctaagttggaatacattgccagtgggtgagaagaaagcataaatgatctctattagccattagttatcactatagattattatagcaggaagaagagaatgagagtggggtagagatgagaatatggtaaaggagtgggcaaaggaggaataaaataaaataatccctaatattgtattgccttatgattttcaaatatcttggggcttactttaaatagcttaattgccatgtgtattgcagatgattaaaaacttggcaaggtgtgatttatgtctacaaagcaagaaaactatgaggtgtttcttttgttgaaaaataatgactttagtttgtaattgaagtgtaaagaatttcatgcaagcaagtagtccctctactccccagccccccatccatgccaatatctgcttttttcctcatgcaacaaataaatcttatctctgagagtgtgatctgtggtttaaaattccgacctctctgcctttccttgcagtgttgggaaggtgtggaaggatgctgccttgctgcttggtgcaggcgattcttcctagtgataaattggattcctcccaaatctctctgagccacacccagtgtcactcagggacttagtgaattaattaagctgagccattttacttaatataattgaagcttctcgttcttttttttttttttaatagtgattttcaccacaggtttccaaatttaaacagaaaaaatatttgaagggcattttctttcttttttctttcttttttttttttttgccaaattatctggacttgcagagaaccttagaaaattcatggtgagtctagaaagtgttcatttctggtgactctataattccttctaacccatgccagggcgcatacacaatgagccctgatctctcctgctgacagagtctgtgtaactctcttccccaccccctcccctaccaacccatgctgaggcaactggaataagaaaatgcagagttaattttctttcttgctgagctggcaaaactacagaaacctcctttgatgtttcaagctaaagggcagtactcctgttcaccgagagggagagtggcttggggtctcctttgcctctgtcatagtgaaattgccagtgttattcctggggctgaattaatccacagacttcagaattttacctggccccataaggaagggtactggtgttctttcaggcaagaatagagcatatatattaaccaatcgtattgataaagtaagacaagtcttcctctattaatagttcaaagaatgcacataaccaggtcatctcaagagaaggtatagcagcatttaactattcacttccctattagtattaataaaggcattagggcaaccaagcagtggctgttgcaaaccaaagaagtgatttcatacaggaattctcccttttcaatttgtgaagtgtggtcaggtggcttttgtacctttgtaattaaatcttcataacattttcagaagtgttgggaagaatattatactgtgagtccttagtggaggccacttactgactgtgagctttaataaaccacatcaccttgggtttcagtttccttctgtagaatgaagagtaaaaaccaaaaaccagacacaaatgaacactttgcttaccttaaggatttttgtagggcttaaacatacttgatgtgaaaataaagatcaatataagaaatttttattctccccaagttttgcaatttgaggcttgtcttagaggccccagttttgcaggatgatctagtgcctgctgtgtctacctttccctgttagagatgagttccttctagtcttagttgagccttctgcttgtgctcttgctcctccccccgtgttttccccagagccccagtccctcatgccctgctctttcttgagatttcatcttcttgtgctgcactggctcctttccttatagtttatgaatatgcttttgcctcatctatcttaaaagattctctcctgactctatgtccccatctctatagttctctgtctcactctccctttagaacaaagttccaagtactctccaccctcattttctcctcttcttcactccccattcactattccatctagtttaatttggctttgattttcataatttcactgaaaaacatattctgaaagggtgtcacatccagtgacccttcattttacatcttatttgatgtctctttggcattttgtgttgttgtcaatccctgttcctgaaactgtccccttactgggtctgcatgatattaatagctctccttattctccctctcagataagaccctgctcagtctccttatagtcttctcttgctctcttcacccacctccccaaatctatgatctcctggatcataatcttcattcattccactcttctcgtttgactcactaatcctaggtgatctcatcaggtcatccacatccaaatctttagccacctgtgtgatttccagatctgtagatcagatgtctgtttttagcttctgatccatagttatcttggtctaagtgcttcatttcagagacaagtttgttaggtacaaaacccaactcagtgtcttctgttgtgtatcacacttgatcttcctcactacaattattgctctgatactgtccatccagcctcagagctctaggaacctgagagtaatcctgaatgtattttatttcaactcccatatccagtttctaaatcctttgattccttgattcttgtttaaaagattgaataaatcctctgcttttctaccctgtttatataaataacctggcacagacttttcatgactactcatctggacaaaagcagtaactttctatgtggagttctaccaccacattgttctttagtttaccttgcaaataacaccacagctatctttacaaaatgcaaatcgggttttgttattttctttgttaaaatataaactcttcagcatcaatgacacaatctagttttgcctgcttttctagtgccaaattccaacagcccccctgctcttttttttttttttacctgatgacaccatgccaagatttcaggccttggtgccttcgcttgtactccactctctgcccatgttacccttccctctcagcctgaaatattcccactttccctgcaagagttagctctttgaagccattcttaaccttcctaattaagttttcttctaccttctttttgcccatgctgtattttgtactatctctattatcacttattgcactatttgacatttattttttcacattctggtgtctaccctgtgagcttcttggggaaaaggatgaaaacataattcttgttttatctctaccataatacttggtacataaaataactcatgttaaccatgaataatctgtttgctaaataaatatggaaccaggtttatagtcttttcacaggctgtagcatatctaaatggatagaatcactaggagatttttaaaaaaatgtcttggcatgaaattttaaagtggaactgatcatcagtgattcttgttattcacttatagacatgacagccatcagtttttaataaaagcagccacaaaatgaacccatttatagactgtatttctctgaactctcatagctggcactatctcccctccatgtcctcctcgtccaacaaccaacattacagccccaccctctctggttaccacaactctggatcttcacatgcccttactttgaggctccaagtacttgcactcactgctttgcttcacaactcttacaaatagaccgtaaatcaatctgtgtgatccatgaaataaatcaactaagagtagcaatatttttttctttaaatgcatgtagtgctggcctgtgcttaggtgtgtgtgctcaaaaattaattttaccttcatttggatttcttttcttccgtctgaagtatccacataataatatttcacaaagataaatcatgattggaggtatagggagggtgaatggtaagtagtccctcaaatgactgttaaaggaatgttagtaccagatgaattggatttttcttaggtttaaatagactgaagggacttgggttctgaagtagtcctattgtgcccagcatggaacaaattgcaaccactgttttccatgaaaacactcttgccagacgctaagtagtgtattttctctgactgaattggcatgtccttgagaacagcagaaagactaaataatttgtaagtgaagtttgtcttcaactggtaaggttcagtagtatttgtcaattgccataccctcacttgatatcttgcttactgctcccaatctctttggcattgagtttttctattattttctcctcctgtcagacccaggtagagtttttctgattaagtaataccagttcatgttagtgtttagtgggtgaggctatggaaggagaactttaagaaaaagtgtgtttcttcaaactttctaaaaagtacttatagacaaaacaggtattttaagctatgtctggcacatcttagattctcaataaatatttgttgaagtaataaatgtaggaagggagggagcatcatgatgggtcattaggggagatgttctgggacagacgaccatttctgattacttattcagcgtgggctttgtgtaaatgcaagctcagctctattggtccccctcacaaggtggatgtagtcaaagttcaattccctctcctgtctgcttagatcagagagacacacttgcagtcatttcattcaggtttagcacgggaatgtgatcttccagatttcctatccttaattatttacagatcttattttcttagatgttgtttgtttaatgtcctgtttcatgtctttgtagtggaataaatcctttccctgggttctagacctggttctgccaattgcttgtcatgtgatgttgggtaagtaatttaacctttctgagcctagtatattcatctgtgtagtgggtacataaaaagaacctccaaatcctgtcttaccttttcttcttaaaattaggttggtgtgagtctcaaataaagagataacaataaaagtgttttgcaaacaatgtgtttttgaaatgtaagtattattaattaaggaatttcatagatcgagcactaaagtattcatggctctaagcaaacaagaagtactcttgctctctgtatagaatacacacattccccatttccacctgattcccatactctacagagtaaattttttgtttgtttgttttttgagatggagtcttgctgccatccagactggagtgcagtggtgtgatctcgactcactgcaacctccgcctcccaggttcaagcaattctcctgtctcagcctctcaagtagctgggactacagttgcatgccaccacgcctggctcacttttgaatttttagtagagacaaggtttcaccatgttgcccaggctggtcttgaactgctgagctcaagtgatccacccacctcggcctctcaaagtgttgggattacaggcatgagccgggcacggctcagagtaaatattaaccatgctaatggatgggaacatagtatctgtttattatttcctttgaaaacttcagtgacagaatttagataagccaatattcaaagtgttacaagacccaaggatcacttcaaatgcattagaaatacccactgtttttctttttatctttttctgttttagtcttttcctcacatttagatctcttttcttctccatttgctaagtttgctgcctccccctctatacccacccccacttcacctccaaactgggttctcagcactaagatggccaggcatgctgtgctcacatccatcacatgagggcccagtcaggcagaagagtggagagaaaatgcagggctggttgggagactgaaaatgtagatacagtttggttgggggaagcacatttcaaagatgatcccttgatcaccatttccacaacctgacttcagggctcctcaatacaacaggaataaaccttgattagagaggtgatatgtaatcctaaacctttccaaactcaactctaaatgccataatcttttgagccctcaagatctccacaaaggacattatagttcttctgtgtccctgggcatgactgggataaattaccactttaaaacaacaaaatttaacagattctcctataagcacagaattctacaaaccaaagaaactgagtttttaaacatatggataacatttagaaatactttaaagtataataactggatcaagttagtctaagaaatcctatttttcctagaagccaaaagtttagcataaaaaaattagtattgtacatattttcccaaaatacttttatacaaagggctcatgtagactgcaatagaaaggtgtgttaactagaaatttgaaaataaactggtgtccagaaggaaataatgatttctttaattatatttatatttggttaatggtatcacctttaaactttcactctagctacatccctttctccctgtttctttcttcttctgcctcagaacacactacttctattatatatgcgttttttgattgggaacaagtatccaaaaccaactttaagagtctataaaaggaatttattggaaaaaaaaaaaagcagcgatcatatgaaattagtaagttgaacaacgaagcctatgggaaccagggtagaatttcaataacaggaattcataaactctttctggggccctgcatcaaaaaagactcagttattaataatcccagctacaattcaaattttaaatgatgagagagaaagagagagataagagagagacagacaaagggagagagggacagagggagagagacagagagagagagaatgaggatgaatgaattttattggtcctgcttgggtcacctagcaactgccacagggccgatatctctgactggaaaaagggctgggtgacataggttagagacaattttggtaagcccacacttgtaaatctagtgagagggtaagttggttgagaattagtctcctgcatatatacctatatgtccacatagtccacatgtgggttagctacccgagtcagaaggaacttatctcaagtgtggtggactattcatttttccttttggttattttcaatttggtctgtattacatattattggtagggttattatcactgatggctctaaaaggaagtagtaaccacacagataactgaacctatgagcttatacacctaaaaaagaaaggtcagagcaaatctccgtaccagtttcagtgtggagatgacagacactgggttttcaccatcctcctgaggcttacctctggcaggtgccacctgtctaggaggacatactagctaccatatattcttgctaatttggaatggtgtagctttgctctaacgtctctttttcaggttgtaagatctagttcctgcaaaaagattggacaataatgggtgtaaaacagctcaattggatttatattacagaaatgctactccttgacattagtcatctcattttgaatgttcttgaattaattccagcaataataaccacatttatctatttttagcaaattggcactttgtaaaatatttgctctaaatgtagaatattggtaattagccttacatccattatttataattccagttccaataactattcaaaaatgttattttaaaatgaaagttgggaagaccctaatatcctttcattaatgactagataaaagagctagatgaggcaaagaaaaaaaataaacaaaatgatctccaaaggttaagcaaactcagaaatcggttgcttttattaagtggctgcagaacttcttagtcagcataactaggcttgactggaacctgtgaggatgcatatcctcttcctattcttactttgctttgattccggaaccaatttatctgcttggaatataagctgagaattaaattcctcttaatggccaaactagttcctataacagctgtttccaagggatttattctacaggtctacacaaattttaatagaggcaattgtctcattatttacctaaaaaggaaagaaagaaaaaaattgactggatatggtggctcatgcttgtaatcccagaaattcgggaggctgaggctggaagattactcaggagttcgagaccagcctgggaaacatagtgagaccttgtttctacaaaaaataaaaaaattagctgggtgtggtggtacatacctgtagtcccaactactctgaaggctgatgaggaaggatctcttcagcctaggaggtataggctgcagtgagctctgatcacaccactgcactccagcctgggtgacagagcgagactctgtctcaaaataaataaataaataaataaataataaaaattccccagtttctaaataattaacttgcagttagatttatttgtccatgttgtactgagggtagcccactttggttgtccagactcttactaacattccagtggggaaaggaataagcattgagttatattttgcatggacattgcatttcggtctttaaatcaattttaaaaagtattattttatttgagagatgggaaggaataagagacttcataagggagaatgatattgtcttacttaaaaaacaccaattctttctttagtaaaatccaaactgggagtttgatctattcaaacgtcatttttttttcctgaaatgcaacatctgcaatatttccttaactctcaaggacttgtttatcctaataaaagagaaggaaattgttttctctatcacctgggaaagttactctggagaactcaggttggtattaaatattcatttgaaaaagtctttcacgataatcctcttcagtgtgcctcagggctttgattgcctttggttgaaagacacaaggtggtagctttttgataactcaaccagatttgtgcatccataatgttggacaattaactggagaactgtatagaaaacctaaggacaagagttccttgcttacacattctttcttccatcttaaactttgtaccttacacctcttgagtgaaaccagtatggaggaggaaatgaggatttctataactgaaaagggagaaggagactagagttataaaataaaattactcagtttggaattgggccataaccttctagtaaaaactgtcatgggatcgttaatgaccacagatggctcagacctcacttctgaacatcatctggaaaacacaataagcccaagagaaacagtattcagaaaagaatccaagaagtactctgcaggactaggtatgaaaagaaaaaaaaaaaaataagtgtgagcactagtatgcttaaatatgcataaccaaacttaggactcaattcagtttttatcttcacttagtggaacgaaactattgattcttagctaaaaagagaactgccaattttgctgtcatggttgttgccatatcttatgctagaccaaatctttcagcaatgaatggttttcctgcaagcttctaccgttctcctgcattatcattcccgtgtcattggaaactgattggtttgtgtacatacttaagtctattttattaatcatatcttaccaaaattgttacttttgctcaacctggatatatagtaaaactccatctgtaaagaatcaaaccatgagaatcataagaataccaataggaaaattaactttccattattcaaggtctccaaatattaaaaatattatttttccttttactctttgtggttccctcaaaaagtgtcatgttgaactaactatcttctttgcaaattagactttctactcccctactcttaacaatatctttgagagatcccagcacattctcagtttcccagctcataacagaaataattgattactctccttctgttataaaagtcatactatcagttaccaaattctttttgtaatgtatttcacatatgctcttttcatcttctgccagtctttcttaaccagcattccagaagagagccaaacccaacccttaaagccctaaggccctaatgtccatatgtatgtaatgagttaatccctctcttgtgcatctagatgggtaccagttatataccatccttggaagaagagaaaatagtcactcattttcatgttctgtgtttcagatgagaaactccaggtgaaaaaaggctggacagttaccaaaattctctacatattgcctgctggctaatcttacgtttaatcccccctttccccaaatttcaatggtttctctttgtttacaaggttaattctaatttatttacttatggttgtgtttcaaggctccttaggatctattaccaatttcctattcttgtcttatctcctagtggctctggcattgactaggcttgtgaatttaaataaatttagtctctctcagttgtcatttccttttacgtaaaacgaaagtattgaatgaaatcatctctaaggctttccaacttttaacaaacatgttctatagcaaaatgcctcttttacttggatattctgtcccacccagacttagtataaatttaagtattaattttcctataattttgttcattgttaccgccactacttgaaaagtccccttttgggcctagctcaatcttgcctaaactccgggccctgaatcaagacttatctcatttgtgagggctttcctgactaacacagttctccatgacctgttttgcctcttagatcttttgcagcacatactacctgtcctttgctttggcattcatcaagcagagccttaaccatccatttgcgtttttatgtacctgattctgccaagtagtttgcaaactctttaagggtaagatatccagtacagtgcatgactcaagaaacacatattgtatctactctgtgataagctctgtattagactctaagggaatgtacaagccaaataatttctcagaaagacaggtggaaccatcttgcattacctctctgggacatttgacatcatgaaacataccttgcctcttgaatctctttattttcttggctttcataacacttgatactgctggcttttcccacctacacctttggttgcacttttttcccatgcttggcttctcttttctaccaacctctgaaaagttggtgttattcagcgttttgtccttatacttgcatgttcttactcaacacaagttctgtgaataatctaatttgtgcccataagtctcacttggactagtgaatctcaaattctccaggctctccatccaaacctacttccttggctctagagctttatatcttactgtctactggaaatattttgctgacccgcaggaaccccaatctcaacaggtcttaaaagtaagtcaccatgtcttgctcccaaatctcttcccctttcttatccagtcatgtaattcagaaacagaacccttatatcttctttttttcattggatgctactgttctttctctggtttctataagtaaaaaccaaataaataaaaaaccttttcattccttcctttctttcctcctctcaaaaatatgtcattcatgcaagatgagggcatagtaaaaatataaataaacaaaagaaagaaatatgtcttgactctatccactccatctccagtcagctctaacccagccatttttcatggagactaatgcaatactctacccctataatcaacttcttctaccctcaaccctttacaatctttccctcagcagccagagtgctattttgaaaagcgtctataagattgtgtatctcccctatttaaaaatctttgatagcatcccattccacgtagaatcaaaaccaaacttaatacaaggcctaagaaatcctacattatccaggctttgcctccttttctagtttctgcttaacaaccatgcgcctcttggtcaccaagtctgttggcctctttttagtttttaaaacacataaaacatgttcacacttcaaggcctttgcatgtgttgctccctgtgcacagaatactctttctctggctctttacttgagaagcctttccatctgagtggtgtccaagtcactctctaacacatcacacttttttttttttttatctttttgggatgctctcaatctgattttttttaaaaagtatttacttttcaatattctggtcactgcctatctcttcaagctttaaaacccacccctcttcacatcccagactctattgcaattgtgttatttcatggaatggtccatattatttcatcctttctctctttctaaacactgttccttttgtctgtaatgtcttccttcctctccttttctacatgacacatttcctgtttatttccgtgataataaacaggaaatatgtggctgcagttattttcttctttatggagactctctgatcctccagcctaatacaattattcttcgttttgtgccttatgtctagtacatacctgtattacaacattcaatagactttattatacgtattcatgtatatgtctatctcttttgctataccaggagctcctttcaggtaggagttatgtccatgtatagatctagttgaatgctttgcacactatggtttctcattaaatttgagttgaataagtgcagcctataaaatgaacaaataccagtgtccagtgagtagtatgagatggcaaaatttggttaggactaaggcaaaggttggccagcttacaatgatcagtcatggaaactgttcacttctggcacagtccataattgggcagctaatagatatttcacacagagctaagaccatacagacttggatttcacccaagtgataccagctggttgcttcagcaaataatggtcaccattttatagagagatactttagtgtagtcagaaagatagccgtccttgacactataaacttcttaatatctgggctaaggatgagtactcactgtaaaatatacagctatatcattttagccaattattctgcttcctaagcttggtgctgaacagttagcctttcctcacatttaaagcttgtatcttctggtactcctcccacaggaatcctggtgaggtttcagatcttcccctttgtcaataatataatttatagttacatgtacactgtctcttaccttctctagttaaaaaactatgtacaataacgcttagttgttgctattttttcttgtccccctttattatgggggaagtatccatctgtctgatgttattctatctatccccaaaccaataaacaaaggaaaaatgctagtagattttcctaaagggaaataaaactacaaacggccagaaaatcaatgacttctcaaccctaacttatgtctcctacacacaaaaatataattcctgggggacggatctgggaaggaatgggcttccccttataattctggtgagggaaaaatatctccaattaaatctgttccctttgcaagaatatttaagagaatcaagaagggaaaagaatggtccatgaacattaggtagctagatctttctgaagtgaagctaaataacatagaaattaaatatacctctttggggtctagatgggaaacttaaacactctcttggatttatttttttcaggaaatgttagtctaagtttcaaactggtaacttggaaaataaactttggaaatacatctaacttgtaggttgggatagtgttcactcaaaaataaaatttaggaaggaccaaaagaatataatttttctgtttagagaatggatgatcataaggaaagaaagatgaagtacactttagctgaaaaaatatgtcactttttttccattgtactttaaaatttttaattatgtcgaaggtgaagaagatgcatgagtagtttgggttgccaagaaagcaggtaagacaggcaagtattcagtattgaagacattgatttggtgggatatggtagaattttgagagacccgccagtcatgggtaaaaccacttagagccttttctagaagataattcatttgctattccacttatctggtcatacattcctttgcttccagttttcacaggctttactattaggctgttttctcaacaaaactatagttgacagagtggaaaaccatttctacctcaaagctctggactcctcaattgatgtacacccagagacactgcagtgtcagtccactgtaaattcaaattgccagtaattatacgacattccaagaatacccaacaagtctccgttactctgattaaaccaaatttcttccaaattctctggaactaagaaaggggtttcccttggattccagtgaagggtcaagaggtcaggtctatgttggcacaagaaaatgggagattagattaagaaataatgacgtttaccggacactctccctatgtatgagcttttattaccacctaacaataaaactggtactattttctccacgtgaaattctctttctttctcttttttctttttctttctttccttctttttttccttctctttctttctccctccctccctccttcccttccttccttccttcttctttcttctatttctctttctctctttcttgctttattctgtttttttttttcttttttttttttcaatgaggttttactatgttgcccagactggtctcgagctcctgggctcaagcaatcctcctgccttggccttccaaagtgctgggattacaggtgagagctaccacacctggccctgaaatgttttttcctccattctaccaaaccacattctgccttcaaaaattctgttgaaaaatcaccttcttcataaaatcattttaaacatttcctcattccctatctggttccatatggcactcactatagtaacctccttagcaattccccttttctcatattgtctatgtgtgtgcgtgcacgtgtatgtgtgtacatacacacataggagtttgtgtgtgtgtgtgtatacatacacacataggggtgtgcatatatatacacacagacactatatatatatatagagagagaaagagtgcatttatatgttttgtgcatatattatacatatatatattcacacacacacacacacacacacacacacacacggtgctttcctgtttccctagagactgctaaaaggctcattactgagatttcctctgttttcaatttcacaaggcactatgcaatgcttgcacatactgggtccacagttaaagctactaaatttttattcaagctcccaaggaaaagttgtcaccttctttgtctttatacctgatggtgataattatcattgactagtagagctaaagagagcttaggaattatctagtttgtttttcttttatcttgtatttatttaaccacagcatctttttgacccagattgaaatatttctcagaatccaagaatgtaaaacagataaaaagatgttcttgcggctgaagcagagtttggtggcccagagatctgtctagtccgctccctcctgtctcctctgaaaccccctgttgaagcctggggagcagattttgaaacactgatctacagccagtccttcatggtgcagatgttaggaggttttatgctcaaggccattcaactcgaaagggctaagatggaatttcttcccatgtcagtgctactcttttcagaggggtgaaagaagaccatactcccaatttctagatgtatatatgcctaaattttctaaagttaactcagcatttatgtgattcaggagtaaacagggctcttttacaaatgaagacttagaagttatttttttgttttccaccttttgactcttactcatcttatttttcaattaggctttatcatcaagaccaattttagacacaatatctcctctaatattatattacaatcctttattcattcaaaaaacatttattaataatctaccatgagccaagaactatgctgggtactggaaatacagaatttttttttttttttaaagaaacactctttaccctaaattagctcatagtatagtgtggtagacatatgtgtgtcgatttaaaagtctgtattctagaatgtgctcttaaataattttacttaatctcaggtagtattttcctaattgttcaagaatatttcccagtataggcttacactaatgtttcttcttgtatagatgtgactatcaacaagccttggaggtttgggggataaattttgtaaataacagaacatccatagatctaaagacttaagtaccacaactccaaaagatttttaagaattaaatgttaatatttataactatgcctgccacatagtaagcacttaacattagttattacttgttattgttgatgctgttgttgataatgatattttatctacattaagtgagtcatatacctaaatagctttttgtggtgattcttaaaggactagtttctggattttaggggtatatgtgtgtgtttgtgtgaatgtatgcatacacatctgaagttcaatgaaaatacaattgattaactgagaaatgagttatgaatgccactgacttaaactttgcatgtcctatgctctcaacactctttaatgctaatatacattgtttcttgcagtcttggaactcagaggtgtaattagccttatcttacagatgtggctaataaaggttgaataaaaatttcaggctgcctctacttagaaaccagagaggctcatcatttgcaaggagctgaaatgtagacatctcaatacctagactcagtcactttttatcttcaaggaatgacgtaaagatgcaatggcaattacaaattatcctcagtgatggtggtatccacggtctgtggctatggtatctacagacccatgctctaatcagttggtggttttgccttgactgtgtttcctgggtccactttcacttggttgctgcctaatttttgagcctgtttctctagccttgccattaatactgtgagctctctgatattatcctaatccatttcaggttctattgcttgcactgaaaaatcttactgatgtaaccctgtagtcagaaatcaggagcaagctgctaatatttttcacctggattattgcaatagcctgggagatttgcactcactgttctgtctgcctaaaatactttgttgcaacatattcacgagtagcttccttacctcttcaggattctactcaaactcacctgtttacatcttatcaaggagttctctcattaccctatgtaaaatggcaccccaccctaacactccttatctgtccccttttgttctctttcattttattttctccagcccttgtatctactcaagatacttattacaatctgctggcaccagtggtacgtaaactccatgagggctccgttactcttttggtgacttatatttcctggaacctagtacagtgcctggtacatatgaggtactcaacaaatatttattgaatgaatatatgaatgcacttaaattatattcagaagtaataataagctaaacacgtgctacagctaatgcatccatttccacctgcctccacttccttcctgattgcttttccttaatctgaaccagcagtaacccatatatttctttcaacctagctgtcagtctaaggtatgtgatgcagcggatttcccaagagtgatgaaagaagaatttggtcctgctcaccactacaaaatgcctatttatttctccttttatattttaattgtttaaatatttggggaggattgtcctgctgtggtaaatttatactcattaaattgtcaagtgtaactgtattatttatttatttattgcaggcactgtaggggaaatgcttgctttgccactggcaccatgtggctttgagtgattattgtattttacctgatagtttttggacaggactatcagggtgatgaatgggtgagagtgggaggagttcaaacactggttgataaaaggataacaaacctgtagcaataagtcagtcaccgtgaagcattctaagcactgaataagacagagcatccattccacaccctatttccattcccagttaatcttcaaagagtcaacatggcaaaaacattccaagataaaaatagcaagatcttctagaaaagatttaagtttcaaggcaaaaagaaaaatcctttatggttactgagtatgctgtgaatccacatagttgtggttgtagctaaaatgctgcatatttcttttctcagcatcagtgatttataaatagagaaatttttaaaaatgaatctctgaaaacattccagaagaaaatttgatttgtgggaattgaaggataaaatgtataatggcaagtggcacaatgtcagacactgggttctgtgcttataacctgatctcaaatcaaaacccaatgcccctggcattctcaaagctggatcatcagaggtttcatttcggatagaagtgaggtcatagctctgctaatgtaaggtaacttcagcatgtctgaatccatctaacagtcttgttgaggcagggagcctaaagaagctattcaatcttttatctttctccagggagaaacaactttaaaatgtacgtattgttggcccctatatcatttttgtttatcaatagatcatctattgctttcatggtatctcaagagttagaagaaatttagaaggcatcttatctatgagttattcatttattcattaggaaatctttatttagtcccactataaattaaaggatatagggtaaatatatgaatcagatatgtctattccctttacaggattcattaattattttccgtgacatccttgctaggttggagttcaggctttggtgcagtatctccaatattttttgtgttgatgctactcatttaatacaatactcctcaagtgagtgaaagcaaattagccttcacttgaagtagtgaggcccaaccaactcttctttacccctcattattcaaaaagtcagatgtagagaccaaagaaggatcagagtggaagtgctgaacagttaacttagtgaactctttcaccttatcttcttgttttggcttctgtcaaacttcattgtacctggtcattctctatgcttatccagagatggaagcaaaatactaaaatttcatatttgtaacctagtaaatactagtatcttggtggaaaaaaaacccaaaaatgatctaaaagtccccaaaccccttaatatattttagaacactctttctattgaatgaaaacttaactcagtttagttttgtttgcatacacaaatcaagcattggaataaatcttaagagttaaaatgaaataactatatttgtaaaatgcttagaaatatccccagaaaaatatttcttaaggctcttcatcattggctgtggcaagatggaaggcatttcaaggtctcacaaaataaaaagtaaagtagcatgcaaacatatgcagacacaaaactcttaactccggaattttagggattttttagatttctagtttgggtttaagataatggtcaattgtcacttattggaactttgatttagtaataattttaaaaaattaagtgttggactaagttttaaaatttaaaatatactcctataactaaaccatattggattatgcctcttgccaagattattcttaaaccatgatctaagaatctcctattattctttcactgtcaggatccagaaactcagtgccaagggtaagtcagccttagataaacagattgtctggcctaggccaccaatctgtccaacatttgtgacctataaagatttttttttcctgcaagcaactctgcctatgccaactgtttatatgcacagtggaaacttccaaagctgtcatttcctaggtttgctttgcttatacaactaattactactgtgctagaaatttttttctatttattggatcccagaaaggctcaattaaccagtgccttttggtcaaggatagtagctgaagaataagacctcaagattatagcatttaaactttgcacggttcatcttgttgatatggcaaggattcagggataattgcctaataggcaatattgcctaacaggataggtgggggttcagaagggctctaatgaaagagaaaaagagagagaacttcaaatcatactgaagaaatagaggaaagcagaagtaacctgagacaaaagagggaaagcccttcggatatcttgaattaaatataaaccctcagaaatatttacagtgctctaagttagtagattgtcatttcttatggagaagacataattagaatggaccccaaccacaagagacctctctattaagactcatttgcgatttggtaccatattgcaaatgagtcttaatataaaagatgtgtcagaaaccctcttctcacttcactttatatattaagtatctcttttcaggaaaccaaacaaccaacatgtatttcctgaacccctacaatgaaccaaagtctattagaggtagtatgggacattgtgatgggggcagagggatacaaaaccccaccaacaaggagggtgctatgatttgaatgttagttcccctcacatttcctctgttgaaatcctcatctgaggattacatctgggattactatcactgagatagtattaggaggtggggcctttggaaggtgattaggtcatgagagtgaagccctcatgaatgggattagtgcccttttaaagagaccccatagagcttccttgcttgacccttctgccatgtgagaacatgagaaggctcggtctattatacagaaggcaggccctcactagacaccaaatctgccagcactttgatcttggacttcccatcctctggaatggtgagaaataaatttctcttgttaactacagttaaccagtttatgtttattttgttttctaatagcagtgggaactaaaacagagaagaaagaaggttgatatttaagaaatatgtacaaattaaggaataaccctcacaaaaataacaaaacaaggcagtttgtaattaaaatatacaagtactataagagctcaggactcacaggaggaggcaagggaaactgaaagctttaaaaagggaaaaaactaggagagtgcccagtatgaagggagagtagaaggcattccagagaagtgggataacatggggcatggtcatggagccttgaggggacgatcctaaaaaatagtggagagtgtttgatggtaagaattaggggggagggaaaatgagcctgtaagataaaccatagccaacaaaaacaaaaacaaaaacaaaacaaaacaaaaaaacaaaaaaaaaaaacggcctgatagggcaagaactttgtgccattagcagcttttggctaggggagcaaagtgatgtaaaaagcatttatggcacctatgcatgcaggattgcatggaagactggaggcaggaagcaagttaagaggttattgtttgaaacacgtatatagaagagaaaataaaaccatggactagagtgttcataattgaaatttaaatgtaaaatgaattgcagactttttgaagaaaaatgggtcattttcagtgcctatgacacatgaagaaaagtctctgccaatacatgtggtccatgatcctttcaatttggctaaccagttgttttgtagtctaggctgtatgacagtgtgacaaggctcgtcatggaagtagtccttcttttacgcaatactgtgggcccttctgcagatctacttgcattccatttttatttccctaattcttggactgctggctgtatacctcaaccttcttttctgcttctgactccttcaggtagaccctatctgatatgctgtcctcgcctctgagactgggactcctctgtccactgggctctttgtcctgctctgttctctagctttggacaccatcttcagcattgaactccattgtcctatttcaaacccactgcaccctataagccaggagaatccccctaacttgccctatgatgtgtggagaaataaatatgattataagatttctagcttagatttactggaatggatgggctattggcagaactgataaaaggaagaactgatttggtgaggaagacaatgatttttatttccagcatggccagcatgaggaaaacatccagaaagaaatcactaattgaaggtccagaagtggaggcagagggtacagggggcacatgactcaaaggctgattgagagcttattcatcttcgtggcattagttgaggaagggttagaaagaaaagagctaagagaagggcttactcacccttcagtggcagaagatacttcattcagagaaaaagaaagagcagttagtaaaagcatatgggatcagggaagccaacaaaaagaaagctctaaaataaatggtcagtactattaaatcagagtgattaagaaggatgacaatggagaatagaccattgaatataggaataaagagaccattgataatctctgagtgggtagtttagttgagtagtgaggatgaaagccagagtttaaaggcttagaagaaggttgaagtagaagaaatacagataactggcatagaccacaaatctagaaatttggtattcctctcagtcaattcctgctactacaaaaaaaaatcacagattggttattagtaacagaaatttatttctcacagttctgtatgctgatccaggcaccaacaggtttggtgtctagtaaaggcctggtctctgtctccaagatggtgctttactgttgcatcctcacatggcagaagggcaacaaggaataaattcactttctcaagcctttttatgaggacatttgctgagacctcttgacctaatcacctccgaaaggccccacctcttaatactattgcattagggattaagtttcaacttgaattttgaaaagacacaaacattcaaaccataacagtgtcgaatggagaaagagaaatgagattgtaataaaaagatgctatttttcaaggtagggagaaacctgttttaaagtagagggaataatagagaagggaagactgaaagggtaacagaagaaatcaatgtgacagtaaagaagggataagttcaaatgtttagatctcagcagagttccttatggagaaatgatacagctttgaaacagaaaggaaaaagaagaggacaagaaatgtattgaaatgggatggtttatattcaggggatcctgtcaaaatcctgaattttgatgctgcatgtgatgattcccacctttaatcccagctactcagtagggtgaagcaggagaattgcttgaggccaggagttcaagaccagtctgagcaatatagtgagaccctgtctctaaaaaaaaaaaaaaagaaagaaagaaagaaaaagaaaagaaaagaaaatcctgaaaccctgaaaccctcccctcttttttccctcagtgaagaactttggctggctgttcagaggaaaaatgggaaagaaaaaccttcaggggagtttactaactgacaggaatgaattagacagcactttcccaagtgttctatggatcacctgacatagtgtcacctggagaaggtttttaaaatgatctctggaggagacacttcattcacaagctcctcagatgattatgatgcttgcaaacgtccaggagtgagtgccttgttggaggtggatccatcttgaaaacactgactaatttaggaacctagcaggaagctacattgtctctcatcctgtggttatttttctcttcacatccctcacagggctcccttcgctgggtgtatttctatggtaaagagtgcaactcatcccagcatacaccggcataagctcttggttaggtccaaaatatcagcgagggcattatagtatatccacaacccaaaagaaaacctcagtactgattatgtgcacacatgaagtttcagaagaatgtaaacgatgtattttttctactgaattacctttcagtccattaagagtttatttcgggtagccatctgggatccccctctctctgtgagccccctttcttttctctttccctcccataccatctcctatttctctgttcctccttctccccattcccacttccatccttgacttgaagtgggacattagatctttatggttcttatggcattgcactgagctctactctagagactcagcactagaatctgcacatgtggaagatccacaggtgctttcttgctaacctaatcatctctaatagcataactttgatatataactataatttttaaaatcatactctagtcttttaaaatcatactctagtcttttcttactctagtcttactccttctaaaaattaaaggggaaggaaaaagtgtgtggaggaaagtaaaatctggtcaggcatggtggctcatgcctgtaatctcagcactttggaaggccaaggtgggaggatttttttgagcccaggagttccataccagcctcaatagcgagaccttgtctctacaaaaaaataaaaataaaaaaattagctgggcattgtggcatgcctctgtagtcccagctacttgggaggctgaggtgggaggattgtttaaatccaggagatggaggccacagtgagctgtgattgtaccattgcactccactctggaagagaccctgtctggaaaaaaacaataataataataataaagaaagtaaaatccaattctgtcacactgagaaaccttttattatttggaacccatatgccaacaggccctcagtaaatgaagcatggtcagtggaggtggggttctgcaacattatgagtttcttgctaaatgaagtcaagtctctcttcctctttctctcacacacacacatccatgcacactctgcacatacggaagacctgttgtttgaaaagttaagttagtgtttgaaaagtatatcatttgtttttaatttgttgcatgaatttttgtgttcatttggcaagataaattttactaccagttatctagatgagagggagtcaactttgaaccctcatttgatgcctaacctcggcatcaagagaaaaaatctatcctaaactcagttcatatgtacatttctatatttttcttttctcttgctgcattccattttatttaccaacacagaagcagaaggttgtagtttctctatttcctttttctgataaacacctcaaaagcatatagtaatttcctccatttttatctggcccgtgcttttcttaaacacatgtaatctgttcttccctccctcccccactgttctaaaattgctttccctgaggtccttggtggccttgtaatttatatttgcaaagacctttctcagccttcacttaacattttcgcattgactgtgctgaacacttcttaggatcctctctattcttggcccctgttctggccctcttcaattgttactctcctcctctaagctggttttactttctcctctgtcttctagatagaggtgatacaaaaacatgatcttagtttttctgatcttttatttttaattctcttaattagaattttcttccaccttcatagcttcaactatcaccttctcataaaagacactcaagtgtatatttcctgtactaagatgcttctagttgcttactgggtgtctagttccttccaaacatttaccattgaaactgagtccatcacctttccccaaaatccatctttccctttgaattctccacaaataaactgtaccgctcatttaattctgaagatattatcttttttattatttatttaattctttcatttgttgttaccatatttaaacagtaattattttgagggaaagaatcgtattttctacatctctatattcctgtattcctgatgattcttatccagcattctttttttttttttttttttttttttttttgtgatagagtcttgctctgttgagtcttgctctgttgtccaggcttaagtgcagtggtggcaccatcataactcaccacaccctcaacttctgggatcaagcaattctcccacttcagcttcccgagtgactgagactacaggcatgtgccaccatgcccagctaatttttaaaaacttttttgtagagacaggttctcgctcttgcccaggctggtctcaaactcctaagttcaagtgatcctcccaccccagcctcacaaagcactgggactacaggcatgagcctctgcacccagcctcctatgcagtgttcaataaatgatttttattaagacgtttcacctaagttcctaatattttgcatatacttctcactgtggtaatttttgaaagggttgacagattttgatgaaaatgaatagatatgaagtgtaattttggttcagaccaccgtcttgagacaaaatagtagctactaaatgtactgacaggagaatttctgtaacttattaacagtggattccgtacaattttatatacctctgcaactgaatgtgttctgctattcagaacttctgaaagaggaagttaccagccaaagaaattatgaggcaagttgaaggatctagttaggttagactaagcagacactcaaatgagagggaaggcagagctaaaacttcaagactgggtttctctacctcatctgggagaatactgacaacagggcatataaatttttgtctttttgcccaaaatatgaggtactgggctaggtgcggtggctcatacctgtaatcccagcactttgggaggctgaggggggcagataacttgaagtcaggagttcaagaccagctttgccaacatggtgaaaccctgtctctactaaaattacaaaaaaattagctgggtgtggtggcgcgtgcctgtaatcccacctacttgggaggctgaagcacaagaatcacttgaacctaggaggcggagggtgcagtgagttgagatcttgccactgcactccagcctgggcgacagagtgagactctgtcttaaaaacaaaataaaataaataaaaaggtaatttttccaatgtcaaaggagactagaaaaagtttttgaagaatggtgtctgcccctactttgtgtggcggggtgaaataccactatttcaccaagggtaacctgcgcctcctaaaacttttatttctcccaagactaagtttacagattcttagaattaatgagttgaaaaagacttgaccatctagttcaaatccctcgttcagagacatgccacatgcttcttaatcctggttgtatgttaggttttctaatcttgcctctgggccttatctctgaagtcctcactctgcactggccctagagtttgagtaatgccatccaaatgtaggtattgctattatattaaaaataacactttgccttgttcatatttaatgaattttcctatgaaagatagattcatgtatcacttttcagatatttaacatctgaaattaaaaaaaaaattagccctaatgaacattttctacaatacatggatcaagagtagagaggaaatattggtctccacatctcccctttccactcccccaacaccaaatccactgtctataggcatttacacattccttctgtgattggatgattctgcctttttcaaggctgaaaaattcaagtcaattgactctcacagatttgaagttttctgctgtggtgtaaaaaatacatccatatttcaattgttttcactttaatttatcagttggccacaatatatataaaacagaattgcctggtgctcagaatgaagtaccaagtgattcaaatattgactattctactcaatttcaatataaacttaagcaagtcacacacttgtccacttatccagtagatgaaaccgcaaaggaggagagtttatctgaaaagttcttctctggagaaagatacttagaaaatacaaatggtccttactaaagaccccagctcatcccaggaagatctgaggaaaagatgagcagacccaatgctacttcagctcacctttcttagcagtcttttttttaaaagctctgttttaattgaacactatgttcctgagtcagaagagtgcttcagtaaatctgccttcctggggcacaacgaatcacacacagtcacactttcagaaaggcgaatcctgccaaacgttggctggacaaaagatggctttttttctcctccagcaaaaattactcaaattgcttgagaaagaaacacagtatgtttatccctgtttacagatatttagctagtgccccttcagagggtcatgttcctataaacagcatcatgataattatatccactgctgcaaagaacagatgtgtaaattggtggtttcttgggggaaaataataccaagtccattttccagaaatgtacacagtacagtgcagctgtaacattctgtgcagaggtctcattagtgtctattactgagtgaggtgatttttaaagaatatggaaattcacggggggcatctagcagggaagtccagagacacctaggaaatgattcagatggtttggtatatttaaaaatttctagtgatactgggcaaatctccacatctaaagaaagtagtaataaatctttgattataaagttttccaggcaagaaatatgtatgagtagagggtaggattaggaaacttctcatgccccacacacctctgagatctgtgtaacttaggtatagactaaactttagtgaggccaggttgcatcaaggtggtcaaattttcgatctgtgaacaccagaatatttctaaactcattgctgaagggtctggcagggatcagggttcctgaaactagagtcaatggttccttatttaaaaagccaatgttaccttggacacaagaattagatgaaatcctttctgctaatgaatttattttgttgtagatacttgcttttccccagggtatatatttatgtgactatatggtaatcagtattatccctaaaaattaaaacacaacactaaggtcagcttattgtattagaatagctattgaacaggtctgttattacaaatatgcatatcactataagcttcactatcttctctctgcaaaattctcttaaatcatgtcaaatagtatgtacagaatattatatacagggatctagtgtctgcctgaaggatgggatttctcctgaactggggctatcagtaccttcacatgtaccaaaactttgcataagaccaatatatatttcataacttagtaaatgtgataaaacactgaaagttaatttgcattttcattgaatactataatattcaatgacattatgcaaaactggggcattttgcttctgggacagaaaagtataaactatttcttttaagctatgcttctataattccacacgaactacccaggaggatcaaagcatgttagaatgactgaaatacaacaggaacagtctagtctgttaatctggatttttcaggcctgggatggaaggataataaattgaggcctgccacatgccttaggccaaagcatgcctttgacactaatgatctaattcagttatctactttgtccaaaattcagccttctcatactctgtgccctggggacataaacaaaaacacagggggtgatgaggtagccccagctctatctggggctctactgactcactctcttggtctcagtttcaagggctatgaaatgtcatggtgtgatggtctcttctaggccttgtgtcttatgttcagtgggtctatgcatgctggaatttagaatagtgattcttggtcatttgtgtgggatagcggctgctgggtatccacttgacttgaaagtaaagaggtaatggggtagaaatagaaaattctgaattgtttaatataaaatcaaggaagctgtttccaatcaggactgtggttcaggtctaaggaccatagatgcagcccactagcacatttactaacatgcagtttgggctctttatactaggctccctcgaccagcatctctgaaagttgaacctatgaattggatttaaacaagcctctttggtgtaaatatgtatactgagggtggggaatccctgatctaggtaaaagaggactttttctgctaatctgaaatttggttgggagaaaatgatgtaatctacctaaacttcgattttgtaataatagaaatgttatctttccatcgttctcagaaagtaaaagtgtatcagtgaaacagccccttagagaagtttcttagaaaagcaagcaatttcctagtaaaaaatggattgtatttcaaaaagaaattgttaaacttgaaacataaaaggctttccccacagaaataacctaaaatttccagacctgtctgtaaaactcagattgatccaaaatgtaactgaaattctatatgtttgcaatggaaacatagaagaaaataatgttactgggcttcggagtgtaatagaaccatttcctcatatataatttcattaaaaatgcaaaaatataaaaaactatatacacacgtacttgcgtataatttcccttttctagtctacaagtattatggtagcccaccctcaacagtactgagaatgaaaattatagcaaaactcttttgtattagttacttctgtgtcataatgagagtctcaagataaatgaaaggagggatggataaaatgatttcttatgatgggcaaaggttggaagaaacatcatgtggggagagggcaaagagaaaacagataaaaagagaataaaagaggaaatgagtggcttatgtgagcaagcgatgagctaaagtggaagtgtaggagaggtgagttgcttaggtctaaggagaaagactgcttaggtgtgtgttcacccccaggacgaagaaaggaacactgggtgagattttgttcaactacccatagttaccaccagatggtgaaactgatcccgggcctcttgggtattgatcagtttatggggagatggggagaagactatctttcacttgttaattcattaatttctttcgcaaatattttttcagtacctgctaagtcccacggactatgctaggagctgctgttaaaatgacaaaccagataaggtcactgcccttaatcaacttacagttgggtgagaagctatcaggtacaagtatggccctagaacaaattagtcttttctagttaataatcttatgtgatgagatttggccttgctcctttggtgacttgcctcaaggagccccaggcaaaaccaatgtaacatatattaataatatatgaaataatatattttgtagacacaattgccttatgttgtccaggctagcctcgaactcctgagctcaagcaatcctccccacctctgcctcccaaagttctgggattacagacgtgagccgccgtacccagccaaaaatgtttattttgattagatgactggtattaatctgattaaccaaagagacaaggtattactaaattcctcatccctggtaacatttccatgttagctgttttctatttgttttttcttttccacaatggtgcggcctagaaacagttaaccttcttcgggctattacataccttagacatataaaaaagctatgagcattcaacactgaaataatcatataaaccaaacatactgcacactacttcagggatactctgaagcccatccttagaccccagactcaaacaaaacaaaatacgatgtaaagaactgacacaaatcatcggagtttagagaacaacgtgacgggcagcagaggagaggagagggttgaagcaaacttttttggtttttttttcctaagtagggctggttctggcttgtcttccttctccccactttgcttcttactcttgggcttacaaactgcctggtttcccttctccaagtcagggcttcgtttctctgccttggccttcctaccccaccttctgcgttctgactcaatgaggcccttttcgcgtctcattttctgccttctttaggcgttccctcggcggctctgcagtgtgatctcatctctttgtttctccccggctgccgtcagtcaccggctctctgcgcccccacccgcgcgggctcgcggccgtgctgcgggcgtggcctcagccgctgagaccctggggaccgcagggcgtggcgcggcctccgcccgctgcacggagagccccccagaggcagcgacacggcgcttggggtccgcggggctcctcctccaactccgcagacctccggggaggcctcttgctccccgaacacccgggagttcgctttcatttttaacgaatctccacaatctcttgtttgggagataattgcttctttcaggggcttggagaacaaaagcgtcagcccagggccccaggtctctccgcgggaggagggcacccaggggcgatgcgccgggctctctccttcgcccttcttggcccgctcgccttcagctcccacccgcagcagcaaccgcagcctgcttccggggactgagcagccctgggtcagccaaggttaagcagcgggtggggaagaggagagaaagctgggtcaattggaagtaaccttcttgtaccgcccactttttccttgcttggaggcggcaaaaagcactttagcattcttcgggctgtttgcgcctctttctctaacagggccaggggagtggaagagcggccggcaggaaggtttctttgtcagcaaaagcggacctttggaaactaaacagcaatgctctgtctttagaagacagcacaggaaggaacaaacagctgaggagtgaaggccagagaccccatttggaaaacaatggcctttcatgattattactatttttaaaaagttttctaggctttttcatttgaactttccatttctcactatgaaatgcaggttctatagacaattgcacacaagtttctttttcgggggggagggtaaacgaagcaggtggaaagaagtgagatgattgtagacgtggccaaatttagacttggtgtgagatttcctcttcgcttggaaacacatggcaccagcatgcatttgttcattcattcaataatgtgaatgaacattaaacactacgatgtgatgggctttgtcacaggctgtaagtggcttcaggtccacatgaaaggagagcgaaaaattaaaataaaatattagagagagagaaaagggaagaggggcaaggtgtcaggcagcaagcttcttagggtcagaatgggtccccatccctaaaagctgatgactgaagagacccacgagggtagacgagctgtagagagacaatactgcatctgccagtgatgagtgtaggaagctcatgagggttagaaccttccctctctgttttctgacctctttttctttttaaataggttgaagccaactgtggtagaggataacagtgattcgcgtatcttatttatttatttttagcagccccctcccccgcaactaggacagtgagttccattcagattttcaacacagctaaaaacttggctttaaaacttgtgaagggagacatttctttagaatctttcacttttttcatcgcagaggctttgggggaatgtttagctttttgctgaatcatgaagggtttgttactgcattctgagagggtaggaattagatgcctaaaggatggtgtctgctttcctgttgaggtggtttatttaacagttcatagaggcatgcaggtcaagtcatccttaactgtacagagtcaagggtattgccacatgggaggctggccagcggagaagtttggtgctctctcagtttggagatcctcatgttgtatacatattccaaaattcccagtaattatgtacctataattatatacctataaataccattccagatactagaataagatcacagataacttcttagatgtttcttttctagagaaatagggaaacagaacatatatacatttgcacacaattcaaacttacactttgaatgtttgtcttaaatctcctagtcaactcccttaatgtacagacaaagaaacagatccagagaagtgaagagactttcataaagttggagtcaggttgggatatgtcaggcctggccttcttgctgctgattatttctctgaattttataatagaggcacctctgaaactgtctgaaacttttcatttaaagagatattcaaaaagaactgtagatttctcagaacgggtgtgtttagtctgagtgttgtgggccagtatatttcatcattgaatgtgcaaaagatttgttaaaatggagatattggttcagtgggcctgggcggggtgacagtctgcattgccagcccaaactgcccttagtggtgcagatgttgctggtccacatgtggaacggctaggctgtagacagcatctgtcctccttgcctttccttcttgctgagggaacagccctggggatttaagaagccctttttgtttctgttgccaggtcactgtgctcccttagctaatctcgatagctttcactgccttgtcttcatccagatctaagattgttagaaatagtccctagagacaggtgtcttgagctggagggtgtgatcctttgtatagtgacttagcaccatttaacttggttccacaaaatgtttctttcacacataagcaatttactcaactcagattgttaaaaaaaaaactgtttttccttccacaagtgtcctcccagctgcagctcattgcactcccttgcagctgggagtgcagctggcatgctgctagctcactggtctggcccttccactggaacccagcaagttttttgtgctttttttcaccactctcttctatcctgcacttctgcatgtgacgcctagatttagctgtaagtgcctttgtgcagcatctgagttgagcaagctgctaagatataactgggcagaggttcttctaaggcaggcaaacttcagtgtcacccaaagggtggtttgacttggctttgctttgtcaagcccaccgggctttgatatgactttgtttttgtttgtttgtttgtttgtttttgtttttttgagaggaatctcgctctgtcgcccaggctggagtgcagtggcgtgatctctgttcactgcaagctctgcctcccgggttcacgccgttctcctgtctcagcctcccgagtagccgggactacaggcacccgccaccaagcctggctaatttttcgtatttttagtagagatggggtttcactgtgttagccaggatggtctcgatctcctgacctcgtgatccacccgcctcggcctcccaaagtgctgggattacaggtgtgagccaccgcacccagcaatatgactttgaatcgcaagtttggcttggggagaaactagggctttttttttttttttttttttttttacctgggagctgtcaaattgcaaaccacagggcatgctcacaagagaagtgggaagatagggaccatttcatgaatttctcaaatgccaaagcaatgcatattttcttagcttgataagcaatgggaatgtctaaagtttgtttttggtgggggtcggggggaaggggaagggcatattgtaatgaaaccacaattctattttagcttactctgataaaatatgttgcacagagtggaagacagactaaggaagagagcttcttagattgaatgttatagtgttagcttttattgtcagttttaaaccttaaaatatgagaatagtacttctaggtagaatttctgacatttggtaaaaggagaatcttcgtctaggtcctccctgcatacccactgcactatcgccaccagctacttctgttattgccttgattctctgcagtgatttaaaccttctgttgtatgtttcttgggtgcttccatatcttccatatcatggcatagtcactcagatgcatactcatttaccagaggctgcagaggtatcaggcaactttggtttgttcagcttaccgggttttgatatgactttgaattgcaaatttggcttggggagaaattagggaattttctatgtagtaactgtcaaattgcaaaccacagagagagttggctactggatttttctgggaatcatttattcctagtcttgggtataattctgagctgatacagtaatatgggaaattcttggtttctgagaagtaaatcagaatcctggtaagagtggtgacatcacctcttgaactcaggagagtctccaggactttttatgcagcaacacatctgtaaagctccccattgttggagtttcactaatttggtgctctgtacatccctttgggccatgtgacatcacttatgagagggttgtggcatgtctcatagtgttgtatatgtcaagtagaaagttattttcattgacctcaagactgcagaattagacaatatctccctatttttacccaatttagccaaattctttcattcaaagattagattattattaatccctgaacgcaggttcataggaattaattcaagagtcgtaaaatttgcttgcctggtttccaaactaaataaaagggaattttctttctttgatggctccaaagggttcggtgtttctccctgcagaaccacaaagtgggaggtgtgctgctgctttgtaccatgaactacacagtcatcaaacatatacattttctccacaacctatgctgcataaataatatgatactttctgagtatcattcgattcagagcaatttgtacggcatgcgtgaaacagttctagatggggtttccttatatacctcactacaattgtgaaaaaaaggaacacgaatagttggttcaagtaaaaagcaatgtttaattcaggaactcaggctgaatttaaatcctcacactcaggaataaatcgcagaaccttctctttaccacctgctcaatcccttccttctgataagaatgcataaggttgactctagtccattcatctgcttttctcatttattaaatagccatagttcctgacctgatgccctctccctccctcttctcccagtattgctttccctgctctctgatatttttctcttttgctttcagaattaaaagggaacctggtctctgggttgttttcaacatctcaagtgtgaattttccctgtcaaaatcttcacaaggaaaatgagtcacagcatcacctgggtgacgaggtcataacacctcagcccttgcttaaaaaattttatttctacttttctattgtaaagagatctcaaaacaggaagataaaattggactgacagctctacagcctagtcttttagacagtgaactaggccagcattggcagacactggcgatgacaaagtcctgctctgaattatgccaccccgcactccactttttaccttgcctgggaggcttgaggaaaaatcttcagagagcagttcgacctagtccttattcacttggcttcttgactttctggatttcaagggtaattttacctcacatgtaacctatacaagtattttaggttaaaaccctgactctgccacttactagctgtatgactttgagcaaattacttaattacttaactaatgtccttctacttagtcttttcatctgtaagataatagtacccattgcatagttttgttcttagaattgaattagttaatatacaaactatatgcaataaatatgtttggggtgtgtatatatcatataaaagtgcttagaagagtgcttgacatatagttttagaatttgctattattatgttctccaagcatatgaggtattttatgtcattacttttaaaggtcgcttttttatatgtgttagtgggaggcatttattatttttttaagtgtgcatatccctgaaacatccctctgtggagctataaaagaaaactataaaatatttaccatataattcactcaatccccagtctccagaaagtaacaatttgtacttcatttgtattgtcttcttccaggcattttacaaatactattttctttcatcctcaaaaaaattctgcacaataggtaataggattctaatatgggtgataagaaaactgaaatttagagaaattaagtaatttatcccaggtcatacatttaagcagtgaatgagccaggattcaaactcagatcttttgaccccaaaaccatgccaggtagcaagtaatcaatgaatgtcaatgacagatcatcgagagagaatccagtgccaaaaatgaagagggtgtcaacaaaataagaacaaggacaatggcagcatgagcaacaagaacaaacttagatccaaaattaacagttaaagatttttctagagtcctgcatatttttccttaaactgtccagcagcttggggacagaaatctaattaaaatggaagtctatgcatgctcaaaccacatgccttgtacctgatgcaatccgcttccaccccagtcctgaaaaaaggcattcagttatttttttctacatgtggaagaatacaacaacataccttctagaatcagggagaaatgtacttgctctttttatttttttttaatttctcaaatactgttctataaggataatcactcacctggtgattaatgtagaatgttaaggtgtgtacaaattactgctgataggtaacactgtccttgcaaaatcatcccatgtgcccccctcaaataaataagtatacttcaaaaagcagtgtgcttgctatacaagtgcagttttaagaaaaatcactcagctctctcttgcaaacatgttctttcccctaatgcctcctacacagagattctggagccacccccttcagaatatctgaaatatagaccaattttgctcgttaaaactacttcaagtagtcctagagctgatattaggattgctacttattcagtcatacttttcgagtgttcattgttgaattcttagattgaattttctattagtttccttaaaatataagaggttggagggctaagtttaagacccattctactaattgtgaggctttccacaatctgtgtttccttatttttttaaaggggatggcacacttgcttagccttcttcattatcattctcagaggaatcattttaagttgaaagtacttcataacctataatgcataaatttaaaccactgtcatttccccccaccacagcccttggcaaatggggtcttaaattccttctcccaccaactagacttttagcatgcattctgacacgtattgtgtatccttactagatatgaggtatataatatttgggctttactaactatccagtgggggtgcattggatatacttggcttggcaatttcaaattataatgatcttcagtaccagatgctcttaagctagtcccctacaaatgtctggcagcttcatttgtaacttttatcaggcttgagtattaccacacacaagcacatagagtagctctcagaacctgcagaggcaattgttttactagatgtgtgagggatatagttggatcaatgggatagatactgtatatgaaatagtggctaaatgagtttgtgtgtgtgtgtgtgtgtgtgtgtgtgtgtgtgtggttgggggatgtcaggtgaaggtcacatattttgggaatgaatagatttctagtttcagtgaatttctatcactaagctcctacactaggtgaagttttggggggtgggtaagttagagaagactgagaaggaatcagttggtgtgtgtcaggtgatagtagagtgggactgtggtttaactttgacaatgtaaacagatcttcccccttcccaagataagaaagaacagagttgagtactatggcacattttacatggtttcctgcttatctctttctttgagaatagatatagctcagtagtactgtcgagttaagaaatagcttttccaccctctgagtgatgatacctacaatcatcaggatgaatacagtctcatgaccaaatctcctctggtatttgtcttatcaacatgccttaacttaatgtcacgatgctctagaaattactctgagagaataatggtgatggcaataattatgatgagaataatggtagcagccacccctttctgagtatgtacaaagtgtcagggactgtgctgggtgctttatgtgcattaactcatttgattctcatatcagcccaatgggatagtttttttattccctcatcctgcagatgaggagcctaaagctgacttgcccaaggtcaggatctaccaagtaactggcagagctggaattcaaacttacacatgtctaactccgcagcccatgctcttaagcaccagggaatattgacttttacaggaggaggactaagcaagggctttgtcattcagaagctggatgacgctgggctccttcctggttcctcatctgtgttgattataaaacaggcacagtgatgtgttcctcacatgatcatgatgaggattgaattgaaatactaaatatatatactgtgcacttataaatgtaagaagagagaggaaaatgactgctggagagtggcgtgatgaaggctccagcattagtgacctggagcgagaacacccagccagtgagctgagtgttcacacacagagagtttacacactctctgagcaccaacacagtatggcatgtggtcatgcaacaactaaaaataacatttttttttagtatcaactatgtgccagcactattttagccactgaagcttagaagattgtaaaaaaacagataaagttctgttctcagattgtttatagcccaagcgaagttcagttagtaataaaataaaaacatacagcagatgatcataagaactaagaggggaaagacagagaagtggaccaagagtgacaacatttgaagaagggtgtgtggtagagtgggtgagaaaagtctctgactcatttattcattgaacaaaatgtctcaagtacctgctgactcagactgtaacttatgaagggggtttaattaagaaaaaatagatgaacaatcattatttgttatagtaggaagactgtagtaatttaagaaaatacttatcttattgcatctcacatttttgagtatccaacaaaagacacttcgcagtgtcttacctggaaggaagattgttttatgctaagttccctgggctctggggccctcttcctgctggtgagctctgaccatcttcaggagcttggcatgtgctttgctcttggggcctctcagctgggaaagatttgcctctggtggtagtacaggggtttgtctgctggtaaactgcttttctgtctttttcttgatgcattggcttcctgcagctcttcttctgtcttcagttgctagcagaagaggcctcacagtccctctcatggactggtctgtgatagcctttttagctgagtgatggggagttccacccttttgttcctagctcacagtggctgctaaaggcatagcaacctctctgagagcagagtctagtgtccccctcactttgccagcccttctgtcctttgagcatgtcatttcttgagggaatcaacatgtgcttctgtaatgggcagtgttcatcagagggtttgctcccattgctcaagagtagagatgcttcctcccagggctgacttcccataggtattttcctgagtctcagtgattttgacccttgattcagttaggtaacttatacctatgtctgctatatccaaaagttttctagaggagtttagtcaagtgattctgtctggcttgtgccttggtacatgaccagcatgattaacgtgcctcatcgcaacactgggctcttccaacccctgtttagggaaggagacttccttccttgaataactaagggactagttattcccagcctactccccttaagctttggagagcaatacacagattaaatataaatagtagggagcagagattctccagcaatctcccatgaatattttcaccacttttatttatttatttgagacggagtttcgctcttgttgcccaggctggagtgcaatggtgtgatctcagctcatcgcaacctccgcctcctgggttcaagcaattctcctgcctcagcctcccaagtagctgggattacaggcatgtgccaccacacctggctaattttgtatttttagtagagacagagtttctctatgttggtcaggctggtctcaaactcctgacctcaggtgatctgcccacctcagcctcacaaagtgctgagattacaggnnnnnnnnnnnnnnnnnnnnnnnnnnnnnnnnnnnnnnnnnnnnnnnnnnnnnnnnnnnnnnnnnnnnnnnnnnnnnnnnnnnagtccaggagtttgagaccagcctgggtaatatggtgaaatgttgtccatctctacaaaaaatataaaaattagctgggcatggtggcacatagctgtagccccagctatttgagagactgaagtggaaggattgcttgagcttgggaggtcaaggctgcagcagtcatctgagatagtgccactgcgctccagcctgggtgacagagagtgaccctgtctaaaaaaaaaaaaagaaagaaaaagtacacacacacacacacacacacagaaaaataattttattgatatgactctaacgagtcaatagataaatataaatcagttgtctttatcttagatgtattattattttcaagtgcttgtttattattatgatcaatggcgtttctatagctttgctatttcttttcttgttaaacctctgcttactaatttctataattggggaatcatatacctgttgtagttagatgctcttgaattccaccactgagaagtgaaggattttaacaaaaattgacaaaatcgaatccagatttcttcacctgtcatcatctttctgaaatagcactaatggagatgctcagattttggattcatccaataaatattaattgagcatctactttgtgccaggcaccattctagaaactggcattcagctctaagtaaaatagacaaggtacttctcaaaggctgactttttttctgtttgaaggcatcagttgcaatacattatttacctcttctatgtctttgtgggacataatagggttatagatatacaaaataaaagaaaacaacttttcagactggaaactgagttctactctgataatgctttatactatgttgaagataccacctcatattattttggaagcaggtgggctgtacatgttgaataaataatacattaaagtggactgaagacccatcttttgatcaccagctcttatctgaaaagttaacattactactgcagtttccaatatgagatattttgttttcttatacagtttcattgcttctctgcgcactctgctccccattcccctcataccctaggtatgaggtcttcaaaccagactgcatgttgggggatccggtgtatgcccactgtgcttattcatctttttatttttattttttttttttaattttttttttaatttttttttttattatactctaagttttagggtacatgtgcacattgtgcaggttagttacatatgtatacatgtgccatgctggtgcgctgcacccactaacgtgtcatctagcattaggtatatctaccaatgctatacctcccccctacccctaccccaccacaggccccagaagtgagattccccttactgagtgcatgtgaactcattgttcaatccccacctataaatgaaaatatgcggagcatggttttttgatcttagcgacagtttactgataatgatgggtaacaattacatgcatgtccctacagaagacatgaactaatcattctttatggctgcataacattccatggagcatatgtgccacattctcttaactcattatatcattgttggacattaaatctttttaaaggacacttttttccttacccctgcacccaaaccggaatagacattccctctatagaactggaggaggctggaccactgtattctctctcctacctaaagggcattttactgtatttttgatctttgtctaggtttaaagaaagtacagaagctccactgtgaactactttaatacttgcacattttccctaaagtcaattgccatggtatcaatgatgcttaaaaatagagtgaaattttgttatgtgactttcacctcaataaattattaataaaaaataaagtgggccataagtaggtacttcccagattttatttatatttatcaacactttattctggttcctttacaggctgtagaagattctgataggcatgaaaactacaacatatttaaaaaaacattgcttaggatatctccggcctttcaagtttgttctcaaaaataactttgcttgatcaaatgaactatattttggtttactaaagatgttctcagaaagaagaatatgtgtacatcaatgatttgtaatgcatttaaaattcaatactattttttaaaaatttaagtattataatggtactatttatagctagcagaagtagatatagggccaagttttaatttgcttggaaggttgaggcattcctatgataactgggaaaagtgaaatgcattgaggtatcccagatgaatggatgatgttatttttagttctgaaagttagccattcatggatttttgcctagagctcttttgtaacatattgaatgcaaatgtttggacattttagaataaatcttaagttgtccattcctcctttccccaaaggaaaagaagaccagagcaacaatgttggatatttaagtaattacttcttatttctggctttcttatctgtaattcttaaatatcaattaaaatcattgttcattcatctaatggatttagaagtttcattagtgtcaacaagttagtgtaatggtactcttcattttttccaaccaatattcatctgagattttaatgtttgtttaaaaagtagggatgtcctacaccttggtttcctttaagacttcataaattgcagagctctcaaacaaatcagtcagtaaaaaatattaagccataacaataaagattcctgaaaaacttatggtaactcgtaatgacacccttcctacctataatgtactgcactggaatgtcctctttacttaattcgcagatatcaacaattctgtgtaaaaatgaaataactttgaaattccctcagaaacattagagttcattacaaagcttatttgtggcaagacttagtttaaaaactaaatctatctttagtgacatttatgagctgactttttagccattagatagcaggattccttttctggacatttcatcttaactcacagttttagagtgttgtccttacttgaaaagaagagtgtaagatcaggtgtctactgcaaattcctgggaagttatttattgttaaagcactatgatgtggtttaagtgtattttcaaaaggattctatgtgggtagacacagtatccttccgttcagtagcatttgtatagtgcttaacataggcactgagtatttttaagtgaataaatgaacgagaatgctgatgtgaagccttatggattatctactacaagtaagtccaagctattccaggtcagccatgcaataaaattggacttggaagtaggtgggaggggagaagagttgaggtcaaatacaagctgggccactgcctccctcactcgctgtatgaatttaggcaagtcacttaacttttcagggccagggctgtcccttttggaaagtgaaagtattttgctgaatgtgctgagtagtctggtttctctgggcttgaatgtccttcatcttaagtaagcgcttctatttctagtggggaaagggtcaaagcgttctcagaacctggggttactccacatagccagttttgggaaatgttctttttctccttgtcttaacaaaatacacaacaaaatacactcccagtccacttacttttatactgtactgtgaaaagaattttaccaagaaataacctgcagtttaaggaatattaatagaatcattagaaatacaaaagaaagacacacaaacaaaatccagtggtgtctagcttcaaacccagtattaacttaaaatatttttatttatggatgtctctattcaatcactgaagtctgacctcttcttagcctggtttatttccttccctttcctcccctctcctctttcatttcttcatctccttcccacatccctctcctctcctctcctctcctctcctctcctctcctttcctttcctttcatttccctgcgtctgtttctttactgctatctggaaaaacttctattaattgtcttttttttcccaactaatctctaaaatttagttttcctaaatctctaatgatgaagtccagcagtttctccaggatgagctacatgcgtgtggagtactttgagcatctttttgggtatagtcacttatttgggtacctggctcttataagactgtcttcacctctctctcctaactcttgtttttcatggttctccccgtttctgctcactcctgcttcccttgaatttcttatacttctgggttgtttaagtgaggtttgtctcacaatcttggcaccctagtctagtcttagcctttctaaaaagtcattctaacatagatgctgtgttcagaagcttaaattctgattttttagaaaattgaagttgcagatgctttaagaaattgagagagagagaaagagaaagaggagagagagaaaattgagagccctttctttatccttgtagtttctttgtttatatcatgtagactctcagcttccttctctttgtgatttccagcttttcaggagtttcatccccctactccttatgttcataaagaaaagacagagctctaaaatgttagctttcttgagtcactagagagtcttttgtggacacctgctccttctgaaacaattgacttgtctactttcacaaacagcagtatttgtattaaagaaccagttggcatcaatgcccaagtgcaggtgtcctaatatataagatggtgcttcattcagaaaactcaaggtagagtaaaataaattatcaacatcttggctccatgctccattcacaactgttaattttacagggttatgcttccatctctgagcagagaactcctggcagggacagctgctcctgtgtctcacattgggctgagctcatcccagtaggagtcatcaagagcagcaggttagcgagaaggtgatagtacatcagagaactgagcagtggaggagggagaaggatgggcctctccaaagtgcttttcatttactcctttaatctttgtgtgtatatacatgcatggttaactaaggaaaaaggaaaagttgacttgaatttgactgagaaaattatcaaacctgcttttacttgtacatgtagctcattttcaaaaatacttttgtgtatccactggtatgttgatggtcctatgcagcaataggtctgtacgcttgtccaaagaatgtctaacagccccacatcatgattagcaggagctgggtcactggggcagagctggtttgacaggtggaaaacttgtcctgagtagttctgtattagcttacctcctaaactggagcaaaggtcaaggccaatccaagattgagaacaggcgccgaacatgttacatggtaaacactcttttattagtggtcttttgagggaaagttgctgtgttgttctttgctgttatttctgctagaacagtgttcacaaaagtgaacaaaagttcaatgctcaagttaaagaaatctaagaatggagactatcagtagccatgttggggcaccatggtaaacaatggaactggataaaattttatgtagttgcctacacaattctttctatgaccatacctgctgttcctatcctctgaattaattttcatgtggaaaatagtcatttgcagcatatattaggctacaaatgttgccatcaaaaggtaacattctatatgctagtctcttgtctttagtactaagatggctctattgatgataatacgaacacattttaggttcccaattgctttgggaataaagaattgtgacttagttaatatatgttgctttttcaaaaggagaaacagtgtttcccatcattttttaaaattcaggaatagtggtcttttttaattcagattttgaaggtttggtaagtttattgctaatgttggaccacacgcaagagaaagttagacattattttgtgaccagcattgttaagttgtcacattctgaacaaatcccttaaagacctggaactcatttacattttgcataaaatcctgatgggatttatggtttaaactttgactatactctttgtcttgaatttattaatttccttatcaggcttaaaacttgggggaaagtagacttttgcaaaatatttttttaaaccattaagttttatacaaagtccttctcaaaaaccctgtaaaccctctatctttcagagctctttgataaaaacctggggtgaatgtgatttattttttgcttttgtttctggtttgcttgcttttttgagacagggtctcaatctgttaccaaggctgaagtgcagtgacacaacaacagctcactgcagcctcgacctcgcaggctcaagtaagcctccttcctcagcctcctgagtagccaggaccactggtgcatgccactacacccatctaattttaaaattttctgtagagatggggtctcactatgttgccagggatggtctcgaactcctatgctcaagtgcctcctgccttcacttctcaaggtgcttgaattacaagtgtgaaccactgcacccagcttgtaaatgtgatttgagttgtcaaagtacttctaaaaaaaaggctggtttaagtttgacatggagcaacattgagccggggaaagaaaatacgtagaaaataatgccagtggccagatgcggtggctcacgcctgtaattccagcactttgggaggtggaggtgggcggatcactgaggtcaggagtttgagaccagcctgaacaacatgatgaaaccccgtctctacaaaatacaaaacttagtcgagtgtagtggcacatgcctgtaatcccagctatttgggaggtcaaggcaggagaattgcttgaacctgggaggcggaggttgccgtgagctgagaccacgccattgtactccagcctgggtgacagactgagactctatctcaaaaaaaaaaaaaaaaaaaaaaaaaaaaatggccagtgattctggaaggtccgaaagacattacttttcccatacaatactgtgggagaaagatgaggcttgatttgaacttccagggtactgttgaattcttaactccaaaaacagtgcctggcacaaaataaatcacttaataaatacttgttgaatgctgagatttaaaggagaagaatgtcattgaagccctctcttttcccttcttttctcgacaaaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacataggtgagcaaccgcgagggtcagatgcaatgggtggatggggaagggagttgctattcggaagaccaggccacctgggtcattgagggagaggaaaaagtctagaagatgttttccagaaatcaagggaagctgtgcttaatttcccaaagtggcaggactaagagctaaggttacattcccaaatatctccagagaggactaccagagaggactcaggcaggtctatgtagcagccagtactagaaagatctggcaattaccttaattggattgatatatgcagtcaaactagataaatctgctttaaaaaagtattctgtgtgctgatagacttagtttaataagtaattactgaggctacatatattttatggatgggaattagctaatgtgattatttggctctagaaaatgcctggtataaatacagccatcctcttcttgatccagattatatagtgtgtgaattgttggcagcaaaagtataatctcagaccacccttccctatctcacattatgtttctgggcattctctccaccatcggttggtgagtagtgtgtgtatatgtgggtatgctcagagaatgttaattgtaacattaattggggtcaaacataattaggaaaataagtctgtcgatgttgccaaaaacaaaagaaaaaccccaaatacagaatatgttgtgaagtcaaacataaataatcattttattattgaagacacgactttctacaatatgcataaataattgagggttcctatgattacaaaaaggtactggattctcttcagtttggagctgtaacttgcaagttggagggttttcactattactgctcaattgtgcagaattggaatagaatattcccagagcaagataaattcaacagagtttcgtccctggagactagatccttccctcaccccaacacatccacagtggtaaaggaggccaacagtttccatgatctttctctagtctaatatgaccgataaatactttccagccccaaagatcctcaaagataaagtttcttctgtgtccatttaaaagattgggtttactcctttagaagcgcctcggtttaaccaatgatgtttgtcatccaagggtccaaatacggactgaaccaccgtgtgctccttgggagaaaacctactccatgagagtggtctgaggaatgttttggcatctgaccatcagattgagaaagtaatgactggacttttaccttgatatacatttccccaaaatcagatactacaatatggtaggtgactattctagatattttaggtctacttctttcatcgtatccctaaaattctatgaatatgatgccagattatattaattaacattgttattggcatattccagctctggataaatcgtatgcttcttttcattttgaatctttattctaacacacaactgtcccaggggccagacattgaggtttagaagatgggaatttttccctggaaaaggtaaggcatgtgataaaaagtggggtgtgggttttaatttactcagcaaagcaaaacttaactacttttctttagatttaaggtttgagcctcaggtatgatgtctggaaatcactttgcatatccacaagttacttaatgtgtcattttcatacatcttagaaattaatcatgcttttaaatacagaacatatctgacatggcacagaccatattttttaactgggatttctaaagttgtgggaaacagagaaatgatgtgattttaggtatatgcttatgatttgggttgatagaaggattttttgaatcagtaggaagtctaatatataatatattttaaaagaaattaagttttattatgtttcaggttatgataactaactgcaaatgaattaatgaaatattttatgtagtaagttgtcaacaaatgtcaaatattgaatataaattgatgaaatttaaattatagataataatttgttcactcatttatatatttctcttgcatatttgcttattctattcatttatttgattaaaaatgtgtctggtcagtgaaagcaaacagcactcttctctgccttaaatgttacagattctgacagaaaaatatcttaattaatcagactttatcatgggcattcaaaggtgattgaaacaataggtgaagttcaacttgaaggtaatcacaaagggcaatttacagtgtttcttagagttgggtaggtactgtcctcttggttagattcagaaatgctgcctgtcgtttctttctgggttgaggtatctagtagccttgcctgctcttatgtgacaagcacaaattactccactgtgatgaatctcatgggatcacagaaggtagaggtgacaaggagatctatcacatcatatcaggtccaaattcccaggtgccctgtactgcatttcctctgccttccactgtatttcattttaacctgggttaaagtagcagcatcttccactgggctgtactgttcggaaatgggtggctaccatgggttgctttaggattctacagctgcctggaggggcgtggacagacaatctaagagggtgcaacagggttaaggggaaaaataggtacaaagagaaaatctaagaaaataatttctgtgaatatcaggcttaaaaattttagatatgattattactttaatacctatggaaatgttgggggaactataaatgttatttattttacttcttttactatttactaccaacctgtttgttatggggggatgtcatttgtattttgatctttgaagttggttggttattgtcattgttttaaattctccaagtatgtccacctctccctagtttgccacgctgcctgcccagctttttacgtgcctgggaccaaaacatttcagcgcacctctgacaatgattcctttagaggaagaggagtgttcaaaacatctgtgggacactgccccattcagtcatgagtagagaactttgaagccccctttagtgattatatccttggggtctcctgctgagcagtgtcactgtgctcattggctctcaatgaaggaattctctcttacgtctcctcttctccatggtagcctattgattttccccagtagaggactctgctgtggtcatattcagtgatgtggtacaaccaaggtaacctatccagagggctatcaatcagtgatattgattgggtggctgccacagggtctttgactgatgctagttggaagtgtagctctgagtgactttaaatgttctgtatgttgatcttggctgcattttattttcatggtctcagtacatcttgcaaattgatgccatcagtaatgatcaagaaaagagggaggagtttcctattgccattccctgaaaagaaaaattaacttagtgtctccctgcttctcttcctcctcttttttatccttccttcctccctccttccttcccattctgtctccttcttttctattcttcctttctttttcccttccctttatattaactttcttctgtgctaggtattggagtcacaaagatgaataagatatgattttttggccaggtgcggtggctcatgcctgtaatcccagcactttgggagaccgaggcaggaggacttgagtccaggagtttgagaccagcctgggcaacagaaggagaccccatctctacaaataataaataattagcagagtgtggtggtgtgtgcctgaggtcccagccactctggaggttgaggcaggaagatcacctgagcccgggaggtcaaggctgcagtgagccattattgtgtgccattgtactccagcctgggtgacagagtgagaccctgtctcagaaaaagtaaaccaaaccaaaacaaaaacaagatgtactcttttgaccttaatgaattcttacttggtatgggggtagtatgaaattcagggaatgacattgaaaacaatcatattcataatctcaattaaattctgcagttaggtacagggcacttccctatgccaatgcactttggacaaaatatgaatgaggcagtgcttcaggggctaagatgcagtctgctgcttactataaaaacgttgcatataatgtatgtcctgatactcaaattattaacgaaaagaatagatgcaaaatttagaatttctagaatgataattgtgtataagaaaatgaaatacccagctcatatttctgaatttaaaaaattatttatgtttcccagaacaatattttccctaagacccaaggtaaccatctatttttcagctttccaaaagataggtccacttctaccaagctgtgtgttagatgtgagattttccaaggatatttacacttatttggcagggtgcctcgtgagcggctttgatttgaaatgtggtttcaaccacttcctaaatttatacacaactcacaaagaatgaaaattttggttgtggaagtccataaatgctgtttataaaacatgggcaccctgtcagatactcagtggtatacctcttaaatactgttgattattaagcttttatggagcacttttatattgctagagtaatcatttttattggcttttcttgacaacagcccaatgtcatttgataatatttttctttctatttttatattccaagaatagggacaaagtaaatggatattctggccacaaatacagccagtgacaaaatgaggatcaaactgattgaactctaaatcctcaccttaactgtagccctacagttctttctctctattaaggtgttatgttttgtctcagtttctgcattttcttttttatcttagctgttgttgtgatctgatgcttttgggaaataccaaccaggaccttactaggatattctctgtcctacctgccttgtaatataatgcagggaaaagatctttgaactgaaataaagagaccagggttctagtctcagtatttctaccaaccagattttaggcaagttattgcttctctggacctcattcatctcatccttaggaaaagggactacgatagttggtttttaaggttttctttcaagagttaacatataaaagtctaataataggtagcacttaatgagcatttattaactgccaggtcctgtgctgagtgctatgtggggattgttccatttaatcatcataaccactctgtggtagtaatgtagtagtgtaattttcccttccctttttacaaggagaaatcttagctttagggagactatgggacttaatcattgttgacagctagcaatgttgaaccagaagccaaaccctgagagtctgagaggtcacatgctgaaccctgacacttatccaagtgctattctggaagaaacaaagaggagaggaatgtctaaggaccccaacaatgtgttataatataagaacatctctcttctttggataattggatattccagactcttgtctgggaattattagggatagcatttacagatgggtgtctagtaactactataattcctgatcataattccctcacagccctatcaccccagaattattagggatattaaactgtttctgagtcttagattcttatttcaaaaatgctccaagtactgttttattagacctgagagagctataaagatcagctgaaaatgattgttcttaacagatgtattactgactccatcaaatacatcagttatgccaggaggatctgaaaactagaaatggaaattttcatatctcaatcagatgaaagtcattttatttattgtaggcaattgctaccctaagtttagcttatcagaatcagtatcttttttatattcttgcttaggtctacccccctttggcaagtgcatttccaaaggatctggtacctttataactaaaatattaaagaacttaatagaagagacaaattaaagagcaatcattaactcttttttgagacagagtctcgctctgttgctcaggctggagtacagtggcatgatctcagctcactgtaacctctgactcctgggttctagtgattctcctgcctcaacctccctagtggctgggattacaggcacctgccaccatgcctggctaatttttgtatttttagtaaagacggggttttaccatgttggtcaggctggtctcaaactcctgacctcaggtgatccgcctgcttcagcctcgctgggattacaggtgtgagccactgcgcctggcccttttattaactctttagttaaaaaagtaagcagacaaaagacaagatgaaggaatgtgttgtggagtcacatgactcatattgttgaggccattcattcattctttcatagcttttattaaattgttactgtcacctcataaaagaatctggaaaacagacatgttcttcccccaattttaaagttgtgaaactacatttggaactaaaaattaatatttcttaaaatatagactattattcagatattaacacacattcataaaatatttttcttttttctctacatacatgtgcgcgcgtgcgcgcgcgcgcgcacacacacacacacacacacacacacacacacacacacgacaatcttgcaatggtagaccaaggaggcatctttgaagtgtgggacatatggcttcttagccaaccatcctcacttttccatagtcccttattttcttaactattagataatgggcttaagggatggggttgatagtagagaagtttagatagaggggcaaagaatctagaagagtcaattctaagaaagtttattattagactagaggcccagaagacagcaagaatatctcagtagaggtttctaatcccgtcttacacttgagattgaatataaagagttgaaaatgatgttttctgatatgactggacttctgattcataatcctcctaaccctgtctctggatggaaaactatagctataatagctacagtggctatagcctatagacagccataatttgctatcaatagtttcatttccatcttacacttaattcaatatcagtgtatttttatatgcttttatttcattaaagtaattaaacagcttcaagggttaataaaaccttggatgcttatgtagagcaatggatacatctgatagacatctgataagctttttaaaattttgtcggtagactgtcattaaaacataaagtattatatggataagctaatacaaatctcttccaattcttttttttaaaactctacattcacagtcgttggatatttgaccaatagtgaaattaactaacaggcctaagtatttgaaatgggctattgaacgtcccgagaaaaggtggtatggaagatatacaagttagatgtgattactcagcaatcctcacacttatttgtaatcaccaaatcacaaattagaggattatgagaattaaaatatttcagtttgatcatctcacaccattctacttggaagggaaattgtagttcttaagatatcttcaggggaagaaagtattctaggaaggctttttgcctttctttgtaaaacatgttcaacataaatattctatcctggtggcacatatacagtgaaataacttttgaaggcttttttttcccctgttttattttgtttttccagtatgagttagtagaatcttttggaatttggaatagaaaccagaagccatttacttaaaatggtcccttcttactggtgcatgatgaatgtgtgtgtctctcagataaagtggagatgaacatttctatagccttgaaaaaaatgttctcttccctggtgtatgacaaagtgaaggatataatttagatatgtttaagcactgtatccatgcctgtagtatacccttctgccaatttccaagcacatatgtatacacacacattcaatatgtagggaaagggctgcccaagagttcagactgtagggaaaatctggaagaacggtaagttccacattttcttcacccttcagcccaaaaagaagtagagaatggctccaggaacaccctttgtctctctgagggtgtgtgtgaagagtaatggtcgtttctcggctgctcatgtaatcaggatatgtttgtgaacctacagtgggttgaggagagttaagagttgggattaaagctatctacgatgaaatttatagtgcctaagaactaaaaccctggtttggctaattaggggaacattatccaggaagagttcttggtgtagaggttgcctcatctgaatcttaaaggataaaatttatccaatgaaaagagacgtcatttatttaaaaacttgagacaccacctttcattcaagttaacacacatgtataaataaattgattcaggtcataattctgcagcagctttttaaccttcagtggaaaaagtagcttcatgtctgtgttgtttattgttgcttttcctgcatctgtgacaatactttgaatgaataatattatgccttagagaaaatcctaaactgacccaggaaaatgaatacagaagctcattggaaagtttagtgttactcaggcctgtaagtcatccctgaggttgccagaattcaaaccatttagggcttcatagaccagtgtgagcattttgcattatattcagaaacatattgagaactagaggaagtcaaggctgctccctactgaaagcaggtgattaatttcactccagccacatgaatgacctgtgggtggcccttgctagtgtgtgacagaaacacccagggaagaaatgatttgccaggttccttggcttcctttcctcatctgacacaattaagtaatctttgcaaggtgtgtaagagtctattgaacctgctgttgctccactgtagggtgaattgttattgtgttcccaaaccaacagtgttgggacacagaccagtaaacaggctttcccattccttaatgcaaacataatttgtgtacagcctgtgagctattcagattacagaccatgagggacattgcagtgggaggctgaaaggattcttccctacacaaaaactgcaacttaaagtcaccctcatgtatttggtaaaaagacagaatgtgccccactttgtgaaattctattccagtttaaagggctaagaaagcgcagagttcagtaatgtggcttcagtgttctccccattggtgtaatcaaatccttttagaaggaaaaccagcggtggaagattttttttatttcctccttcctcttcctttgatattggtggtttaattataatagattcataagagaacctggcccctattggaagatatgttagttttctttttcttgccaccaaggtgtaaaccattcattatgattttatcagatatctgcagcggcatgctggtaaactggctctccaaaaaataaaacaaaactctaacagcctttatttgtagtttttgccaatttctatggtataaatactcccatcctagctgatttcaggctaccaatgtgtaatctccaaataagcagttgggaagaagtgctaatatcttgctgtcagcagccaatgttagtcagctccagcataccccagatcattatattttagcaatttgattaattttattttgataattctaaaatactaagaatagtaattatcaacttccaaataatgtatcagtgtagaagcatataaatatacatttgtaaaaccacatagttatgtacatatatatgtgatggcatgagaagtactttcaacattcgcagtcatttctgttgagcattgtacacttgctaaaggttaaggaagaaaagtaaagtttagaattggtattcttgtattcaattagaaaagcaattgctactgaaggaatttgtacattgtcctcaaaatttgatctgagctgtatctttttaatgcattgaaaggcttttcatctttttttaaaggaaagtgcataatttattatatttatgaggttataataaaatggatacttaggaactttaaacatgagttaaaagtaatcatcagatataaaattctcaaatcttggaacccaaaatactaaattttagaattttcttaaaacctctttctcatgattaacttagtttgaaaattattatgttctttcataagaaaagaaggaaaatttaaaaatagacatgttgatggaggcaatagttcttctcagctggtttttcggagatgatttcagggttcagattgatttgcaaccatttaacatttaatgcagaggaagagttgactatttccttccctcatactaatttttagtgagaaagatgcttttcgtgctaggaggaacattgtgaaacaatgtcttcacagaggtagaatcagatgagtaagtaattgctgaaggcagacattttcaaaattgttagcctaggcactatttgctcaaatgagtttaaaatatatacactaaaccccaaagcagagaagctttggttgagaatgataggggaaagtggagatgactgaagatgtcctgaaatcccccctcttttttttttttttgcatctatccctaccctctaggtagatcatttctgagccttgaagtacagtttgaaaaatgcaaatttcagaaatttctcagctacttattgtctacatgtggacagcaacaaaagagtcaatgccaatcgatctcatttactgtaagctgatcttcacaatgagtatggataactgcacccatattgatgatatagtagattttgtgtattacttataaggtcaacagaaaattgattcatattacagtcctattgtgtagtcgcagataggactggtgtgagtaacttctaaacatggctttaggcaactaaccactgttccatttaattttagttccactggtattaaaaccatgcagaatttattttctaaatgatattttacaaatcataatcccaaagaaaatttattttctagaatcctcaatcaatgaactttgagttgtgttgctggagcctggagttccatggagcagcatctcagcagtagtttctgggaactgcggttgttttgcagaggccaggttaacaaggattgggttcctaggattggggtcctatctcgcaatcccctacacctctaccaaactatttcgtgatcttggttaaactttgatttgacattttaactaataataattaaaaattactgttttaaacttaagaccaaattcaaaaggtcttcaatcttggcaagattaaaactcaacataattcaaaactcatcttttcaggcaggcatccaatctgtacttagcttgaattgtttattttacaaacagatactgctcaaattctaaaatttgacttgtagtataaaccataaaaaaatggaatttgagtgactcacccagggttactaacgaaatttttttattatttatttatttatttatttatgtttgagatggagtctcactctatcacccagactggagtgcagtggtgcaatcttggctcaccgcaacctccgcctcccgggttcaaccgattatcctgcctcagcctcccgagtagctgggattacaggagtgtgccaccatgcccagctaattttttggatttttggtagagatgaggtttcgccatgttggtttcaccaggtctcaagctcctggcctcaagtgatccacccacctcggcctcccaaagtgctgggattgtaggcataagccactgcccctggcctcaaattattaaaattattatatccatgggtactttaacttaaaaaataggctaataatgcagtaatattttttagttatactccagtgtcaacataattgtataaataatgcattccttctgatgggatactatttaaaaaactctatctatacaattttggaatatccacaaaaataagatttctagaaggttaaaggccgaaatcagtctcaaaaattctaaaaaatctgtcgcctttctttctcccactccttagccctagtggacgatagctgtttgtgcctctgttgaagcacgtgccccaaaaggaaacatgcctgggcaatggggccaattcttatttaactccgcggactgacatcctaaatgcctcttcagtgattaacatcacaacgtgacacaattcagctgggtaaaagggataggtcccataatgccatgctcactccttataaattcaagtagactacttgaaaaaccactcatacaaagctatgaatttatacctgtccatatcaatgccccacaaaaaacctcccaatgcttgcctactttttgcaatctgaatacaatctaacttacttccgcagcctaggaggcctcatatgatctcacgtcttagctttctgatcagatgtccttctgctcagcccttcttccccattctccagccctaatagctttcttaaggtctcttgaatgtatacagcttgctcctgtcccagggcctttacacttgctttctcccttgagcttcccatggtcacctcttagccctggcctcttggcactcaggtctccatttgaatgtcccttactcagacaagtcttccctgaccatttgggcagaacagcactgcactacccctaccaatgccaacagttacatcacattacccagtttattttctccgtagcattcttagtgcctaaaacgactgtgtttatctgtgtcgtcctcagtttctctccctctcagtagacttttcatttcttgaaggctgcatggtagccccagtgctcagaatagagcacagcacatagaaggctctcaatagacatcctctgactggccaataatatggattgcacctatggagagatttcttttcataaacagcttgaaagggaaagaaccatttaattttttaaatttgaagccccacaagaaaagctaagagtttttcaggcaagtgtccatctttattgcttgcagcccagttctttggaattttatacatcagcaacttcttttccatgacccatttctaaatatttcctaggcacccagacactctgagtctgaatgaggatatttgattgagaaggaaaattggtcagaatgtgaaaaaggaaggtgggcccttaggaggaacaaggtggggatgtggatagagattctttacttcctatagagaaaagggagagtaggagggaagaataatggggtagaaaatggagaaaaaagtgggaggaaaaaaagcagaagaggaccagaaatcgatcaggggaggcagaaagaataagcaagggcaaagtggagaaagaatagatggtagaaaagagaaagaaggaataataggcgagaaagcaagaggtgtgggagaagcagggctggaggggcgctgaagagcaggggaaggcactgactgagctgagtaccaagagacagccgtggttttcttgtagctctgtttctgacaagctctctggccatggccaaggccaatttaccttccttgctggtaaaagatggttttatgggatcttccagcactagcgctctctgttcttggcttcacaaacagcaggccctaaagggttccttgacaaatggattttctgtctttgagcagatctaagtggcagatggggcacagctcccctaggagagacccccccgccaccccctgcccaccattgtctgagcccttctgcagcatcagtccccagccagcgctgcctcaacaaaccaagagacattgtctctgcttgcttccagacaggaaaagaaaaggattgagtttcataatctcacaattttaaatgtaggcctatttccataagaagtttcagattacaaggcatgtttcagaaacatttttttactttgaacacctcataaagagacagtcttggaactggacagtcctgggttcaacctcaggttcctcactgcatggttttaatgatttgtataaccttcagtgtcttcatctataagatagagattaaaatgttacccttaaacagttgtgatgaggatttaatgaggtaacatatttaaagaaccaggtatagagtaggtcctcaattattatcattttgcctaagttttcttctgataatctgaaataatcacttttgatcctcatactctcctctccccatatgaagatcctctgggcaaatcttttttttttttttctttctttcttttttttttttttttgagacggagtctccctctgtcgcccaggctggagtgcagtggtgcaatctcagctcactgcaagctccgtctcccaggttcacgccattctcctgcctcagcctcctgagtagctgggactacaggcacccgccaccatgcccggctaactttttgtatttttagtagagatggggtttcaccatgttagctaggatggtctcaatctcctgacctcatgatccacccgcctcggcctcccaaaatcctgggattacaggcatgagccactgcgcctggccccctctgggcaaatcttaaaattgaagatggtaaaagcatggataatctgtcatcttcctacaggtaaaatagtggaagaaattacttcatccagcaaataaagagaacaatggtttcttggtgacccaaagtaaagtatttcagagtactattttgtattcgaagtaatacaaaagacaaatatattattcagtggatactgcaacaatagacagaattgcaacaaacatgaatttagccaaatctcttgcttggaggcctgcagtggaggagaaatatcagagcgatcttggaatcggacctatctatgtttgaatcaaaggtccagtccctaaccagctctatgccattaattcagcgtcagctttgtcattgtgaaataaaatatcctcattgctgaacttggtggttgtcggtattaaatagatcatgtgtaaaaggtgtctattatggtattttattgaacacacagtaagtgcctaatagaaagtcaccattgttcctgttcctttcagctgaagctattggggaactttctttttctttggtactacacctgattttatgaaggaaattaacgtgcaaataggacatgatttatggccagcaagagagacacataatgatttgcagtctcttttgggagtcagagtctattctatttggcctaccttgtagctcagcaacattaccaagtccttacattatcagtaatgattgagcctggaagtcagccaaggttaccaggtagtgatgttagggttaatttgggcttcatgtaatttgtccctcagaaactgcaatctagggattcaatagaaaaggttgggataccttaagggaaatagctaacacactctttccaggtagataccagctataacttgtcacatcttgtatttcaatcctacagtcttagacctaaaaggaaacttaaaaattgcctaagcctgggaactggatgggcttcaggagggttctttcatctcctaagattatttgcaacatgttatactgtgtgtgcatacggatgatattcttggcaaaatgaccttgtctttcatcagatactctactgggaccactgcgcaaaaatattatgatgcactatgcttgaacaatctccaggagaagttgtgtgtgcctgtgttttaatgaacgatgaagcatgttctgggattcagttgcatggtctggccatggtcccacaatgagttagcatcagaatagaggagataaacccagatatcgcaaggactgtattctactgtcattcaattaatttgtacttattaatacgtataatttccacactacacaggcattgtgagggatgtagattataaaagtgaatatctgttgtcatggaagttacagtctggatggggagaaaagtaaggctcttaaaagaaaacagaaacaaaaaagactcagtaccagtatagaacaaaataagtctgtgactgcttgcaaactgcagtctgtagttgtggcaaaggaattcagagaccacgatagtgggtagggtctgaagaaaagaaatgagcattatgatgaagcattggtgaggataccggccttagtagtttgtgccagtgaggagaaggtagggtatgttggaccttgaagtggtcggaagttttcagtcttggtccaacagcaaatagagggtggttaaagtttttacttcaccatattatttttgctcccagaatgactctgatgtctctatgaagtgtacacaaagcacaatccacacttatgaattcagttcaaagatattaatattatttcagcatacctgttaaagtgacttaacaatctacttgtagactgagtttttggtcatattcgaaggaccaaaaaatcaaaattgatttaggattaacttcaaaataggacccaatcacaatagttgttcctattgcactgctatgcagtttgcctggggtcatttcttcctggagagtgacgcctgacacgcctgccttccactcagcctccacagctgggaacagaattacactggtgccctctgctgggatgaaatgggaagttgatcaggaaacaatggtgtcctcgtcttttcaacatagagatggaggtggcgattccaggcccactgcagcctccaggctggattcatttagtgttctctccaggcctccctctcaggtgtcttctttgcatcatacctgaatttattaaccaaagggagtaattggatttttattgtaagaaggttgtcagctaatttttaaaagtagtccaaggaaatgctgccccctttcctctgacaatttgagagctgggccctggtttcaacacacagggctagtcatcttgggtggtggcttggccgtcttgctagagaacaatacatattaagagccacggggagactctgggaccatttaaaaaaatcctgttaaattattattattattattatttattttaacggtgaggaaagcacattgatattcattgctgattttcttggctcaaataaacagcattaatgctatggtgttaaattcaatttagagtgtctactctggtgtgcctttggtaccctgctcagctgatttttctgctagaggtgaaaaaacattcagttgtaattaagaaaggggtgggggagtgctgagaaggaaaccgaaagagagaagagttgtgaagtctcatgtgtgcaaattggtaatggacttctaaaataaaatgatgggggctggggcggggcggggcaggggagaggatggattgaaatgatcctttcctgctccccacttttattttattttattttgtttaggatcaataatttggacatggaggtctgctgctggtttccataacaacctggcttattgaaaaactgcaggctccacgaatccccaattatcagccttccagggcttattaatggagttgagcatcccagtgaggcaggcagctcattgctggcacgtgcccggtgggctggcggagggtggaggagatgggaagaggagatgtgtggtgagacagcagccatttgtccccgtcacttgcaggggaggggggagcagtcattcaggaggctgtgagagcgtctcttgaaaccctgagtggctgccgctgctgttacaggcagcccagaaatcgaagcatagcttgtttttccagctccaccccgaagccatctatctggaataaatccttatgaatatatcacaagccctgtatgtctattgagcttctataattaatcgggctttcctcacaaagacaatggtgactctatatttctaatattaactcaagccttaattaaaatgtgaagccaacctaatgcatatttgatagctttgaattactcagtctttggtctggcttcacttattaggccctcgccatagaataattacaatagcaacaataataccgatgatgatcaaaatacagataacatttacttatcttgtgccaggctttctgctaaaagctccacatggagtttcttgtttaagcttcacaatgatcctatgatgagggatatcactgtcccttttttacaaatgaggaaacagaagcaagagaacttaaatgacttatcttaggccacagggctagtgagtatatcagagtctcatttctgctccctttccataattattttttatttttcaacatgcgtatcctcaagatagaaaaggaacagcacatttacagtaaattttgtgctatccagtgttaattggggaatgaaacattctggtttatcaaatattttgattaataattgctattcatgtcatgattgggtttccaatgggaaagatctgggatataataaaacatacacaacattagaagtatagtaatcattgtcataaaatgcttcaggatcattatacaaatgcgaatttttattgtagtgcagaagtgttagttgataaagacttctgtttgacaaaatgccagttgaactgtttttatagcatggaaatatcagtgccttaacacttttgaatattgtagatttcaaagtgctttacataaactaccacagaagttcaatgtgatcagaaaagaaaaattttaggatctttcagagttaaagaatattagtgcttggaaaaccttaaatgcattaaatactctggatccttagactatgctttttaaaactggaaccttagactaactgggaaatggaatgtgacacacccttgaggtggttcaatgcaagtctgtcatcaagcactgttaaaatagatcaacatttccagaaatttcatcacagttgctcaaataacatttattattagtttagtctccagaagtgaaaatagaacttgtttccaaggaccccaactttttaagaattaagagaagtgacaatatggattgtttgttttatttaatacttagtgagcatataatctaagcattttacatgtgtcatccatacacagcaaccctatgaggtaagaactcccccgtttatagatggagaaatcaaagtacagagaacacataacatgcctgaggtatcacatttgggaaacacattcaaagtcaggcagtctagctcctgagtctgtgttctcaaccagagttgtctatactctctccaatttgtttcttcctattctgcgtttaatccacaacaatcacatctacctcctacccactccccaaactccccatccagtgaaacaactttagccaaactcacaaacgacctccacatcgccaaaacccaatggccaattctaaggcctcatcttcttttacctattaacagcatcgcagagttgatcactttctactctttgaaacactttcatgattgctcttccaggatgttgcctattctgattatttttgccaacctactggctagtcccattcagtttcatttgcccttccttctttatttccctgatttgaaatgttgagttaccccacagctaagttcttggatgtcttctcctcttttctcttctacattctctctctctctctttttttatttacatttatgactttggtgatctctctgagctcatctatagcccggacctctctccccactccagacaattgcttactctacatctcaacttggatatctaatagatacctcaaattaaatctcttgaaaaccaaacttctgtcttttttttctgaacttactccttctcccgtctttctcatctcaggaaatgacaagtccatcatttcctgatacttaggccatatgccttaaaattattcctttttttcttttcctttgacaacattaaatctatgagcaagtcttattggctccaccttcaacatatatccagaatctcagcacatctcactttttctagcacccatctcacttcagcaaaagtcaagtccttaaagtggcctcaaagctccatgttctcagcatatccactaggtcaccacttggatttcctctcctgttactctccatttcttggtcctttctagcaatactgatttccttgctgccccccaccgccccccccccccacaaacaggtatgctcatatgcagggaatttgcaacttactgttccctctgcctcaaaacctccctcctctagaaatttatagagttcactctctaaccatcttcagctctccgttcagatatcaccttctcaaagcaactttctcttcgtttaatattgtcaccccaacctcatcccagcatttccccttctctttcccagttttgttattttcagtaatttttgtttgttggttagttttgtttgtttgtttgattttagacagagtcccaccattgttgcccaggctagagtgtagtggtgcaatctcggctcactgcaacctccacctcctgggttcaagtgattctcctgccttagcctcctgagtagcaggcactacaggcgcccaccacacccggctaaattttgtaattttgtatttttgtatttagatggggctccaccatattggtcaggatggtctcaaactcctgacctcaagtgatccacccacctcggcctcccaaagtgctgggattacaggcatgagccaccacacccagccaattttgttattttcatggtgcttactgccttctaatatattatacattacatttatttatttataataataatataaacttcatgaagacagggtattttttgttttattattatttcgtacactgtggtattctcagcaactggaacaagcagtaaatgctcaataaatatcaattcattcaatgagtgaagaagataccaagcacatgtattaaacaggcagttctaaaggaacttcctctccgccacctaagcacatgtttcctcaccgtcctttgtccctgtacattctttggtgactcatagagttctcacatgtaatgccatcctcctaatgaccggaagatgatggccgctggacagcaactataactgggttgtgtctgtggcatcagggcactggccccttgttttagcctcactgcttcacaagccctccttacatggagtccatgccacagggaggaaattgtttcatctttcaatgcaaaggatatagctctaaaagcagagaaccattttagcaaattcaaaaccactgggaattctgcccagactggaaatagatggcaaaacacacttttgcttagaagtgagctgcctttctttcatgttgaatcatcaaatcaaagtcatagaaactttaatgtctaacaaagagtctctggcagattaaaattttccacttataaattatagttaactcagcatttagctattagtaacccttttgtagtatgttaaatttgcttacatattgattataactcaatgtgattggaacgttttcccatgcgggagcatttcttcaaaggaaccactgcataaaaattcacagagtacatgtgcgcgtgtgtgtgtgtgtgtgtgtgtgtgtataaaatatataacatgtatataaaatatatattatatattatataaaatatatattatatataatatataaaatatgtattatatataatatataaaatatataatatatattatatataatatatataatatatattatatataatatataaaatatattaaataatatatatattaaatatatattatatattatataaaatatataatatataatatatataaaatatatataatatataatatatataaaatatatattatatataaatataataatatatatattatatataaaatatatataatatatatatataaaaccagttctgtcggtcatgatcagagtccaaggattaagtctcatatcatctattagctttgcacaattagaaaatagttttgtgactcagattactccaataaaaccagtaggtcttctcttaagattctaactgtggttggtaagaataaatgcagaacactgtgagacaaacaaatctaattcatacagctgtagacaatctttggtgagaaaaggctgcttatgtctgtggggctatgtttgtatgtggtggaacttggaaagtggagtggaaaagtgtgggtagaggatggaaatgagcacatacttaggtgacaagagagatgagggtgtgggggtgtcagtgctacctgaaaaatcccaatcccaaaggaaagtgggaagggaccagggtgacagcaagcaactataaaactttaaaatctatggaccagaacccctgataataggaatctgtttataagttagataacaaaatatggttgtacatataatgacttggccctaaactggtaatccttcatttcttactcatagcctcagcattcccaccaccatcctccattgttggaacagctgcccaacccttacgtatgacaacagaaaatgggaggagcaggaaggcaggacacctaaggcataaagggctgtgtttcatctttactgctgattccttgtaaaagcggcagccattctcgtggattggaattccctgcttctgatcttatgtggacaattgttgattgtgtctgtctaccatggaaagatttggtttactgaggaagtactttggcattggcaggaggttgatgagaatacaatcattctacctccgctattcatcttgagcatcctgcatcctgacacctgctgagtaagacagatttgtaccttgtcaccacatgtgtgaagtgcacgtgagaaacagtaacagggttaatgccactctcttacaaagagaattttgttttcacttgttctctcccatattgctctaacaccctctgtgccatcgttcccaaccttccttcctcttcccccaccactacgcacccacccagatctcctgagagtcgttactactcagcccatcagccaaagttagtgggtttccatggtaaccaggcagctggtgtctagacactctgagagagatgccttgcaattgagctgcaaatctagcttctatcaaacaccccctctcttccctcctcctctttcctcccatttcctttttatttacagcaggcattaataccaacactgaatggagtttccttttgacaggccattaaaggaagagggggatgagagagggtgaaaacccccaacttgctgtcttgtcatatcagtgcagtgagaagacaaccgaggtgacagactctgatctggtttgctctttcttctttaagaaggattttatttaattaaaatattttaaattaggaaacagtgccactagtctattgggagtcatatgcatctttaagagccagtaaaagcattttcaggatagagcttgagctgatggcactgggttgaggtaaaatttttttcacagtgtctgggcaatcaatgtaatttctctttctatgatgctcaggggaattacatgcctgtagtattactagacaggaaactatgcagtgggatacaggcaagtataagaaagggccttaaatgacacctcagatctggaaaagtcaagtttaactgttccttatttgtctcaagaaagagaaaagcagcttctgacagccaggagctggcctggagctcacaagttagccttagtgttctgttaatataaacaactttgcagaacaccaacatcagacaagggcactttgtgtgatggatcaggacaaaacaagaccaccataataatcatgtctgaacgcagactaaatatgcacattgtccaaaccataaaatgtctgaatatttcctcagcctggccaatatgaataatgatgcttactttattcctccctcttcctagatgatatttattgagatgcctaaaaataaaattacgcctgttttgtgacagcattccaatccagagcaaagttctgtttccctaaaaccacctccaaatcacctaacacctgcccaaataaagccctttctagtcccttcttgtgagacacctcatgattctccatagcatagagtcttcctagctgtaacatgtaaataaacccacctttgctcaactatatgtgtgttccttttagtcttggctgtaagtggttgatgctccatagaatttctctctatattattatgtacactgaagttaacttcagtgaaaaagtctttttcttattttctcccacatctaaatattttctatgccatctttaccccaaatttattgctacactttcctgaattcactaattctccctctgaaatctcataaaaacctaatgtaggaaacaaaattaactctattttttctatctgtagtattttcacatttttgatctcagtaattacacaggatgcctcagggcacagatgagtttataattatctttactactcattgagaaatttattacctgaattagcagtgatgacaaggacatgtagatcagactgacagcagacatcaaacatgacccagtcaaatgacagtaagactatgacaaaatgtttaaatttagtacactttcccttaaatcccaaggaaagctatgttccctgtttcagactaaagggtgtcagataatttgttggggcagcaaccatctcctctcccgttcatattatgatctgtcagctttaagtgactattttagctaccactatccacaacagagaagaagtttggaagaggtctaccttgggaacagaatgatatgttaagatatgactctattcgttctgatattagtatcttctctgccaccccctgaaatgccagtttggtgtactgtcatatatcctctgagcccctctgtgagatcactcaccactcaccatctctctttcaggtgagttctgtacctggctgtggaatcagtatcattgttattccgggggtagggtcatttaaagagccctacacacaattggctcaccaccaagtcaaatggtacccaccaataattggtttcttacttgggaacagttccattaactagacttctgcttggtttacattacctacattcctatcttatctcttttagattctggtttctccaagactaaggcctagccttattctcatctattctcttggagatggtaatcttgttcttggacctataattaggaggctgtattgttggctgacagatttccccaaatgtccatggttgatttacattggacttttttagttgctgtgttctaccaacctccaatgtttgtttactacttctgctgttgaccttctattttactgtttcccataatcataagcctcagacattccaccccgccaacctgtccttcctcccattggctattactggttccatgcccaaattgtagtagtattgctagattcaattctctttgagtctgatatatttaacatcaattgtattagtacagttcctatttttaaatcttttctttccatttcttggcctcagttagagagatgtgcttctgagaaagaagaatcaacagatacaggtgcatttgggagagagggttttaaatttgaatcactgagagaatgttaaggccaatctggttacacttgtagagataatggtcaggtgatgtctcagataaagacataggattggagccaggaatggagtcaagattgtacttacttgggaagtaagaatttggaatttaagaatttaagaagttggaagtagaacttggaatttgatggatatgaacaaggagttaagatttcatgataaagaaagtaatatgcttacagtgatctttaaggattaatgataagacagtggtaatataaatcaggtggttacctggatagaggtcaggattgaagtcattagagggaatgagttttctgatacagagtctacaaggataatattgacttgaatcttggattgaggtcatgttaggggacagaaagaaaaaaactagacccagaatggcaaaagaaaagctagaaaacagcagaaataaatccagaatatactgctcattgaagctaagaaaaaggaatattttaagaaggtgtcaaagccaaaatgcaccaacagttaaggagatgattttacttaatctgttgcaagagactccagatctcaagatcatgtcttggcagggtggttttccattagacttttataggaaggagtagacaagttataggtcaggtaattttgtgttgttttgcaatcaggggaagtccagtcaactaaacaggatttgtttctctgtgtgtgtagctcctttcaaaggaaaaaattctaatctcagctaaacatccatgagacaaagaatggaaagttaagagtatctgtatctatttttgtcagcagtttcaggcaaaaggggaaaggtctatatttgcccttgttacaggtaaagaaggggatcatctctgagtcttacgggagtcctgagaaagagttgacgcaagtcatatggagaagagtgttcttcaaggttagccatttcctggagtacaaaaagatgtgggagatttaagaaagcaaaaggctaaggaactttcctaattgttgatgttttctggagtacagtgctcaggtaaaggtcaacagtcaaaataaagagtacttaaggaaagataaagaacaatggtaaatgagaaaaggccttaggattgggaatatgtatatttatgaaatcaaggagaacactgttattaaaaacagtaaagctaaaattcagttcacagagaaataaggaaggtgaggaaaagatggcacaattccagtttattttttagtgaagttttatgattgaagaggaaaataagatgtttgtaactttatgaggaaagaggctatttttgcctttttgaagggctatcatgtgccagagaatatatttgagatatatttgttctgtgttattccagaagacagaactccatagaaacttagagggagtagatttcagctgagtatctggaataatttacagaagagctggaatgcctgttaaagtagaggctgtccctctgcctggggtatcataggggattcctgcattaggtggggaaatgctagaggatctccacagcctctttctactctgaagtttctgtatgtattctgattgctttcaaataaataggattttgaaataaggtagataataaataggaggcagttttagatgtaaagtatgtcttggaaaatggctttattggagagaaaaaaacactgggttcagaaaagtgaggcatgatttttcaaatggctgtattatatgataggcagagcgtacatgactctatagtgctatcctctaaaaacacggactctccgtgactctttgttctttaactgtttattgttatagtgttcccaaatagtcaaatctataacattctttgccactaaaaataagtaaacagcttggagatctttgactaaaaaataaaaaatcagtacaaatactaatatcactttttcaatatagttctggttgtgttccagtgagtgctattgattcctaaagtgattttttactcaaaagcagcaccataatttgacaggccccaggaagccaaggcacacaatgactgcaaaatgagttgtcccagtaagagatggagattgcatttatttacacacatgcaagtatataatgcaaggcttttttgttataacaatattttaaaaattaactcccaaactgagttaaatcttcacagttggctttttaacattctgctggcactggaggtgaagggggtgatagatgggaggaattatctacacttttatttcctcttcctcaggatagtgcaacgatctcttaaattcttagatatgatagcatttgtagtaattttagctatctctggattttcattctccagtaactcttatgccattttgtctatgaagcctaccataatcaaatgctaactattcaaccttagttactaattttagaggtctccacttattttctttctgcataaaatatccacttcacctcccgcaatttgaacataacatgttagaatttgataaaacagtaatcctcagccatgattctgcaagcctccagagtatctaaaattacttttggtaggccttaaagcaaaattatattgaattaccttgcatttctcaaacaaaaatagcaatggagggaaggaagaaagaagggagagaggattggagtaatacagtacatttaggactctgggaagagatgcaagttaaaatcaagcagattttactcattccccaaggctatgaaaggcaatatgatctaatggaggatcgctgaattctaattagctgtgtgtctttggacaagtcacaaaaactcttcatctttagcttttctcatagagaataaggaactgaaatcagatcatctctaaggtctccttcagcttctgttactttgtaatttcatgaacaactacaagctgagtctgtgacggtatatacagattttgtatttttgtcctgatttatgtggcttagccatttgctttgataaaattaacaagacaactgccaagtctctagtttactttgtgctgtgtagatacagccataagggaaaattaaacaacaaagataaataattgtctggctaatctcaagtactacccaaacacatcatgccgaaccacggcaaggcatgagctgaatgaatatgactcataaatgcagtgcttttatttaaaaatttaaatgttacccaagcaatagatataaataggaaatatttttaggcagctgtagtcactattggtgtcattcttacagagctaaaattatgtctggctttagtttctttattttaaccctggtgtcagataattaaatcatttaatcaaatatcagatcatgggatttggcaaacctagatctgcttttgcttttaaaggtaaatattggaaataccaactttataataaggaatattaactcatcatatattaaaacatttaaaatcatttattgaatttttaaatggaaatcagtataactgaaagatagttggttaactttctcaaagtctggcaggcaggaattactacagtaacacttttatgattgatctcattagatgagatctagggtgacattgttgaaaataatgggtataatagaaataccaaaacataaaaaacccaaacttttgaaaaggccggtacaatgcctaagcaatcattcaatgaatatgaaaaactgagaaggaaaagctaagaaagtagattcaataaaaaattaccaacaaacatgattagcctgtttaatttttcctcacctcttaagtatggacctaaataattaacatcaaatacacgaggtataattttttgaaaattattaacttcctccaaaatgcagcaggaggaattgtagaaaatccttcgtggagggtggaggtcggtgctaacttcaatcatgtttgaacaagattccaaaagaagtatgacgtctctttgcctagaaaactttcaagagaacagccacttcctaccccattctgattccttattcttcaaagtctgctgggattccctatttgagaacgcccagaaacgagagtgttttgcataagtagaaagaagaaccccatcagcgcagtcttctcaaaggatttttccttcatcgtatgcctgtccccaaataacttcagtacttcctggaaatgagaactttctcacaaaaaagctgaaaaatctcattgcatcttaccgttttcctgaaacttaaggaatcaattattaaaaagaagtcttagggtccttttcaagtataggattccagcattatgattaaacaagggaatttttcttgaagttggatggagtgtcttaagcctgcagaattgccatcctctctgtaacttgcctattggatgcaagatttactacccagctggggggtaggctgtgacttggccttttactcattcagtatggtaaacatagtttttctacaaatgaagctagctcaaagataaggtttttgtttgtttaatcaactggctgctattctttagatgtgaaatagagaaggctgttctgctttgaaataccatcgatatcagaaaggtctttgcccttgaaggcattactgcttagtagccttgattcttgtattactgaatcatgacttctcttctttgctgcccttcaagtttggccgatggtcacctttgcctttgtgatcatttttggactttggtctctgacttcaaagccgttttcaaaaaactattctttttttcactccacaagcagaaactttacaagtcagagactcttctctttctttgtcaggatatttgaagacagtttctctttggctgtgagttatgattggataagcataagttagaagagaaaaggttgaagataactcatttattaggcattcatgtgagcaaagaagtggcattttaaaatgtttattgtcatttaatgttcatcacaaatttatgaggtagatattattattcctattttacttatgaagaaatggaaaagcagcaaagatacattttgattacctatatgtgaaacctcttggcacaatgcttggcacatagtaaacattaatcaatgttaggtcccttctagtcatattataatggccaacacttataagcgcttacttaaatatgtcatttattgatatggactttaaatgaacacatttaattgtcataacaaccccatgaggtgggtaccaatattatgaaaaattaggcagtgagaggttaagtaatttactcaaggtcatagtgtcagaagtagaatttatttatttgtttgtttgttatttatttgtttctatttgaggcaggctcttgctctgtcaccaaggctggagtgcagtggctcactgcagccttgacctcccaggctcaagtgatcctctcacctcagcctcccaagtagctgggacgacaggtacatgccaccatgcccagctaatttttttaattatttgtagaggctgagtctccctatgttgcctaggttggtcttgaactcctgggctcaagtgatcctcctacctcagcctcccaaagtgctgagattacaggcatcagccactgcactcagcctgagagacagaatttaaatgtaaacactctggctctagaatcaactctcttaactactactttgcgcatctaaaaatagttatgcttatagtagatatctatttcttactttttctttatatatgaagacttggttataaaattagaagataggtataaaattaaagttagcaaaaaaatggagaatgatgggataatgattttcatggctatgaaacagaatagcattggggttcctttttataatccaatatttttaaatttacaaacttttgctatttcctttgatcatggtaacattataggaccacaggttttcttcccgaggtaattgaggtgactttaattactttggtgacatctacatgtcacaaagcattcaagatatatatatcgggatacacacacacacacacacacacacatatatatatacacacacacacatatataccaagtatctagaaacatactttccaggcatgtttctaggtacttggtattcactggtgaacaaaataaaagaaatctctgcttttgtggagttaaaacaccaacaaatgtatacttttcttttgagaagttagtccacagtcaactgaagaagactaaaaagataccacaaactatgatataatgcaaggcatataacttccatatgagaatgaagtgatgaattctgtttagtgtaagtttggaggttgaaaatgtagttgagctgggtcataggaattataagcagtaaatccaaatgagtcaaacttgaagatttactacatccttcactgatatcattggctggtctgcctcccaactccagtttttaatttttggttaaagagctatctttggtccagatctccataatcaaagtccaagaagggaattcttgtgcatataatttattggtgcaaacttataagagagtgagagaaaagaggatagagcagaggaagataccaggcaaagacgagagttcaggggaaatgtctcagcctgatccaacagagagctctgaagcacaaactgcaccatagaggttgttttgtccaaaagcaagggtactggagtggagtcatggtaggcagaggggcatgacccctcaggaaccaggttgaggtggctcctattttctataccttacccaagtggcaggtggggctgttagcagccaacacctctggcagctgggggatgggagcatggacctggtaaagaagatctgagaggggcaccaacagcatctactacaaggaatgtaggacatctgaaaggcacgtggagagatgtagagttgtagaatatttgagtggcaagtgagggaacagatgatattgacaactggctgggttttttttttttttttttttttttgctatctctttttgctttggtgggacatttataaaatctgaaataggtattatttatttttacttcactgaaaaatcttaaatgctagtagtttaaatttagtaaaatagaaaaagcagcactgtcattcagaaccccagatttaaagttagttcttgtaggcaagtatgagactgccttttattttgattagttttgattaatgggaacctctttcattttaagtcagagtccacaaatttacatgtcttactccagacgccctgcctcctcttgcttttgcagcgagagttctttagcattttttaatgcctttaggcaaaacctgcactctccagttccccacagaccccactgccaattttacccttggccagattttcacattaatgttgtttgcctggcctcttaggcaattgagtttgcgaaggctggaggctgaaatcccagctcagattttcacctagctgggattcttctcaactgggatcctgtggagtgaaacggggagatgtagaattgaaattactgatgtgtttcttgtaaacttcttttcagagtgttaaacacatacaattaacattgacttcctagaattaaaggttagtaaattgatcgtgttctaaaacaataacataaatttgcttatttcactctaaggcctatgtcaaagaatatatgctaatgaaccaaatcataaagcactttttcattttcaaggtgatgtacaaacattgactaagtagctttttaaaatgctaatatgaaaaaaggttattactggataatcagtcatattgtaactgtcctttatagcactttaaagtctcaaatggcattcttaatttttactgcattttgcaagtatacatgaacatacatatatatatatatatatatacacacacatgagcaattgattttaatgttaattttaaacatatgttttcaagcttttccagtttatggctcgataactttttcacggcacccctaaacctctgcttattagacagttaggttcaaggagcttaataatagtatattgcacagtatccaacagatagtttctctcaaatttcaaaatatatattggcactcctgtgagttcactgtagcacccacggattcatgtgtatggtttgagaactacaatttaaagtgctgattcactataatgtgccaagcagtgtagataacttatggttaccatagaaattgaaagtttcccaaaagtttgctttctgggaaatcacattctaagtcaacctagaaaaattattcacctactctttttttttttgtctgtagatatcataggctataccttgacctagtttttactgtgaaaattgagaagtttgaactgagtgaaataagtgttaaaatcaaattttgtttggagataatttagatattttaactcaaatatttaaaacacgtttattttaaacctgattaaaactgatttatggagtttttaaagagggagaataacaaaatctttttctgattcattgatcagtataaaaaagcactgctatagttgaatatcagtgacatggttctgcttattccagtttttgttttataatttggtttagttcaaatctctgagaaatccactaaaaattgttttgaaccaaattttcaggatgtataaattgtttttattgagaccaattagctcttcaatctcttgcttgtgtccatggttagagttcatagcaaaaaattttcattatttaatgtcccttcacagtgaaaactgggtaaaaaaaatagttaataataaaattctgttaaaaatgaagcctcccaaagtgaaacttaggttttatgatttttgtccactcaaattatttaagaacatagcctattttttttccttcttttccgtttttatgtttggtaagataatgaaaccaaactatcagcttcaatgtctcagtgaatccagcctgccaaggcataaagataaagcatgtttttgggttttgaatgtcatctgccccagtctcctagaaaaatatcataccataaaggaaagattactgggctgtgagtcaggagtcctggatttcagtgctgcctttttcaattttatgaccatagtagagaaattacctaatttcttacagcttcaattttcttatcaaaaaattgggtgttaaagtatctcttacgttcctccaagctttagatttctgtggttataccatatatcaaagttcttaaataaagctataaattcttcacggtcatatgtgtgtgtgtgtgcacgtgcacgcatgtatttggaattcccctgggagaataaaatagtccttatttcaaaaagaattcaggaaattatttgacggcaaagtgctatgagccaacactgcaactgtgataatgaccacttgcaatcaatttatggcaagctcacaagaatttgaaaatgctgagagaaaagagctcctgaaactcaggtctttagaagtccatgataaagtttgggcacacgtgggatttttaagttctaaatacacacacacacacacccccccctacagaaaggaggaaaacaaaaattcctaggttgaaatgtctctaatcatcactattagttaacaacactcactatcgcattatttttctattcttgtcatggcatttctcataatttctcagtgccattggaaccatcagtgtttatctttaggctgactctgcattctacctcttccctccaacccccaaacaaactgaagcaatgcctcaatagacccacagattccactgccagctcagcatgtaatttagctgggagcagggatgagggagtgattttatttgactgtttgttatactaaagtgagaatacccttaatttcttgttttaatttttaacctttagaagttgacttattcattgtaataatggtaagaaataaagttaacatcatttaacttaatatatttacttcatcttattccaaaaattattgagggcaagtaggcaagccatgtaaattataattattgatgtttctgcatatttctagttggggaagaagagagaacactaatttttgatgatttgatagacattttttataaataatgttttaagaagttttcaaggctagtcaacttgtaccttctttggctttagttttaattttttaaaaaaatatctctgggttttttctccattcagaaaaaaacactgtcttttgttctatagactagaaatattatattctgtcctagttttataagagtagctgtctttaattaatagtcactcatatctttattttctgagtagtgctctctaattaattagtcattcatatctttgtttcctcatcagagtcagactttacagaaacattctaggggagaagatctcttaatcatctgtctgggaaagaagttttttggtgggtagtggaagaattgctttttttcctcttgagactattaaacttggcagctagaattaggttgagtgaatttctcaaatccttcatttcctgaaggttggattaaaattcagcaaatctcaaaccccataaattggattaaaatctcgacaaactacattctgcactttagattttataaagcactttcaaatacctcccttcaaactccaaacaacccacgataaggtagggcaggcattattattcatattatgtgtatattaggaaactgagacaaagaaaggaaaagcatcttctctgaagtcgtatgattagttagtggcaaagtctaggctagaataggaatcagcctggtcttaggcctaaacttgagggaaaaagtagacatgtagatggcatattgcagatatcactgagaccccatcatgctgcctctgatttttcttcttggttactctttgaaatcctttagtgtatagtgttattagcaaaaaggttattctctcttttaagtgcttggaaagtaaggaagaaatgggggcagagatgttacttgcataattctcctcacatcaaaatgaaatatactggctcagtgttttgaaaggaacttaaaatgtgaaacatggtaatgaaacaagcaaaatgtggatcacagtgaccactgaaagccatgatccaggctccagatggacatctggtatatagctaaagaaaaagactgtgtgagcaacaaaagggccatatgtgagttagctgccaaagatttttattattattattattactttcctttgagcttttgaggtgatgatgcttaatattcaagaaagatgaaaataaaaagagaggaagcaaacacccagctcattggtgattggtagagtaattgtgggcatggccccaggatgatagcagcttctatttaatcaatgttgacaaggctggggagagctgggcaggtcccaagaggtaatgttttactcggaaatccactcaacctaatttcagtaatgtagggctgtggaagggcctggactggagccagaaaacagggccattagagctcagtgtaggcaatggcagctgggaacatcgccatccctccagcagcattgcaaccaggctgcctggctgagcgcacaagcagccgctgctgcatatgctcctggtatttgctcaccaacagaatgcatcgacatgctattctcatcctttcaaggaaatgaatggaatgcataaaggcaagaactgcttccaaactctattttagcaagaatcagagagcaagtttggcatacatctttcaaggaccactgtgaaattgtccacttaatcccctgaatcctttaaggctaccattacattgttgtaaatacatgcagagataacttagatctttattgctgtcttagtgtggttttgatctttcttaggaattgtggttgtggatcaagaatatggaaactactatggtttttcctttttcaaaacttctgagattcattcaaattagtcagctttgcaaatccaagagaagtgacccaggacgaattacgctccttagggctgagtgcttcttatctagctgttctttcctttaccattctttctccaataaacaacacattattacagtaatttgctagcatataaattccaataacttagaggtttttgctttgtgttttcatggctgtgtcaccactgctatacttgcagttcgtggaacagtgtatggacatagtaagacataatttctttcactggatgaataaatgaatgaatgaaaacattttctttcttcccttttgaaggatccttgagctatcatgcatcaagaatatatgaatttactttctatgatgttaactttctctttttaagttaacacagaaatgacaaaattcatggaggctgccagtgaacgtggtggtaatctctaagctgtctttgggcttggaagagcaatgtttttgtcaaggctaaaatgccatggcatgggcaggttacagctttctatcagattctaacattatctgtccaaatgactgaatataatttttgagactaaatcgtggcacagcaagagtatttaatcaacttcattaaataatttaatcaagtttttgagcctctagcttaagcctctcatataaataaggttatttactcctgaaaatatgactatgttccatttgaaaaatttgtgtcttgaaaaaacttttttcccctaaaaggaaaaaaagcctaaactactaaaactaaatttaaaactaaaacacatcatcgatttttgtttattgtttttttttttagacacattcggttttataatagaactggatttgggggattgattttgccctggtaaagatggatttggggagaagccatcactaggtagataatagtaatagtcttaggaaattcattcaatggtcactacatagatacacgtgtgcgcgtgcacacacacacacacacacacacacatacagcccgagtgtctttggctgctataataaaataccataaactaggtggcttataaacaacagacaaatcctggtaagggccagctttctctgtaccttgctgtgtcctcacatggtagaagagactagctagttctctgttgtgtctttcataaagacactaatcccagtcatgagtccgctaccctcatgatttaaccacctcccaaagattcctactcctaatgccgtcaccttagggggttagaatttcaacatatgaattttgaaggaacacagacatttaatgcataatactgtgactcatttttgtttttcctgtaatgtcttaaacaaaataacagtactaatattaagttttaatgtttaatacaagtaaaagtactattcagaggcaaactgaaaaagaacaagcatattctacgcttcgccttgctggatttcagccgtcacactagcacttccaggctttcctcatttgccagctccaggtcattgcttctactcacttgttctatgtcacctggtgttgaaaatcacacttcaatcttctagactctatagcctcttcctaagtaataactgtctcagagggaggttgatccgctagatgaggaatgtgactatttactctaaatggaacatggtaattggagtgaccagctggccccagccattcatttgtctttgacactcaccatgatgatcaaagattttgcacaaaatactaaagattacatattaactcatctctagcatttacaaatcacataattagtgctggaaagtgccaagaccagattttatactacagaagacttatcaggattcttcccttcatttttagctgcttttaatggtacaatttttaaacgttgtaatcttcagacctacatagctgtggaccggactccctgctttagttatcactctgaacttacccattctttttgggcaaaggtaaaaccagggaaagcaactaaagtaaaatctgctgagataactctgtcctacgttggaatttacagtgtggccttacgtaaaccattcagtctccctgtgtttcagtttccccagctgtgaaatggggtgattaaggtagatgtgagaattaaatgcaatgatacaggtacacttcgcactgttctgagcacatagtaagagctcgaaaatgttaactatagctaaatactttatacaaaggaccagggaagtcacaatccataattctttccaggcagttgttttaagctgctgaatagaacaggtaagaaaatgtagatataaactaaacagtcgacattatttatcactgcaatgatttatctagggttgacatcagtgggagaataagctagcaatatcaaaatgttccctctgatattcaggcttaaatggaactatttatacaaaacttggattctgtttataataagttctgctttgtcagaggttaaaacctttcccaaactcacatgcagtctcctaccaaaagtagggctagctagagcaggtgtattgtccacatctggctattgttcccttatttggatgtagaatttttaaaaaatgttatcatgagttcttagtttatctcactttggaagctgtaatagattgtttctttacattgtttcctccatccatattttattttcctctccataatttcttggtggcctataaaactttcactgcatccattgacttgacccacttttttttctgccaactagtcatcccttcgcttaaaacaaagcaaatattttgcttaatattcaataatatcaagtaaaaaattactttaatctcagacaaatatatatatatatatatatatatatatatatatatatatatatatatatacagagagagagagagagagagagttttatatgttccagctaactgactaacatttccttttgtagccatctaatcgagcttcatcaattttaattttacgggttttattttataatttggagccaacaattttttaatctccaaagttgtatgggtcactaaaaccctatggactctagctacttagtttcagtgccgaattgctaaaatgagtttggccacctgatataatcggaaaaactgaacaaatagacctgagttttagctctggcttggtcataagcaagtcatatgatttagggaaagttcctttatgcacctagacttcagtgtcatcacctgtaaaatgaggctgtccagtcattccttcactcaagaaatatttactgaggttctttcctgaatgaggttatgtgctggacatgggattcaaggttgagctgaagtaggtactgctgttacccttgaagagtttatggtttagtgactggatgatcttaaagggtccactcatttctaacattctatatttataaattttattgtctttttttttttttttgacagagtttcacttttgtcccccaggccggagtgcaatggcaggatctctgctcactgtaacctccgcctcccaggttcaagtgattttcctgcttcagcctccctagtagctgggattataggcacatgccactatgcccagctacttttatatttttagtagcgacggggtttcaccattttggccaagctggtcccgaactcctgacctcaggtgatccacccatctcagcctcccaaagtgctgggattacaggtgtgagccaccgcacccagcctgaattttattgtcttttaaaggtatattatgaaaggctttaaggagagcaaggattttgcttttttttttttttttctcagtacctagaagaatgcctggcacagtgcaggtgtccagtaacaacttattgaacaaataaattaataaatatttacatttaaaatactttgaagcatttgagaaaatgaatatatattgaggctctctcaatagagcttcataatttcctgtcataataaacagatttgtgccaaatttcgtcttttgtcctaggaccaggcaatggatgacaagagaaagtgggagaatttgggaggatttagcttgattgtattccaacaagggaacagaaagtgtagctgcatctcagaaccatctgaatgttcaagtttctgtttctgcatttttgagttttattccctttattcaacaaacatgcaattctcacctttcccagtctacttccctttttctctcatttcctaatctccctctaagcatacataatagctcccatgtctttattttggaaggagagatttgaagtcttctcttgttcctataactactatctttctatatgtttctgggttgtgtaaatcaatattatgtttattttgcagtttgaaaagggcactaaaaacattgcttcttggaactgataaggatggtaaactaccttgggcatacttgtaatatccaaaggtttgagcagggttagggaaccaagcaaactctccaaaagaattcctaattgttttagaaggacttcactgaaataaatctggaatctttcttctggtagaaaattaaatacctcattagcacaccaaaatttttgtaattcctgaggaatactgctgatgcatagtgtattataatgatcagaattgagttagtttcatgcaaaacttggataggtgcactgtgttcaacaggtaattacagtcactttggaaagctatagccttaaaaaaatcttataagtagtagtaggtagcatcactagaatagctatattttatgaatagcttatagtgagttatgaaccctataaaataagtcagactttaaaaccctggtcaaaagtgagtattataaggtaaaattacccatcgtagctgcttactttatttaccagactagtctagttagattctaaaaacctaacctattttcaaaaaataagcatttctgctactgaagagctctaaaagaatgttttttgataggtatttcagagaagaaattccataaatttgtttaataatggtgggtataaatgttcagcttcatctgaatgtaaatatgtagctggctgatttaaaagagacatacattttgatgagctcttttaatggtctccttaatgaccccatttctctaatctcaacatctatgtacagtaaaactattttatttagtattcctagtttaatctcctcaaagcatagctgtattatgttccttgctcaagtgctttcaagctatgtctgttatcttctaattaaacacaaatttgttagcctaacaaaattacatggactccagtttacctttccaagaataatcagcacctagtagttgttaagaggaggacaagcaataacaatagctccattttaagacagaggcatcgtcaatatcagggattgaggaaaaaaaaaaacagttaatacagtaggcctgggactgctatccttagaaaggcttgtttgtaaagttgaccattggctggcatctgggatcttggattttgagaagattctcatcattccttaactgataagagtggttccaggtgcctaaaatcatagtacaaacaatgtggtttatgctgaacatctatttttcttctgggagtctgaattttgtacctgcttgctggagggtgcctacatgacctattaccagtgcaaactcactcagttaaacttccctaatagatgacatcttccatgtgttatggtaatttattgctgaaagaattaagcacatcctgggtgactccatggggagaagactcttagaaatttgtttggtttcctccaaactttgcccatgcgcaactttcagctttgcttattttgctttgtgttttttcgctgcaataaattttagttatgaagcagactgcatgctgagtcccatgagtcctcctagcaaatcactgaacctaggggtggtcttgggggacactgacacagggagttgattgtttggcaacacaagttgtttcagagcaaatgaattctttttccacaagctagcatattagtaaactatcagggagcataaaatcagttgactgagttctgtcgggaaacaaagggaaaatttttcttcaaaaagacatgatatcctccctgttaagcaaagcagtactttccctatggataagtgtattcagttggaatgtgcttggctgcaagaaactgaaaactattatattacaatgctttaaagaggctagtgacttgtttctgagggaaagatatctaggagtggtacagtcactcagtgatgattttttctttttgctccaccatccttagtgtatagtttttgtcttcatggtcacaaggcagctgctacagtgccatgtattgtttgatgtccaagtgatcaggaataggagaatgtgaagggcaaaacccaactctgccctctctagggacttcaatttctatataattgactagcactgtcccacaggagctgaaaattcaactacttcacttttcaatactggaaatgagtggtaagaaacttggactagatgatcgatggtccacataaattatctgtcacaattcttctgacactaatagaacagcaatacaagattgtcgttgattccctatgtgaagatcctgtatgtggataccttgattgtaaggctgagagattaaagaccatagtaacttttgttaagtggtctccttgtcactcacatacctttgctcctgagttcttccataggtgccactgaacagcttccttgaggtaaactcttctgaacttgtaacctacattaactgggatattaataatctcttttaatcttaatgctcttatgaaatgacataaaaagaagaaatgcattgcactgttgtatgagcagataagacaaaatactaattctctccttttccccccatcctatcttgttttctttctcagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaggtccaatggctctgtgtttctgttctaccttctcattagttggttggacatgctagggtcttacattttcatctttttcttctctcagttttacatcagcaaccctgataaagaaaacacagatgaagcctaaggctctggtcaagaccaatagctccggccctcgagggagacatctgttgcaggcctgtctctttggcttatgggtggctatcttttaactgtgcctcttcacatcttccctttatgcctgtctttgtgtccaaatttccccattttgtaaagatactagtgatactgagttgggcccaccctaatgacctcactttaacttaattgcctctgtcaaagcctcatttttaaatgaggtcacattctgaggtactggagcttaaggcttcaacatataaatttgggggatagggcacaattcagcccataagagacactaatttatgaccagtgtatccaacatggtgaaaccctatctttacaaaaaatacaaaaacttagcctggcatggtggtgggcgcctgtaatcccagccactcgggaggctgaggctgacattgtgccattgcactccagcctgggctactgagagagactccatctcaaaaacaaacaaacaaacaaacaaaaaaacactaagactcactcttactaaaataacctcaagagtattttcattatgtaagagaagtttagtttatccagtgaaaagttattctaggttttgctaaggtaaatattacaaagaggagctgggcgaggtggcacatgcctgtagttccagctacttgggaggctgaggtgggaagataactcgagctcaggagttaaaaagtccagcctaggcaacctaaagtgaccctgtctataaaaaataaattcattatagagatgtgtacaagtcttggaaacccccaggcttttgtttaattaatttattttaacccaagtattgagccagtccattgtatctttttcagcttataaattatgttgaatttacaattcctacacagggcagctgtcagattcttgattagttataatcattatacctgctgatgttgatagtatataaagaaaaggtgtacatttagcacatccatttcaaatttccagttccagtttttaaaatgccttctattagaaggtaaacagttcttataagaaacaaagcaatatctctaagtcctgaagtatctatgctctatatccctccctacattttctaaatcaattctggtgcagattcctaacatgtcatgttctgctctagccctgagtctcctctcatagacatgcatggccagggggttcccttcagctttctaccctcacctgcagatagaacttcctagctaggaagagacaactaagtcaaagagaaagtcctcatactaatgaagatcaatgaaataagtcatcctcggagtttcaacctgtacctcggtaactatgctcagctttgtgtagagctagtgcctaattaatcaaagaaaggtgaagccatatgaaaaatgagtcctcactgaatcaacagggtctttccttggtcactgacactaagtcgaattttcattgggagaaacaacctaaagaaaaaggttagaaagtatcaataacatatattaaaacaatttaagagtttgatttcattctgagttgatctgaatttcatggaagacttggaagcaagaatgtctggggctcagtcatgatctgattagagtctcatcagatgtggaataagctgctgaaaagatcattcatagattgaagttatatcacataggatatctggcaacatac

SEQ ID NO: 12034 - DNA, 7853 bp, Human
ttcagatcatgatcccctccagctctgcaggagacaagacctgtctcccagcattcctcattgttcccgggtctgcagagggcgtgagctatgctgcaggcgggctgccccctgaagcctgcgcacccctctccagctcctcaagtcttctctgctgagtcaccttcgaaccggaggctgtgagctggctgtcgtgaccacactggtgcctctgctgtcatgacaacagcacactacgtcagtagtgctccctgggcactgagctccctctttgcggggagaagacagtaatgaaaaatgacaagcatgaggcagaggggaagatcacgcttgggtggtgcaggagcatggaggtgctcttaatgctctcaatgagaaagggttaacggtcctggttgcaggaatagctgagtcagaggtggggcttcctccactcccccaccccacccctttcaccattagggaccttcttgccttgctcttgctactctgctctgggtggtcattgtgaaaagcccgcaccaaccatgccagtggcagccagacgaggacacagcctggctctgggtcccagcaggaaaggcaatcccagaaaggcagggtcagggactggagtcctgtgggtgctttttaagcaaagattatcaccaggcaggctaaacttagcaaccggcttttagctagaagggcagggggctggtgtcaggttatgctgggccagcaaagaggcccgggatccccctcccatgcacctgctgatgggccaaggccaccccaccccacccccttccttacaagtgttcagcaccctcccatcccacactcacaaacctggccctctgccctcctaccagaagaatggatcccctgtgggagggggcaggggacctgttcccaccgtgtgcccaagacctcttttcccactttttccctcttcttgactcaccctgccctcaatatcccccggcgcagccagtgaaagggagtccctggctcctggctcgcctgcacgtcccagggcggggagggacttccgccctcacgtcccgctcttcgccccaggctggatggaatgaaaggcacactgtctctctccctaggcagcacagcccacaggtttccaggagtgcctttgtgggaggcctctgggcccccaccagccatcctgtcctccgcctggggccccagcccggagagagccgctggtgcacacagggccgggattgtctgccctaattatcaggtccaggctacagggctgcaggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggtggctgtggcatggtgccaagccgggagaagctgagtcatgggtagttggaaaaggacatttccaccgcaaaatggcccctctggtggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctaggcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgctgcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggacccgggttcataactgtctgcttctctgctgtaggctcatttgcaggggggagccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgtggctggggccagagactggctcttaaaaagtgcagggtctggcgccctctggtggctggctcagaaaaagggccctgacaactcttttcatcttctaggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccagttacttgtcctgtcttattctagggtctggggcagaggggagggaagctgggcttgtgtcaaggtgagacattcttgctggggagggacctggtatgttctcctcagactgagggtagggcctccaaacagccttgcttgcttcgagaaccatttgcttcccgctcagacgtcttgagtgctacaggaagctggcaccactacttcagagaacaaggccttttcctctcctcgctccagtcctaggctatctgctgttggccaaacatggaagaagctattctgtgggcagccccagggaggctgacaggtggaggaagtcagggctcgcactgggctctgacgctgactggttagtggagctcagcctggagctgagctgcagcgggcaattccagcttggcctccgcagctgtgaggtcttgagcacgtgctctattgctttctgtgccctcgtgtcttatctgaggacatcgtggccagcccctaaggtcttcaagcaggattcatctaggtaaaccaagtacctaaaaccatgcccaaggcggtaaggactatataatgtttaaaaatcggtaaaaatgcccacctcgcatagttttgaggaagatgaactgagatgtgtcagggtgacttatttccatcatcgtccttaggggaacttgggtaggggcaaggcgtgtagctgggacctaggtccagacccctggctctgccactgaacggctcagttgctttgggcagttactcccgggcctcactttgcacgtgtgcttacctagtggagacaaaagtacatacctcggtagagcgcgcacgcctgtaaccccagcactttgggaggccaaggtgggtgtatcacctgaggtcaggagtttgagaccagcctggccaacatggtgaaactccgtctctactaaaattacaaaaatcagccaggcttcatggcacatgcctatagtcccagctacaggcatgctgaagcaggagaatcgcttgcaccccggaggcagaggctgcagtgagctgagaccacaccactgcactccagcctaggcaacagagtatgagactccatctcaaaaaaaaaaaaagtacctacctcagagttcaaactagtgaatattaggaagtgcttgagacagtgacaccaaagtgcacaataaatactcgccagtttcattattattaaagaatccatttgaatgtcagctcaacacagcctcctataccgaggcattgtgaaccgcatctccccagcttctccaggcttttccaagaatcagggacactgtagcctgttggtctcagtgtatgacagacacggaggaagcacatctttagctgatacttaaacagagaccctgagcgcacatacacccgcgcacacatgcatggagcttcaccttctctgtcattctgcagtgaccaggagagcaagagctcccacctcccttcaaaacactgtgcccatcccgggcactaaggcctctttaaagcacggcacctccacgagggagggccacagccacatacactccacctggcaggtggacagcgtgagcatgtggaccatagcagggacaaggtgccccggccagccccaacgccctctgccgctgacagggacagaagccctctccagctgcgtgtgctgcagaggccatgcgtagcctccagctgcattctattccactccagtgcctgggccagttagcaccagtgtggaagacagtgagctggctccggacaacagggatggaggaaaggtcccacattcacattcctgatacgtggacaaggtgaggggccgcaatcgctctggcagcattttaaagatggggaagtagcagacacccacgcgtgaaggcaggagagccccaactgtggtggaaatggccccagaatggtagggccaagcctagctccagacaccccagagccctggagaagccaagactgagggagaaagcctgagggaggagcgccccagtcccca

SEQ ID NO: 12035 - DNA, 6828 bp, Human
  misc_feature (1)...(6828): n = A,T,C or G
gtctgagttgtccaagtcctccaggccggactgagaggacaactccaaataatagagaaaaaaaaagagacagagagccagggatatggttgttttgatgtgccatgaagttgcagcctttctggatttttttagtatcgatttatattgctgtttgtctaccaatactcaaatcagagcaagacggtccgccttacctcagtctggctcttttaaggtttgattttggttttggggactgcagaggtgcagcttcccacggcagaccaagcgcctctgaggaacgcagcagcttcagcaggtacaggaagatttcccgcagccggaggaatctcctagtgctgggcctccggctgtgacttttgccatttcaaattcacttggcctctagggagaggcagacagcccgacgctgagcgcgtcggagccccggctccctctgcttctggagaggagatttagccttaatttttgtgacagatggagttgatagtctctccacggaaaggggaggaaaaaagcgccagtttttgacaggccgcagacgcccgctgcctctggtggcggaaggctgcgttgcgccccagttaaggtagctcggaaactccctcgccgagaaggcagaggtttcctctgcagagcagcctcccttaaatatactgaggggctgaaacttacactttaatataaacctttggtgcgtgcccatttattccgtcttctgtcctgtgactgcggccaggtggtaattgctcgacattcctgaatatttttaatgctagttaaattttttcattattgcacgtgttgcaagcttatcttcctaagaaattatttcggttgattggatttcggtcttgcaatttgaaaacgatgcctggcgcacgggcggtacctgccagatggcctagctggggctggggggtggcgggcgggttgtaagcatctcatcaacatctccctaataaagtgtgtgcttctttcttgtatgcttctttaaaacagtttcagtctcacattttatctctggattctccccttcccctctgtggtgatcaagacccaaagacagggagcctggaagataaactgagttctgaatccagtcgaaagcacagatgggggccagcgagaattaataaaactacaaaaaaaaaaaaaaagaaaaaaaaaacaaacaaaaaaggcccgtggctgagccggatgcaaacagctgcccctaagccctgcccgctggttctgtgcgcgagctggggctgcatatccgagcctccttaagagtaggaggagctccgggcctccgtcaggctccctaagccgttcctttcaagccctgaatgcctgaatgtgagctgcccaccaccctcccgccctcccccactccgcaaccccactccagcggctcgtaaaaaaaaaaaaaaaaactttcaacaacaacaggcaggaccaatagcatctcgaaaagccgggaaagggggccgagcaaagggcgaaagagagtggagaaaggagaaagcgggcaggctcggagcgcgcggggccggggctcggcgagccggaggagcgttgctaatgtttttgtttgtttgcttttccatgcatgcataatgagggggcaccgcggcaccacgcgggggctcccggcccacttttgtatttaaagcctcgctgctaacgagtctgcagccgggctcagcggatccgctccccgggctcttggtcacccgagaagctgccgccgagtgaagccagggagccgctctccggcagcgccgactttcttgttctccccgcgcttcccggaaagagctccccggagctctgcggaggccggggttgccgcgggcggagggggaggggacgcggggcggccgggccgcgggaaggcgggcagcgcgcggacgccgggccaggaagcggcgcgatgcgagagaccgcggcggcggtggcgcggcgaggcactgagcccaggaggaaggagccgccgcggccgcagcgcgagcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgccccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccgcacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggcggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatgaatatggtgtagttactttccagagttacattgtggttaacccaataatgggtgaggaggggggttgagggggcactgagaatctatcaaccatcaactgaaatgaaaatacagtacaagacaagaaattatttctgcctttaatttaatgaacaattagacatctgtaaatgaggcagccaaaaatatgtaattgactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggtgtttgcatttgtggagagaattcacaaaatagtgtctcctgtacataatttgaggataactcagacatgttgccccgcctcccccttttcccctgagacctcccctctttgtatcccccttcccatcaccccttacccccaagagtatcctctctggctactagccattctcaatcaaacatgccaataacatctgttaccaataggttttaggaagcttgcaagctcaatacttcaaagtcattttcacacttttggtgaaaaagtacaaaattttgttgcaaaacattcagaccagcaaaagtaaacacacaggggaaaggaacaatcaccagaacttgtaatattgttgtgaggagttgtttagcagtggctgaaggctgggttcctgccagagctactgatctacactcaaacgcccttagataaataattacactcttaagctgtgtcgagtgctgatacacttgaccttgtaaatagaaatgtttgcagtaggaataaactccggcattggaaaatcttttaaacattaacacaaaagagagcgctctgtcctctagggatttgagcctgaacctcgccaagctaggcacttgcaagggggaaaaaaagtttatttatcttctattcctggtgtttgtttaaagcttttcattttaaacgcggtgattggaaggcaagtcgggagtttaaaagtcaccacaaataaactttgtctgaggggtcgacagattagcaagatctggtgtctctttatttgatattaacatgtgctgaaaaaacataaccagatttctctgctgcctaaagtaattaacgaagctatgcccccattctgacttcctcatacccactcccacccccctacttttcaaggtttcttgtgcttctaactcgctcttttcccagcttttatggaggtattcaagacacttcttggtgcacctaaaaccacgatttctatatgtatagtattagaaagtctaagatagctgtagtgtcagacttaagcccaggagagtggtgtgtggttggaatctccagtcacctgaatggttgagtaaacatattgttaaaacaaagctgagagcgttgtttctttgggaagcgaacaaagagtattcccagagacttgtaaatgaaatcagctttctttacaaaacgacaagttagcagtgctcctgcgtttgtccttaaatatatttaaatcatctccatctcatgttattttaacacatgcttgactaaaagttaagtctttgtcccagtaaaaggcccagttttccccagtaagaagtaaaaggcattagcactagaaaaggcctgataattaactgctacaataaactcacaacttgattttacagggtcctgtcaaaagcatctgcctggaataaatcaacacaactcgctcttggggagagaggacacgaggctttatgttttcttccttaaagaaagtgaacattgattggtggtccattttaatttaaacaattatacactggagcccaggagtcctctggtacccctacagacctagcggaggttgttgagatgttagaaccctttggctagtggttatgagattgcatattgccatctgcttctaagcagaa

SEQ ID NO: 12036 - DNA, 12140 bp, Human
gagggtcttgctagtctccggagacgccaaataggctcgagctccgcggcgatctcattttacgagttgatgaagaatcgtaagctaaaggatgggaaaagttgagagacagacggacggagagacagtgggccccggcgggaccgcacgcgttgaggggaacgccaaccgggaggcacggagactgctcacctgcccggcctggccgcggaggcccggcgccaagggcctcgcgctcggcctcccgccccctgcgcggcttcccgggctggcgccggcctccgctcccgcagagtggagttccgagcagaccgggctccgcgcgctccagcgtggaggggagcgggaggcttagcaggcggctcgggcaggcgggtcccccaagggcacgagacgcgctggttcccagcccaatggagctctgcgccccccagccccgcgctttacctgcgctgaggcctcggacagacaaacggacgccagacgcctaggcaggaggaggcctcagcctgagcccgcggccccttggcgctgccctgaactggcctgggagggggtgacgggggcgcgcccgcggagctgggcccagccgggcgcccccggagccgaggggaccgagggctttcctccctcctcggattattaaaaagttcatttcctggcgaatcgggtgacgtcaggggctcggcgtcgcggtggcggggccgcccggccggagaagccgcctccagttacccaattaccgactgtcaatcccgccgcccctcccccactctcccgggggtggccgggaccccagccctcctcctgcccccgacccacctgggggccctctggacatctaccccgggagcctcgggcccaacagggaagagggctggaggacgctgttgagtccccccagtactcggcacctgtctaggtcccccaaaatgcctttgtcctggacctccctcctcggcccggggctcccttcgagcctccgtctccccagtctgtacaatgggagggaggaagacttgtgcgcccggcccacacgaaccatagagccgatctccgggctagaagtgagtggggagcacttccaggtgacttagaagacggagacctcagaccaccgcctccccctcaccagaggccacctcggggaccccccccggaggaaaaaaaatgccacctcttgcccgggggcgtctccctccagctggcgccggcgccagtccgggtctccacggcctcgccccaggcaattgggcccgttggcctgcgaaggccacgcccggggaggggtgccccctccccctttctggagccaccggccgggccacctccactgggtcaagcacagccctgagcggccgcgtgtccgaggcccaggtgccctctagagccctgtagttcctgcccctctctgcccctctcggctcctgctgttccgccgctgtcgtccgaaccatcccaacccccagtccacccagacagcgcccgagctaggggagggaacggtctgggtaggtaactgcgctcggactgaccacgttcagcggtgaaggagcgtggcggggttagggtctcggggagaggccatccagagggtgtgcggcccgggctcctggggagggggcagttggtggttagttactgctagggaggcccagagcatcgagggatcccggagtgttcgcaagaggggctgcaggggtcgggccttggggtgagggtcccttagtggtggggcgcgttggcagcaggggccgccaggagcgcgcagggagggggcccgccggctgaggggggccggcccgcgggtcagtcccggagtccagcggttcgggaattgcggacgcagccaatgggaggcggaggctgggaggcgcgcggcgttgattggctggcttgggcttcttaggcgtgcgcggcccccgcttcatgtctgtgcaggagtcggcagctggcgccagggcggccggaggatgccgaggggccggagccgggcgggcccgaggccgaggcgcactctacccccagctcctaccctgtaagccccgccagcctccggacgtgctgtccctgggcccgtcgccctctgggctcccgccggaactccttcactctcagaggccgagtccctcccctccccacggctgcgtgtgtaagtttggggtttgagagccggctgggggcctggggcgctcctagctttgaggggactctggggggacttagggcggggggccaggctgcgggcgactgctttggtgtgctttgttgagaggtcctgattgtgccgcttagtactgcgctcagggggctgcgtgtgcatgttttcggggttgagatcagtatgtgtatctggcgccaagtgtgggtgtgtgcgtgtcgctgggatcaagtgccacactgggtgcccgggcgcctgtctccaacttttgagtctgtgttcatgtgtttgtctaccgggcgggggggctcagtgtgagtgtctgactgaagtgctgctctgtgcgtttgttggggtcactggtgtcgggacccgtccccgggcgtgaccccatgtgcacgggtgtgtgattctggagccgcgggtcaccacgtgagtgtgcgtggctgaaccccctcccccgccttcctttcgttttgagccttgggctttcctcccacccgggactggtgctctttctcgccggatctgggctggggctccgtggcgtgcgggacacctcgtggtgggactttggggggtgtcaggcgctggcggcacgcctcactcccccttcctcgcgcagggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacggtgagcactgggcccgtggtgatgagaacccaggcgccgcgcgccaggcgagggaggggaggagggcccgtctgcttgcttcccggatgtaggatccgcaggaatcgagctgctgaaaaattggggcgggagaggtgggagcagcggccgattggggagggtctgggacccacagggtttctgcccacttccagctggcctgtgagggttccctgtagggtctgtccggtggggttccttctatgccacttgtccttcagcttggactgacattcctgattattaccggtggggtattatgtttctggctttctttggggaggggatgactgctggttctgggagtcgtgatctcaatgtctgtcaggggcgtccctagctctgcctaccctgatctttctgcccaccctgatcctctctctctttgcccgcagcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcaggtaaaggcaggtgctggggacttcgtggaagaggggagcatttgcgtttttgtggtggggagctgtgacttgggagaggtggcagtgttggtttcccagatctggggatgggtgatgtctcgctctaatagcccccagcagatgtttgagacccccgggtcagggagaggagactctaaaacttttgccattttcttaagtgcttccagtgtacccccaaagttcagttccttgccccagggttggtcactgcctgaccagaacatagaacaggaattccccctttccctccctgaatcttaagtgaaaattcaagccacctcaggacttagtatgtgaagcgagggaagtgactctgtatgtgcatgtgtttgggagcgtgtgtgcatgtgtatacgtgtgtctgtgtgcatgttgtgtgtgcatgtttcaggcactccggaggttccagaccattaaggaatctgggtctctaactcaatcagtctgatcttgggatttcgatggctccctgatctcctcgggagattttccccagagcaaaattcccaggacctgctcctgctccctgccctcgccaggcccttccctctccctccctgagggctggagtgaggggatgaagctgcagtgcccccgccccttttcccgcagctggctggggccaaactgggtttgtccaagaatctggccacagagcataaacccagaaactcgtggctagtgtggagttcttgctgtccatgtctctttcccgaatccctttgagccacagagggggaaggtttttaaaacagttactcctgagtgcaggaaccaccttctcttgccagtctgtactcctcatttagtttaaactaaatcaagaacaacttcctggggaacacgatgccagccagtgatcctgctcaacttggtccccagccccagcccccgctggccccagcacccgctgagccccggctcagggtcctagttctgctcagacccgtcagcttgccttttcttggtcctttctcctgtttgttttgcattttatttgaattccagatggtcttttaattgaaaaaaaaaatacaaacaaaaaaaacccaggccacttatctaaaaaagaaagagcttattatttattttattttaaagaacaacaacttcgatccattatttccaggactcagaaaaattctagagctttggtggaagaggagaaaagttggggagaaagagggaaatgcttctggacttagagcagaaagacggggtggggcagacacagttgggtagaaaggagagggacaaaagaggagagggggagagacgcgccagagcgggaaggagagagcctcctgggcccagccaggttgagctgggtgactcctgccaccaccctaccctcggcaaagtttgcagtaaataccctcctggttgctccagaacgcctggggccctgggcccctcctcccctcctccttcgtttccatccctcctggtgaggattggaagcaggggatttggctttaaacgactctggacccgtgccccctcccatgtgggagaccctctagtccctcttcctgcccaggctgttgcagccaggcccaggccaaccgtgtgcctgagaggcaccggcactgctcggctggctgctttcctgccctggactccctcccgagaacttgccggttaagcaggcccccgtgtctctccctgttcccctgcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactggtaggagcgggcacaggtggctgggagggggctgctgggcaggagctggcggttaattacaggggaaaaaaactccttcaaatgcagacgctttgccgcttgaaatcctcttttatcatgaaaagcactgggatgtcagttggggtcgtctctctttctggccagattctttcgggccagatttcctcctcgggtatagggagcccaccgggcacccttgcgccaccccactctgctccgggatccccgaagttgagtgtccacgggccggactcctgtcctctggcctctgcttagctcttttttaaaaatagggccatgaagtacttttccttgtggctcagccctccccgacagccccgctcacaagctcctcgtgcttatttaaataaaacacaaactcacaccggccactaaaaaaacctgccctttattatttttccatggagtcacctatactgtgtattttcatttgagtgattttaaaaaaatgccctttcggatctcctgccggagtttcctatccggacatctgcagcctgaagataaggaaacttcgtgtatctgtttccggactctgcgagtttttagagtctcctcagctcagtcctgcctctcgctgggctgttttgaaatttctaataccctccactctgcaaataatgcgtaaaatgctaagaataataaatatattttttcagggcgaagtgatttatgaggcttaaatcgttccctgctttgggggcctttttttcccctggagcgagggcggggtgaggcccgggtgggggtagaggtggaggacgcggcgttggcccctgagtcagaattccagcttcaggctgcttactcacccctccctgcccccgcggctgcagtccctctgtcccttctgtgaccaggcttgggcctggggctgttccaggctctgcaggcctcagcccccagccccccacactcaccacctggtgcactcccgcctgcagttctctgggaagtgttgggggaccccctctgtcactgtggggctggcgttggtggaaccgggagaggggatctgttttcttgggtaaagcctccctctagcttctctctgcaaggaccaggcgctcatttccagaccctacctctgccaggcatttcctgagggactaggactcagaggggctgcggggtggttaaagctctaagggttggggtatggggggctggatgggggggatcagcactcacatcagctggagagatggaaaagttctgtgtctgcactgcccactgtggtagcccctggccacatgtgaatattgatcacttgaaatgtggctcgtgcaattgagggaactgggtttttaattttgttaatttgtagttagatcttatttaaatggctgcctgtggccagctgctacagtgttggacggtgcagctctgcactctgtaaacctgcgctggcctcagcgacactgactcacccaggattatggattttgagcggagtcgtgctagaggagacacagaatcggccccagatccaggggctcgagggggaccaagccggctcagcctcaggatgcctgtgctactagagagcccttctcagggcctcagtttccccatttatggagttagagcgcagggtagttgggggaggtagctaattctcctctgtagctcttgcaatcccgttgattctaacatcaggcttctgagagttctttattccaaagttctgtgagtcttgacttatttcgttctcaaattctaaaattccatggttctgagatgctttgattcccatgtgagatttagccctccttgactgagctggtggggactgggggtggagcgagggtcagggaggggggtcgaggtgggcgtgggagtccagcctgctgacgctgccttgccctcccagtcggccgccagaagagccggcacctgttgtgcaaattgtcagacgacaaccaccaccttatggcgccgaaacgccaacggggaccctgtctgcaacgcctgtggcctctactacaagctgcacaatgtgagtgcgccccgccccggccaccccgcccctcccaggggacctctgcgctttgtgctgccaggcaagaggccccagccacaatatccagcttggcttggcttgggaagctgctgccctgagtgagcgccagaagggcttcccgtaagaggggtgccttgcctctgctcaggaggtggagctggctaggacagggtctcgggctagggaagtggtttctctgcttaaaaagggtcagggtgggggggaggacttcagttggctgggcagtgctggcatgcggtgggcagagccagggagggtgtgggtcagccccatatgccagaacccgcccttcctggaatggtagccatctggtgatgggactatgaaggtcgggcacaattcctggcttcctgggaccctcagcttgacctgcctctggtccacgctgtggcggggtgggaggaatgttgctggaggaaggaactggccctctgaaaactggtggttgcctctaggttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccctggcctgtcttgtgggctcccagggtgctgggtcccgggtgtgaatttgggcagccagattgcattgcttttgtcgccggggtggctgcgaggggaaagcccctggaatccaggatggggcctctgttgggcctgggtctgattttgccactgacgtcctgaggctcctcccctgaactgctcccatctggatttcctgtcactgcaccaggggtcctagtgaatgggaagatactggggaggtgcagggaggccgtggtttctccagcctgtggtccacccctgagggctcaacgaggctcctgcaaaccccatctccatttgcttccttccaggtgctgaactttctctcagctctggtttctgagatatttggtcatcaatattcctgttcattggcaaacttgaccagcagtgtctgtgatcactgatgtcattgattgctgtcatctttgatcagtgatgttggtcatcaatgataggcaccatgactgatattccagatcaatgacatgtctgatcatgagagcctgccatcagagacacctgatgactaacaactgatcaccaatatttcatccatgcctctgcttaaccatgagtttgatcactgacacccacaaaatgtgatcacgaatgtctctagtgaccatctttgctcaccagtagtatgcctgatcatagtatctcttctcaccaatgtgttgatcgccaatgcgctttgtcactaatgttctagggcatcaataagtatgaccaccaatgtaattgataagtgttttttctggtgatagaccaatcactcacatgtaatctccagcatctctgatcacactgtttcttatcaccagtgtttctttaacaatgtccttggtcagttgtttctgatcaccattacttctaactagcaatgtgcctgatgaccaatgtccctgatcataggatcctctccccatcatatttcctatcaatgtagtcactagtgtttctggttctcaatacccctgattgctcaacactgatcatcaagatctcttatcaccaatgtctctgatgcccaacatcagtgattgctgaatcgtcttcaaagtctctgctgaccaatgttcccgttttccaaagtcccttatacctctgatcactgacctccctggtcattgatatccctggtcatcagaatacccagtcaccaatgtctctgatcaccaaattctctaatcattgatgtctctgctcactagtgcccttgatccctgatggtctgcatttggttctcttcaccaagatctctggaccccatgtctccagtcattgaatctggtcactaatatctcgtatacctttggccaccaaggacatggacacccaatactttccccactaatgctcccggtcattcacagccgaagccacccatgccccctgatcaatgattgatgacatatttgttcaatgataattctggttgccaagacccctgaacactggctcctgatggccagcatgtaacacacccctccctgaccaggttgtgtctgatggacatcatctctggctgacttcaccgtccctaattaaaaatcactctgattgtatgtccctggtcagccatggcttctcttcaccttagttgtcatcatctttgaccaccaggatctttattcaccaggggccctgaggactgggtatttctgattg

SEQ ID NO: 12037 - DNA, 13871 bp, Human
gcccagaagttctagaccagcctgggcaacatggcaagaccctatctctacaaaaaaagttaaaaaatcagccacgtgtggtgacacacacctgtagtcccagctattcaggaggctgaggtgaggggatcacttaaggctgggaggttgaggctgcagtgagtcgtggttgcgccactgcactccagcctgggcaacagtgagaccctgtctcaaaagacaaaaaaaaaaaaaaaaaaaaaagaacatatcctggtgtggagtaggggacgctgctctgacagaggctcgggggcctgagctggctctgtgagctggggaggaggcagacagccaggccttgtctgcaagcagacctggcagcattgggctggccgccccccagggcctcctcttcatgcccagtgaatgactcaccttggcacagacacaatgttcggggtgggcacagtgcctgcttcccgccgcaccccagcccccctcaaatgccttccgagaagcccattgagcagggggcttgcattgcaccccagcctgacagcctggcatcttgggataaaagcagcacagccccctaggggctgcccttgctgtgtggcgccaccggcggtggagaacaaggctctattcagcctgtgcccaggaaaggggatcaggggatgcccaggcatggacagtgggtggcagggggggagaggagggctgtctgcttcccagaagtccaaggacacaaatgggtgaggggactgggcagggttctgaccctgtgggaccagagtggagggcgtagatggacctgaagtctccagggacaacagggcccaggtctcaggctcctagttgggcccagtggctccagcgtttccaaacccatccatccccagaggttcttcccatctctccaggctgatgtgtgggaactcgaggaaataaatctccagtgggagacggaggggtggccagggaaacggggcgctgcaggaataaagacgagccagcacagccagctcatgcgtaacggctttgtggagctgtcaaggcctggtctctgggagagaggcacagggaggccagacaaggaaggggtgacctggagggacagatccaggggctaaagtcctgataaggcaagagagtgccggccccctcttgccctatcaggacctccactgccacatagaggccatgattgacccttagacaaagggctggtgtccaatcccagcccccagccccagaactccagggaatgaatgggcagagagcaggaatgtgggacatctgtgttcaagggaaggactccaggagtctgctgggaatgaggcctagtaggaaatgaggtggcccttgagggtacagaacaggttcattcttcgccaaattcccagcaccttgcaggcacttacagctgagtgagataatgcctgggttatgaaatcaaaaagttggaaagcaggtcagaggtcatctggtacagcccttccttcccttttttttttttttttttgtgagacaaggtctctctctgttgcccaggctggagtggcgcaaacacagctcactgcagcctcaacctactgggctcaagcaatcctccagcctcagcctcccaaagtgctgggattacaagcatgagccaccccactcagccctttccttcctttttaattgatgcataataattgtaagtattcatcatggtccaaccaaccctttcttgacccaccttcctagagagagggtcctcttgattcagcggtcagggccccagacccatggtctggctccaggtaccacctgcctcatgcaggagttggcgtgcccaggaagctctgcctctgggcacagtgacctcagtggggtgaggggagctctccccatagctgggctgcggcccaaccccaccccctcaggctatgccagggggtgttgccaggggcacccgggcatcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagtgaggaggggatggggaaggggggccttgtgagcagaaggggctgaatccccaagaaggagtgcccgagaagtctcagggaggggccgaacctccctgctccctgggcctccctacctcttgatggggcactatccttgccccccaacatgatgggagggaccagaaacaggcccagggccccggggatctgatgcccgcatgccttctgccaggagtccagggtcccctcagcacctccctactggggaaagcagtgcaggagcagcggggcccctgtgtttcattcatggctgggctttgtgactgtgggcagcgagctcacctattctgagcctgtgtccatataaaggaggagttggaagcggagaaggttgatgtccatgagggagattggattctggggtgaagaaagtgagggaaagagcaggcaggtctgggcgcaaagcacaggtgactgcctgccaccagcttgtgacccccatcaagttactttgacttgcacagctgtgaagcggtggtcataataaaattcatttcaaaaggtggttacctgggatcagaggaatccccaggggcatggcgcttcactgagctgacaggacatgcatgtgtgccttcaagtgcaggaggacatgtgcgtgtgtgtgtgtgtgtgtgcaacagtgagtgtatgcttgtggatgcgcctgtgtgagcagaagcaggtgcaccaaccctgataaggcaccttagtaatgagttaaggcaaaagcccacatctgctcatcctccagacaagtcctctgtctaaggccccccaacccttaatcctcctgctgctctactggtcctgggtgggggtggtctctgtgacagctgcctcaagggagactgaggcaggtattcaagtgtcctcagaagagcctggacccaggaatgtgtccccccactccaggctccaggatgaaaccaacctgaggctggaagccgagaacaacctggctgcctatagacaggtcagggaggtggaggggaggggcaggggagggaggaaaggattgatggccacccacccaaacacagcccccaagctcagcccgccagagcaatgtgctgctccccactgccccagaaggaggggtaaggcaaggctgaggaatggggagaaggagcctggggccccagtggccctctactcctcacccctcctgccactccaggaagcagatgaagccaccctggcccgtctggatctggagaggaagattgagtcgctggaggaggagatccggttcttgaggaagatccacgaggaggtgaggccagggcagagggaggaaagctcaacacagagattgcaactgagagagggagagacagagacagagaagctgagactgagagagacactcagagagaggagagaaacagagattggcaggtagagacaggaaatgaaagacaaacagaaagacactaagggagacggaaagagacaagagagcattcgaactcctggccgaggggcaggcagaagaggacacaatggcgtggggaaccccagctgtggcctgtaccctgagccctggtaccgcttctctcaccctggtcaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaaggtagccctgcctgtgggccagcctgcctcctccaggcagcccttcttgctctgtacaagagaatgggggaaggagggtggaggaagctgggagaatatcctctccaggtgactgactttcaccagagaagtgagatggcttgcccagggtcacacaggcactattgctttcaaaagtacccattattattactgctactattgctattattagtagtagctgatactgttctgttctaagccctgtgcttttcatggattaccttactatgaagtaggtgctgttctttgacagataagagagccgaagtccagagaggttaactaatttgctcaaagtcacacagctcctaagtggtagagttggatttccaactctagcacatctcacttgggagcctgcattccatgcctctgccagtctgttttgggttactgagcctctaccatatgccaggcaccccccaggacacagagaggtgtctgacctggaaggtgtgatattgacgtgcacccaaacatagtgcccgtagagaacaccacagctcagagcttatatgtagtgtgggagccaggaaagacactgtagagggggcatttgggctaggcaggacaggcacgctgtggacaggaagagaagaagggagggccattcctagtggaggacagagcctggaggcagaaaagcacagagaggcagggccccaagatgctagcctagccagggcacctagctgaggagtgtgagtggcagaagccactggtgtctgagcagggtgagggcccgatggggctgggaggacctccctgcaggcaggggagaaagggctattagaacccagggtgaggccaggcgaggtggctcacacctgtaatcccagcactttgggaggccgaggcatgcggatcacctgaggtcagcagttcaagactagcctggtcaacatggtgaaaccccgtctctactaaaaatacaaaatcagccgggtgtagtggcgcatgcctgtaatcccagctactcaggtggctggggcaggagaattgcttgaacctgggaggcagaggttgcagtgacccgggattgtgccactgacttccaacctgggcgacaagagcaagactctgtctcaaaataaaacaaaaaaaacaaaaaaacaaaaacacacaaaacacccaggcctccgctcgcctaagacgacagcgttcagtcccgcagatgcagctgtcagtgtggaaggttctggattctgtggcactgttcattcattcgcttgctgaccaggtgttgtgctaggtgctgaggtctggcagcccgctaccctgcccgcatccatgggtcacagttgttgggaaaagtcccagccagggccaacgtcctggggttaactggggtgctgctcacctccctgatttcccagagcccgtgcctgcccatgggcccacacagccccccatatgtgtcccccacctagtttgcagacctgacagacgctgctgcccgcaacgcggagctgctccgccaggccaagcacgaagccaacgactaccggcgccagttgcagtccttgacctgcgacctggagtctctgcgcggcacggtgagcgcggccagggcaggacggggacgggcggagcagggacggccaccccaggagatgccaggggagaagggccaggggcgaggacctgggtcgagggcggggcctgaacgttacccccgggctagaggcggggcctggggccgggggccgggcctcgaaacctccccaagtcgggtcggggctccgcgggaccggccggctccatcccacagaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggtgagccctcatcacagcccctggggaagtctccctgctgcctcacggtagagctcatcttgctcccttcagggactgagtctttttcagccttgtgtgcagatcccttcccacctcaatgcccagcacagtgcctgcctcacacatagcaggcagtcactagatgtttgatgactgaatggatggatggattcaaccaatattgattaggcctcaaggccaaggacttgggtcaccctccaaactaagaggcatactccccatcttcccagccaagattggactcctcacctcacccatctcttctgcctccttggaactttcttcaccactttcccctcccttttccatcttccttcagatagacatgcgcccctcccagataacactcaagccccttgcagacgtttggaactccagatagcacgttggctgctggggaaaaagctaggagatggagttagactttcctggcaaggaaaagggcgttcaagttgtcatgatggccccgcaccaagacccagcctaggggtgtcccaggcagcccgggcagccctctccctctgctttctttcaggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattagtgaatgtgacgtgttatatttttctctctcgggcggggcgggggggggggagagctaaattactttttacttgcattggccctgaaatgattcttagctaaggaacaaaattcctcttcttctggactagaatatttaggaccactagatatgcatgtctcaggacttaattcagcatcagaaaggctaaccaggctgactagtagaggtaatactgccaaatcctagatagtcacaggtcactaaagcacagataaatggcagagagaagtaggaaagaggaaaggggacaggaaagggacctatgtgtattgagcactaatatgtgccacatgtttaacagcctttattttagttaattgtctcctctctcccacctagagaagtaggccccatcatccttattttacagatgaggaaactgaggctgggagaggtcaattaacttgcccagagtcatgtggctggttggtggctaagttgggacttcttgagctctggtctcctgatccttccttccttccttccttcttttcttccttccttccttctttccttccttccttcggcagagcgtccctctgtcactcaggctggaatgcagtagtgcaatcttggctcactgcaacctccacctcccaggttcaagcaattctcgtgcctcagactcccgagtaaggggattacaggtgcgagccaccacacctggctaatctttctttttctttctttctttctttcttccttccttccttccttccttcctttctctttcctgcttgcttgcttgcttgcttgcctgctttcgacggagtcttactctgttgctcaggctggagtgcagtggcacgatcgcagcttactgcaacctccgcctcccaggttcaagtgattctcctctctcagcctcctgagtagctgggactacaggcacctgtcaccatgcctgactaatttttgtatttttagtagagacagggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactctgggcagcagcactattgggatttgggggctctccagcccgtttggaagagcctaggctctctctgctcggttgcataggttctcatactcatgatggggaggggggtgcgatggggaagccgggcatgggagaggatggctcatgccctgaaagtccatgagaggcctcctctccccacatctgcagaaaccagcctggacaccaagtctgtgtcagaaggccacctcaagaggaacatcgtggtgaagaccgtggagatgcgggatggagaggtaaggagggatttgggcccagtcaggctctggctggccccagggattctcaaggccaggccatggaggaaagcctggggctggcacatagaaggttcccagcaactcccagtagctccccagggaattctggaggagagcaaggaaactgaatgtaattccgtttcctcagtccctccataggctgttctaaggggagccttggtaccaaagccactagatgggatcctaatacacactctctctttctcaccctcaaactcgggggccttgcttgccagggagagaaagagaattaaagttagtagctttcacttccaactctagcagacacagttggggatggggagggctttccatttccagcttggtaaaaggaaactaccaggggaatgggaagaggggatttggcgtatccgccacgccactccaaccacagtgggagctcatcttactccagcagcttaccactcgccaggcatgacgctaaatgctttcccagtgttatctcaccaccccctctgtccaccacgcaaggcagctgtggttactatcaagaaaagtaagacctgggaagtcggggacttcccaaggttacacagcctcgtggtggtggacctggggtctgtgtgaactcctaactgttgcactgtgcacgttccctgtcccctgcaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccatatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccagagtggactctgatctgttcatgagagggcgggactggggccaagatgtagcctttgacaagaccaactcatttcttattactgatcatctctggggcccatgccctcaccaaattccacccgcagccaaagaggacatacaccagctccctccactcttttcttccttcctctccctgctacctgcaactcaaccagcacaatcttcataggcaagaaagcaaagcagctcaaacatgattcaacactgatcagtgtttaccactggataaatctgagttcacactttccttctctgacctaaatgtgaagtcaggaaacacatgtgccctacttccatcctgagctcagtccccaatctcccaccagcctcaggcccctccacttctcagatcaggtcccagacctgcccatgaaaatggggagcaggctgtaacagatttgtccacatgttcctaccacctgtcccaacccagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcggatcagcatgtcgctgcccacacgtacctgggctgcctccgtcagcacccgcccatcaaagtccgtcagcactttggtgtggctgctacctaggtgcttttggtagaaccagactatagctggcacctcttcgggtttgcagtgacagggaagctcaaagctcatgtcggccaggtaggctgcattttcaaacatcaggaaagcagggcagggggtcctctgaaaaatgttttccttctccacaatttcaaaggcctggagactcccccatgcccacaggagcacagtggtgagggccaggtgcatacctgaaggaggcaggggtcagaggggcagggcaaaaccagggcattaaaggctcatagggctcctagaaagctctgctaagcggaagcctctggatgaggaaaggattatgcagccaggaaaagcagcaacaatctgcagaggaagccgccaagtgcaaggcaatttattcccagtggatgtacaagatgccctt

SEQ ID NO: 12038 - DNA, 66219 bp, Human
ttccagcagcctttttcttctttgtctgttatggttaatactccatagattttagaaattgagaagttcttgaaacattttattttcttgagttcatcacttttgactcttgtatgagatgtgatttgtcataaaagatagccttccactacttcactaaatgaatttcagagtaaacactgtgattctgcagagcggattcagtaggctttccaatgttttctcctgctatacagtgcctaccaccttgagggcacttcagtactagaggatgaaaactgaaacgttgttttgatgtttattgaataacgagattagagaatatttgatttttgttgtcagtgtattaaagaaattttcacattgataaatgttctctaggaatgtgtctacattcatcaggtgtgaactcttgtacatgaattttgtaccttgaatccacatatatattaagtgtatcatcaatataaaaataaacattatttgcttaaagtttttggtactttttcggtattgacagctgaactgttagggtttgcttcattcaaatatctcagaggctttgaactatcttggggttgatgcttcttgttagtttgtcaatgtttgaatcctggttttggttttttccctgccctgctcctgcaggtcagaactggaacacgcgagggaagggactgttgaagaattgggtggaatctgcttattcttgggcttgtgttgagtctggggatggaaccagagttccttaaggtggaatggctggcttggcattgacgagttcagggacctgacttagggtactgatttggaccgtgactttttgtttgagatagagtttcgctcttgttgcccaggctggagtgcaatggcgcgatcttgactcactgcaacctacacctcccgggttcaagcgattatcctgcctcagcctcccaagtaattgggattacaggcatgggccaccatgcccggctaattttgtatttttagtagagacgaggtttcgctatgttaggctggtctgaactcctgacctcgggtgaaccacccgcctcggcttctcaaagtgtggggattacaggagtgagccaccgcgcccggcctggactgtgacttggaacaagatagtttttcctcttttgtttattttcctactgcctgcatgattgctatttatttaaagagacggagtctcgccacggtgcccaggctggtctggaagccctggtctcaagagatcctcccacctcggtcttccgagtagctgggaccacagaagcgcgcgccgtgcacttttgatgttttcaacttccttcctaagcagaaaggagacggcccagcagcggatggtgaagctaatccaatatagtgagctgccaccagcgtttttaagtgcattacatagtaagaacgtggttctgctggacgttatgtactcggttgcgatataaaacgcatcatctacagtaggtgacaggcgccaaagtctaaaaactggtctcaaggtgtaaggtcccaggactagtttctggagctactggcttgtgagtgaagctggaggcgcagacttcccgggtcacacggtggcaaggcagctgcctagggtgcggcgggaccgggcggcgcgggggggcgcctggccaagcagtgcagccccggccgggtttgtagccagcacagcacagcggggcctgtggcaccgactgggttcttttacttttgacacgaagcccctcccacttaccacgctctgcacgcgcccctgttaaaatagaaaaagaccgagaggcctcggagactcagtcatcatctgtggctctggccgctcgctgacgtggcgaactgggctgagggagcgcccggctgggcacccgagaactccagccgttccggcccagtcgccgctcagaggtggtaacagtagccgccaaggccgcgcacgggcgcatgcgcgcgtcggaccaaccccctccccccaccgcgcagtcacttccggcgcgctgggagacgtgcggttccgggtcgctgctcggctcgccggctgggcggtgggggttggtgacgcgggccggggctcacgagaggcccgggaggcggggctttgctggcttcccagagagaggcaggtgcgcgggccaggactccgggaatgcgagcaggccccttattctcccagtggcctcggtctgtccccacagcggcccggtcagggttgcccgagccccaaggcggggggcggcaccggggtgctgaaagggtgagagtgggggcggaggcgggctgccccggcctgggagtctggagcctagggttccgggattcctccctgcgcgaccttggacaagtcgctcctcctctctagggctcagtttccttgctgtcaaatgggagagatgttggatccttcctttctttgacagtccaaagcacgggcggggctggaggtagcctgagggagtgagatccaaactgccgtggcaggcacctgcctgcctccctgggggttagacatctgtctttacccaattttgccttgctttttgtcagtgcacatccgtgaccagacgcccagggtctggccgggtaaacagtatgtgagtgtagtaatcaactgagaaataaatactggctccaggaaaacttaacctcattcaaattgttttgctcagggctcccagggagaagtgaatttaggcacccgctgcggtgatcaattctgttctatgcgcttgtaagtgaagctcttaggcaaaaaacaatttcataggagatcagggttagggagggtatcccattgagagttgtgacaggttttcttaccccctttaatccttcttctgcccctcctcttccttcacttcttccccctatccccacccaacattttggccatacacttgaaaagaaatacccaatgcattttatctttgtcttcatgcaggacagaatgctttgacctccaagctgttttaaatctagtagataagccaggtgagtaagtggtttacacacattgaaagtaaagtttctgaagaattgtacagccttaatggaggatctgaagtggtaagatggcatttgtgtatctcagagcagagcttaggtatcctccacaaaacatggaaagttaaggttggaaccagaatattagtgttttatacaccattaggaggaaaaggtttttgaatcttactttgaatatcatgtcaaacattcttaagaaaagaaactgtgaggccgggcgcagtggcttatgcctgtaatcccagcactttgggaggccaatgcaggtggatcatctgaggtcaagagtttgagaccagcctgaccaacacggagaaacctcgtctctactaaaaatataaaataagccgggcatagtggcgcattcctgtaatcccagctactcgggaggctgaggcaggagaatcgcttgaacccaggaggtggaggttgcggtgagccgagatagtgccattgcattccagcttaggcaacaagagcgaaactccatctcaaaaaaaaaaaaaaaaaaaaaaaaaaaaagaaagaaagaaaataaactcattggaggtaattttatcaaactcaaaaccacacagcgtctctagaaaatgttcaaggatatcagatacttatataatagagttgtctggtgtgtcttcttttttctgttaccagcttttcctattggacagttgattgcaaaccatcctgaaacagtaggatattacaccttttacatattgaattacatattgaatattgaattacatatgaattgaattacatgcatttttgtcttcaacttaaagaacactaaactgtagttaagcttattggaggaaggatttgaaatcattaagtcatgaatatatgatgttgatgtctgctctgggacattttaccaagtgtgttatatgtcatagccaacatgtaattaaaaaaaaaaaacgtagagatttgtgaatcagagtcctctgttcaaataccagcccttccacttagccacacaatctttggtaggttacttcatcttcttgagactgggtttcttcatctgtatatgcatatgaagcacctgagtgctttttaaatgtttagtaattgtgttctataagtgtacatgtaagttatgaaacttagttttgaaatctaaaacttaacaactcagatgcgaaatctttccaatgtttaacttttgaactgtctctttcatctgatttgtagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgtaagtacctttacttaagaaataaagatacttttgcagggtattcttccaataaatattttaaattgcttgattatttcatacctttcatggtttatagctgtacaagagcctgtacatctgattcttcttactctgaggtacctttttgttaatgtttggtttgtaaatgttaaggtactctatatttttttccttatttttctgtgagttcctctccatattctctccagtgtcctcttgtactgtttttccgtctatataccttatacatcttcttttgcatttcatttctgaaaatgtctgggcctgttttcattgcagacatatatacttatataacaactaagtcattgctgcttaacaaggtctctgagttgtggtatggggttagcaagagtgcattgttgtattgggacgattgttggaaagatggccccagtgattacagtatgttgctttttttcttttttctttcttttttttttttttttgagatggattctcgctctgtagcccaaagtggagtgcagtggcctgatcttggttcaccacaacctctgcctctggggctcaagcaattctcgtgcctcagcctcccgagtagctgggactacaggtgtgttccaccatgcctggctaattttttgtattttagtagagacaggtttttaccatgttgcccagggtggtctcaaactcctgagctcaggcgatccgcccaccttggcctcccaaagtgctgggattacaggcgtgagccaccatgcccagcctacaatatgtttcttattagtaaaatacatttgtgactataagatttcaaaaaatgaagatgttgctatatgagggaaatgtcatgcttaaaaaataaagtgtggcttttgcatatgacaggatcctcttaagttagataaatttcttttctcttcttttttttttttttgagacagagtctcactctgtcagccaggccggagtgcagtggcatgatctcagctcattgcatcctccacctcccgggttcaagcagttctcctgcctcagcctcccaagtagctgggactgcaggtgcccacgaccacacccggctaatttttttttgtttttagtttattgtttttgagatagggtctcgctctgtcacctagggtggagtgcagcagcacaatctcggctcactgcaacctccatctcccgggttcaggcgattctcctgcctcagcctcctgagtagcttgggactacaggcacccgccaccacgtccagctaatttttgtatttttagtagagacagagtttcactgtgttggccaggctggtctggaactcctgacctcgtgatcctcccgcgtcggtctcccaaagtgctaggattacaggggtgagccaccacacttggcaataaatttctttaaaactcatttataatgctggatatatatataaaagaatgtatgtaatatatatgtaaagtataaagcataaagtaaatctatcactcatctgaagagatagaacactatcaattctgttaagccacttatatgtttcttccaatttcctctacccaatttaggatagcataaccactattctaaattttgtatttttcatttacttgctttttaaaatatcttaccagatatgtatgtattcataaacaatttattatttaatactgcttgtttttgaagttataaaagttgcacactgtagacttcttggatttccttttttaaaatttaattcaacatgcttataaaatgcatccatgttacaggaagctgtggttcatttatttttactgctgtataagattccaggctggacacagaagctcacgcctgtaatcccaatgctttgggaagctaaggcggaaggactgcttgaggccagaagttcaagaccagcttgggcaacatagcaagactgcatatctacaaaagtttttttttttttttttaatttgcctggttggtggtggtatgcctgtagtcctagcttcttgggaggcagaggcaagaggatcgcttgagcccaggagtttgggattgtagtgagctatgatcgtgccactgtactccagcttaggcaacagagcaagactctgtctctaaagattttttttaaaaaaaagatcccagcatttgaaaaggccacatttaatgtctgtcttctcctggcgatagacatttgaattgtttccgttgtcagatgagtcttcctcctgctttcttgtactgcctggatcccaggtcagattacatggcagaagttattaggttatcgggatggagcaataagattaccagatctacattatcactggctcctatatttaagaggaaatataagcacacatttgagcatcgggctgaaggatgtagttttaaggctgggttctgtgacagatggacctgttttgccttcatgctgacaccctaaatgaagtcttttatttagtaatgtattccaaatacagagattgacccagattcaggaagtaatttattttggggtttctcaagttttgaacttaatacagcctgatcctcagttcctatctccagacccttatatccaactgcatatgtttctccaaacagatccctcctctgtggcatctcaaattctaaatgaacaaaattgaattcattatttccatctccaaatgtgcaccttcatcttcccaagtcaccagccagaaaccctggaggtattttaggctcttccctcctttcacttcttggtgtccaatcagtcaacacgtattatggcttctatttctttcttttttttttttttttttggagacagagtcttgctgtgtcgcccaggctggaccctgggttcaagcaattctcctgcctcactcagcctcccaagtagctgggactacaggcacacaccgccacacttggctagttttttgtatttttagtagagatgaggtttcaccgtgtgcccagtctggtcttgaactcctgagttcaggcaatcctcttgccttggcctcccaaagtgctaggattacaggcagctttcatttcttaaatgtctcaaacttgcctccctactccatcttctagtagtacatttactagcagaggttaagcatccctaatctgaaaatttgaaatctgaaatactccaaaatcttaaactttttgagcgccaacatggccacaagtggaaaatttacacataaatacttaacacaactttgtttaatgcatatcatttaaaatattgtataaaattatgttcaggctatgtgtataaaacgtatatggaacataatttcacgtttacacttgggtcccatccccaaaatattatattatgtatatgcagacattccaaaatctgaaaaaatccaaactccaaaacacttctgatcctaaactgtttgggcaagagatactcaacctatactatcatttgatttcaagctgcctttctttctgggacaaacttgtagtctatctgggttccctgtccccaaagtgacctttttttttctttgagacagggatctctttctggcacccaggctggagtgcagtggcccgatcacagcccactgcagccttaacctcctgggctcaagcgattctcccatttcagcctcgtgagtagttgggactacaggcacgtgccgccacacccagctaatttttgtattttttgtagcgacggagttttgccatgttgcttaggctggtctcgaactcctgggctcaaacgatctgcccaccttggcctcccaaagtactgggactgcaggtgctagccactgtgcacagcccaaagtgatctttctaaaagcagatctgttcatgtctctccagtacttaaaactcataaaactcagtggcttccccattattttcaggatgaagtacagactcattattatagcataatggtaaactgtcatggtcttctctcagcttatatggccagcattatctcactgtactttgctacaccctgtgccacagccagactgaatttattgcactttctagaatggaccacattctttcatgcttacaatttttgcacatgctatttcctctctctagaatgtctcatttcccctttcactcctgcattcctctgacagactcttgtgcatcttaagactcagctcatgtgttacttccagcaaactcccttgacctgaccttctcctctggcagccccctaccctttacccctcctggctgtttggtgccttgtcttctgctaacctctgtaatagcacctgctgtactgcattattattgatgatttgcttgtttgtctcttccactgaactgggagtttcatgaaagacaataaagtgtagcccttaggaactcaggtcaggttatagagtcatatctgctctattattattatgtgactttgggcaaatttcttcatttttccttgccttatttttcacatctataaaatggggataggaactgtatctacctttattaaagtatgtgtgtcaaggatccccaagatcatccccagatttaattattcactaggaggactcacaagactcaccatatagttttactcactgctatcatttattacagtgaaaggatctaaaacagactcagcaaagggaaaaggtgcatggggaaaagcttggaggaaacaggtgcaagcttccaagattcttctcccagtggaattacataggacatgctccattctcccagcaatgagttgtgacaacacatgtaaaatgtctaccagggaagctcattagagactcagtgtccaggctttttattggggactggtcatgtgaacaccctctgcctactatgtatcaaaattccagaatccaggccaggcagggtggctcacacctgtaatcccagcactttgggggaccaaggcagatggatcagttgaggtcaggaatttgagaccagcctggccaacatggcgaaaccctgtctctactaaaaatacaaatattagctgagcatggtgacacacacctgtagtcccagctactcaggaggcaggagaatctcttgaacccaagaggcagaggttacagtgagccaacattgtaccactgcactccagcctgggtgacagagcgagactctgtctaaataaataaataaataaataaataatccagactccagaaggaaaccaggtattcagcataaacccatatttttgcacaaacattttaggcacaatgagccattcttaacagaatgatgggaaccctcccaaaatctaagttcccagatgccagccaaggaccaaccttaaaagcaggcctttctaaggataacagtctgaggcctgtaatgtcagttcttctgcgtagaatctaaagcacttagcatggcgtctggctctaagcatttcataattagcttctgttgctgctgctgctgttattttggataggagctctttgtttcaccactattcctagtgcttagcacagtagtgagacataggatgtctcctatgtctcactaacagtaataatcataacagcttcttatactgctagtggtgtggtctgaatgtatgtctccaaaaattgatatgttgaaacctaatcactagagtgatggaatgaggaggtgaatcgtctccgagatgattagctcatgagggaggaaccctcatgaatgagattagtgctcttacaaaagaggccccagaaagctgccttgccccttccaccatgtgagggcacagctagaaggtgtcatgtatgaaccagaaagtgggtcttcactagacaccaaatctgctggcaccttaattttggacttcctaggctccagaactgtgagaaatacatttctgttgtttataagtcacacattctatggcatttcattatagcactcaaacagactaagacaactagtaatagatgacacatattaaagctaatatgtgccaggctgtgttttagggatttgacaagtattgatttacttaatcctcatcacagctctgtgaggcaaatgctgtttgttatcacagattgcaaatgaggaaaccagtgcacagagaagttgagtaatgagcctaagttcttacagctcgtaagtggtaaagctgcaacctgaagcaaggttttctgacaccagagactctcctcttaactgtccactgtcctgactctcagtacatattggatgggcaagtggctggacatgtagatgaatatttgaggtgaattattgaataatctttaaaaacattttggggatacaatgggaaacatgattaaggactggatgttagtattttttgttaggaatgataatcatatgttgcctatgaagagaaatagccttaatttttggagtatttaggatgaaatgccatgatgtctgttatttaaattacttcagaaaaataaaaattgatgaagcaaataagggaaagcatcagcaattgtgaaagtagatggagagcattatttagaccaatctctctccctttctatattttgaaaaattgtataatgaaaagtaaaagagattttaaaaactgagttattagcaattgcaagcagtgcctatagcaatagtagtattcatttattttaaaataatctggtttgttggggaaaaatgtatgcctcattaatatattggtttgttgaatgcatattatctgctgaagtctatgatgcaagttagagttttagattgatatccgtttgtttcatagatgaagatactgaaactttatcaatatcggtgaaagattcgtagtcatagaccagcttttgatccctaaagaacccccgccttctttatcccaggactttacttttggaaagataaagtgatttttttatcatggcaaatatagtttttgtattatatacttgctgtaataatggatctatttactattatttatttcagtagcatgcgtacacataaaattgatctgtttagcatctcctctctccttcactttataagaggaagaaagcgttgcttccactttccaggtagagaaactaggcccagcttttcagtgattacaattaattaaagtgtaaccaaacctaaaataagacttgtcactttctggctcagtattgtggtctcacacatatatgaatacgaccttccttgtgtctacctcaacaggcttccgatggaagcagctccagagaagatctttcatcccagcttctgagaaggaatgaacagatacggaagttagaggccagactttctggtatgtctaagaactcataaaaagcaaacaacaggaaacttgccttgcttgactctcttcctataaaatagccatataggatgactttatagttattttcacatatcattttgatctttttagaaaggagcaagtataccctcttcttttgttagtgtagtaaatagtataaattcaaaactgaatttgaaagtttattaaaaaattttttctgctcctgaggtttctagccatggaaataaaagataataataatatatgtacaatagatttgaccatcttccaccattagcatagcctgctttcaggtggaaagggatggcgttagtatttaaagggaatggccgacagatattggattcatcagcaccagagattggtgctgtgttgccacttcctgcagctcataccacctgtgtaagtgttgttgtaggtctttgggccacttttcaatggtatttctgacttcagcacctgcatagaaggtgtcactctcattatgtcttttgtctgcagtttacaatttacacagctcccattatatcctttgcctgaggagggcatggtcatgatagaattgtgagttattattttggtttctgccagtggatacatttggaaagcttcatcctgtaaagtggttcatggcttctgtgtctctttttgtcccttggccttttaatgcccattttattggagtaaaacagcagaccgaagttcaccaagtggtatgtgaaatatttatatttgtgtagctatcagacccaaattcaccaaattgtatgtgaagtatttgtatttatgtagttatcaaaggttcatagcatagctcacaactaccagttaattattttgtcctcactagagccttattaggcttagcaaggttaaggcctcacaagtagtaagtggtagagctgggatccaaacccagatttatttgatgctagagtcttaattccatctgccttaaacttaattgttgctatcctgttactcctacccataaataatatcagtaacagaggtaaagtaattttacatttgtttaatgttggagagagagttataaaataatatatataccttccccatatggtaggaagaatagttgagcttgacttacgttagagaagggacagggaagagcactgacatttactgggcccactatgtggtgagtattgtcctacagtattagtatgagtaatgataatagtcacagtaacaataagagctacattttattgagcactgtgtgcaaagcacttaaggcacgtaaaatgttttatctaatgcatcttttgtggtaggtacaattaatatcatcatttaatatatgaagaaactaatactacaggaccaataatttgcttaaggtccccagctaaggactgacagagttgggatttgagctactatgttttcactaaaccataactatcttctttggccacctagataattaattctgacattcacatttaatgtagcgtaggttaccaagttcctgtgtagaaagggagctcacttttttagagaattaagtgctatcactataaagacaatgctgcacctaaggtgtttgttattgccctaactactgttcctgagttgtgtggactataagcgagctgtttagtgagttcactttgatctatcctactgctaagaccggaaaaggaagtggaaactgagatttgaaattaagtcatgagataaatctgtgtttttcatagcaggacatttctgatcaccaggctaagcctaattcttgtttttctatcaaggctaaacaaacttgcctttttgtactcaccatttatacaccatggatagtttgtactatacttgttttcctgtgttgttcattgttaatgggaggctgtctgtctagctttccttaacaggaatggttttcaggttaagaaaatcatcatcatttccattcatttttttgtttaattaacttcctttcctgatgtttgtccatttctggtatgtgcgtcaccctcctcacccaagactatgctgaacaggtccgaaacttgcagaagataaaagagaagcttgaaattgcattagaaaaacaccaggattgtacgtatttttttcctgcttttttcaatcttttcaaggtttagtttttgaaatgaaacaatagtgtatggttaagtttgtccttcttcaaagcacaaatctttattttataagtagtgtacttcttaatcaggttgatataacatttggatgatatttataagtatgcaagttttatttatgttggcttatgggcatgactcttaggagtaggtcattatgtgtatcagcttgtctctatccagttgacccctttatttaggctaccctcaggttttaataaaatctagtacccatcccttaggtctggattaggaaatgggttctcaccacagcttcattactgctgtgttgagtaactgggagaaatccctgtcatcactccctcagcaataaatcatacattttgtgtagtctaccctcaatcatatattctttgggtaccatccaagaaagatgttagtagaagtagaaagttattttttttgttgatatgtactaaaacttttaaggaaaataaagtaaaagaaaggttttttgtttgttttgatttttctttttgtttttaattctgataaagtggtagtagccatcacttagcatcagctttgatgttttctggcaacctacctaactcagtgttctatcattgtaccatttaaaaagttaccttttggcatctttgtaaatatatatacttgtctattacaaaaaacaaaaacgataaggaaacaaacaaaaactgtggtctattaccaaggccaaaatattcttctggaaagttgaggtggatccagcttttcctagtatcacaatccacttatgtgactttggcctttttcattaggtgacagttgtaatcacatgggctatttgtcatgctgtttctgaagtgttttcatatctcaaatagagcctctttgttaacagcttccatgcggaaatttcaagagcagaatgagacattccaagccaacagagccaaaatggcagaaggactggctttggcattagccagaaaggaccaggtattttatatgtggcactgcccagaactggtggaaagatttcacttagtgacgtgatttcaaaaatcatgacataacctatagaaaatatttatagcctaggagaagagaaatgttaaaagttcgttaaggttttctttggccttttcttgtaaagtgaagaaactttacagttctaatcatgaaatgtgtccagaatgtgagagtatcattccttgtatctgtgtagtttcataaaattgagaagggaaatagtgtatctgtaatctgatggcaggccccaaaataagagaaaaggtctctcccctctaaaaacctctctgaaagtctaacccccaaacatttgccttttatcctggagaagatgttattaacttagtcataatccatagtatacagagttcttccaacctctgttcccacgtttcttcaatcccaaccagcaggacagaggggaaatcctataatctcagcagaaccaaccactggaagatgctgaatgaataaccacaaggaaggaaaataattctgttactggctattacagtaattatgaagtatattttgttcaaaataatagatgacattttaaatttaagataagcatcaatatattataatgttaattttgatttattaagacagagtttattatgtttcacttaagaaattgtataatttatttcatctggaggaggtgggttggttggttggttttaaagtgtctgttcatcatctaggacatttactagccagaaaaaatacaatttaccaatacttagtggataactgtggtatgaatgtatataaatgaagaaataatctaaaattgatggattctgattataggcaatcaggatattgcctttgtgcaaatgggctttttttcccactattttatggtttgtgaataaggggcataattctttttcttttgacttacacagatggcataaagcatgttggtaaaatcaaaatgaaaaggaaaatgattatcagggactgcaaaagatcccccctactcccccagtttcaggaattaatttctaaacatcatttccagaattactcaactcagctggtcccagctacccactcccaagaaataacagtactcatggcaaaactcccaggaacaagccaaaaagctgcatcagaacagcagatacagcttttcttgggtgccctgcttagtaaaaatctgcaggcttatattcatgaattcattccattctagaatcttagataaagttcattttcttctatttttgtgactcttgcctttcttaatattaaaccaagtttatagatttttttttaattggcttttttgttttgtttggttagttgctttctgggaagagttgggttgttttgttttctgaaaatcttggtattacagatactcttcactggaaaccatacttttttattgttttgttttaggaatggtcagaaaagatggatcagcttgaaaaggttagttcatctttatttttgtctcatttttgttggtctcgtctctggggtatggaaaacgttttatccggtaaccaacatactgattgctataccacctcttggaagcaggacagtttatgattagatactgacttgaaaagctctgatcctccccttttttggtgaatgtgcaggatgtcttttgtttgcccctcttgatatactctgcactcctcctctcttccctttctctgtgtacctgaacgccgatagaaactgtatcagcagggctcagaatgccctctggcatccggttgggttcagccagtggggaaccctgaaagaaccatgtgtgaaagaagatgtggtcaggatgtttcttcccccacctttctccatgtgggctctcttcagcttagttgcatcccatggccaaagtcacagcttcagttggacctttggtttgccttcttgacatagtttttgtctctctgggtttcctataacctcttcatctttttgcctctttatggccaactgttgccagcacattatcttttgggctatcttacccatcccacagctttgataagcccctttattaaaccatcctcaaaatgcctgatttgagatggccgtctctttcctgctgcggttctgattgacacgtggtaatattaggaacacttaaagatgaagcagtggggaaggaaggcatttctcaaggctcagcattgaacatatatgagaacctcttggctagatgtagatgaggaaattgattattctagtaccattgcttgcataacaccgtacaggtaccttaagtaatatattcctggctcccacatataaacgagatgaaatttcaagtctacaattggaaaaacattttagttttaaaataatcattagtgtcaactattttttttccataaaacaccaagttaactttactttctgttctatagaaatctgattatcaagctgagagaatacattaactttttttgagacaaggggttgttctgttgcccaggctgggagtggcacaatcacagctcagtgcagcctcaacctcctgggctcaaatgattttcccacctagacttcctgagtagccaggactgcaggcttgagccacagtgcccagctaatttttaaaaaaattttaatagagatgaggtctcactgtgttgcccaggctggttttgaactcctagaccaaagtgatcctcctgcctggcctcccaaagtgctaggattacagtcgtgagccactgtgcctggcaacagttttatataaggaaagaattatagaaaagtcaagtcccaaggaaacctgtgcttgaaaaaaaaaaaaaaaatcctcaaccatatgctattaatgacagtcttcttaaatatggagatatgggttgggttaaggttttcttgctgtaaaagaaactcttaagattatggcaattgaaattctcattgaactgtttttttatcttttaaaattttggtaaagggtatccatataggactgaaccaactaaaaaacctacttaggttcacaaggttcacaaagggaattttctctttgttttgtttttgttcttttgaaggagaggttggggaaaatttttcttttttttttttgagacggagtcttgctctgtcgcccaggctggagtacagtggcatgatcttggctcactgcaagctctgcctcccgggtttactccattctcctgcctcagcctcccaagtagctgggactacaggcacccgccaccacacctggctaatttttttatatttttagtagagacagggtttcactgtgttagccaggatggtctcgatctcctgacctcgtgatctgtctgcctcggcctcccaaagtgctgggattacaggtgtgagaggttggggaaattttctagagtaggaaatagtaatgagacacctatataggtcttcgaagctacttttcatcgttaaagttttttttttttttttcagtcaagagttagaaactgtaacagaagggttagtccttaagagagtccttttttctttttttctttttttttttttttgagacagggtctcaccacgatgcccaggctggagtgtagtgcagtggcacagtcatagctcactgcagcctcgacttctcaggctcaggtgattctcccacctcagcctcctgagtagctgggattacaagcacatgccaccatgcctggctaatttttttgtattttttatagagatggggtttcaccatgttgcgcaggctggtctccaactcctgtgctcaaccgataggcccaccttggcctcccaaagtgctgggattagaggcaagagtccactgctagaaatgatcatttaataaattgtaacctgctgacaccagtcatgtctaatttttttttcttttttttagcttgttaactgaaatcagttctacttttaatctacgtgcatttaatttttttcaggcattcaatcttactggttactcatgtttttcagccagttcagtgtgtcactaagaatagacatgtaaaataaggctgggcacagtggcttacgcctgtaatcccagcactttgggaagcagaggtgggtggatcacctgaagtcaggagttcgagaccagcctggcaaacatggtgaaacctcatctctgctaaaagtagaaaaattagccgggcatggtggtgcatgcctgtagtctcaggtactcaggaagctgaggcatgaaaatcacttcaacctgggaggcagaggatgcagtaagctgagatctcaccactgcaaaccaacctgggcaacagagtgagactctgtgtcaaaaaacaaacaacaacgacgaaagagtagacacataaaatatatatctggacttgctaaacagatgtaagaactttaaagttctacataggccatgcacgatggctcatatctatcaacactttgagaggctgaggcaggagaatgtcttgaggccaggagttcaagatcagcctggataacagagcaagatcctgtctctaccaaaaaaaaaaaaaagttctacgtaattgttgcttttattcccctttttcacaattatttaaaacacatttatttttaaataaagaattaaattctctagttaaaggattaattcaattaaagaatttgtaaataatgccatatttctgtaatgctttccattatcaatgcatcattgtccactggcatgagatttcctgaagatttttcctttattaagaattccactttcaggccgggtgtggtggctcatgtctgtaatcttagcactttgggaggccaaggcgggaggattgcatgagcccaggagttcaaggccagcctgggcaactagtgagactctgtctctaaagacaaaaattttaaaaaagaaaagattttcactttcgtaatacagatttctaatgctttcgttgcctgagttgatgtcttcttctttcaaataggagaaaaatattctgacagcccagttacaggaaatgaagaaccagagtatgaatcttttccaaaggagagatgaaatggatgaattagaggggttccagcagcaggaactaagtaaaataaagcacatggtatgcatttttgttttagtagctaaatactgaatagatgattattcactctgattttactagtcatcactctctaattgctgataaacatacaccagtaatatgtgatattaatcatatttgatattaatcatatttgtatgtttttaaatttattaaaatagaaaagttctgtttaaaatgttctttttctgttttgttttgggttttgttttgttttgttttgttttgtttttaactactgggtatataaattctcttataagcccacaaaaatgttatagaaatttggctattggtccacatttttttttttaaatagatggagtctcacggtgttgcccaggctggagtataatggctactcacaggtgcgatcatagcacactgcagcctcaaattcgtgggctcaagctgtcctcccactttagcctcccaagtaactggaactgtaagcatgtactgtaggtgtgtgccaccatgcctgacaagcttagatttttttttttctttcctttctttctttctttttttttttttttttgagatagagtctcactctgtcacccaagctggagtgcagtggcatgatcatggcccactgcagcctcgacctcccagactcaagggattcttccacctaagcctcccgagtagctgggactacaggcgcactaccatgcccggctaatttttgtattttttgtagaggtggtgtttcgccatgttacccaggctgctctcaaactcctgggcttaaacgatatgcatgcctcaacctcccaaaatggtgggattacaggcgtgagccaccgtatccagccgagatttaagtgtatttttcttttttacttcttttttttttttgagatggagcctagctctgtcacccaggctggagtgcagtggcgcgatcttggctaattgcaacctccacctcccgggttcaagtgattctcccgcctcagcctcccgagtagctgggattacaggcacccgccaccacgcccggctaatgtttgtatttttagtagagatagggttttgccatgtcagcaaggctggtctcaaactcctgacctcaagtgatccacctgcctcagcctcccaaagtgttgggattacaggcgtgagccagcatgcctgatcttaagtgtatttttcttagcatagcccaatgaaactttgtatttttgtgtcagcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagaggttcttgcttggtctgtggggcccttgggaagaggtgttagtgtagttctggctatagcctgcccacctttccccattgttcattacaccactttctgattccggtgctggcaaaggcttctggacacatccttacctgcctaggactcaggcctcaccctacctccaacccattttccccttcagctgctgaaactcaggacagttccaccctgctgaacaattcagtgtggttttagtttgtaaagtattaatagactaaggaaaggcaggtcaggatttctttcttaaactagggtggactttttctctttgggctcctgcttcagagagagccgaggctttttccgttgaaaacctgcatgtggctaatgatgcttgtagccctgacacagaagaaaccatttgtatttttcctgcagaagactgtatattagatgagatatccaaatttgttcattgtctgctttcttttgatgaagagatcatgtgatagcttcaaaaacaggtgcagaaagtaagatcacagccctggaacaaaaggaacaagagctccaagcactcattcagcagctttccattgatttgcaaaaggtaagtagaatatgaggagaagacctggatttctaagattcataaaaactaattctttcagaaatttctgcctgagagtagctactgaacatacatttctcatgcagtccacatggctccatttcctgtactagccaggctgcactcagatggaaatggccatacagctgaacaagggttgcttagcagaagtagtcagtattttcctgtcaggaattctcaaagtacaccatttggtcgactcaaatatgtctctcttttttttttttttttctttttttttgggacagagtcttgctcttgtcgcccaggtattataggcgcccgccaccacacccggctaatttttgtatttttagtagagacagggttttaccatgttggccaggctggtctcaaactcctgacctcgtgatccaccaacctcggcctcccaaagtgctgagattacaggcgtgagccaccgtgcctggcctgactcaaatatgtctttaagcacataatggaccttgagcatgaaaaatacaatagtggctgacatgaccagggctgtacctttgacatacttggctctaatccagtttgttttatggcacgtaatcaaatgatgtcattacaatttgttttttcatttcattgacatacatttgtttctacattagggctgtgctacactctgagaatataaagatgaatgataatatttttgaatataaagtagtgtttctcaggcccagcacagtgactcaagcctgtagtcctagcactttggtaggccaaggcaggaggatcacatgaggtcctcctcttgaccccatctctaccaaaaaaaaaaaaaaaaattagccagttgtggtggtgtgcacctgtagttccagctgtttgggaggctatggtgggagaatcgcttaagcccaggaattcaaggctgcagtgggccatgaccatatcacagcactgtagcccaggcaatagagcaagactatctttaaaaataaaaataaggctgggtgtggtggcgtgcacctgtaattccagtacttgggaggctgaggcaggagattcggttaaacctgggaggtggaggttgcaagtgagctgagattgtgccactgcgctgcagcctgcctgggtgacagagagagactctgtcttaaaaaaataataaaataaataaataaataaataaatataaataaaataaagtagtatttcccaatgacataatttattattggcattttgagcagaacaactcgtattgtatgattgtccattgcattgcgcgacatttagcattcctggcctctgggttctgaatgccaatagcatccttcagtcattgacatccagcccttcccctcacatcacagaaccaccccctattcggcagtgccatccaccctaccctcatctttcagaattgctgatctcaagtgagacagagccttacaacataattacagtacagtaagattttgtcaatagaggtcttagctaagtattatcatacttacagatacctaagtggaaactaagaggttattgaccttgttcacagttataaccgtaagtgacagagttggattctaacccaagtcttactccagaactcatgcttattctactgcactttgctgcctcacaataaggagcacccagtaaatatatacgtgaatgaatgactgtgatacaggctttttaccctcaatgaactaaaaatctcaatacagacattgttttccttcagaggcttacagtttcattatagaactcaaacctactgtaatcacaagaaaagaaatgctcaaacaagaagtctcaagtaagtgaactaggtttttcttttttcttttcttttttttcttttttttgagacacggtcttgctctttcacccaggctggagtgcagtgacgtcaacggctcactgcagcctcagcctcccaggctgaagtgatccttccacctcagcctcccaaatagctgggactacagacacatgccactacaacaggctaatttttttttattattattatctgtagagatggggtttcgctatgttgcccaggctggtctcgaactcctgggctcaagcaatccacccgcctcagcctcccaaagtgctgggattacagaggtgaaccaccacactcagccctagatttttcaaatacaaaagatataccataggggaagtacattccagcccaggagtcaaggaaatcttcctagaggaactggaatgtcaaggatcaggaggacagcaggaggcagaaaaggcagaaggtcagagagtacatttggggtcatggaagaagggggaaaatagatacacaactttggtttttgtattattttgtttttttctgagacagggtctcactttgtcacctaggctggagtgcaatggcgtgatcttggctcactgcaacctccacctcctaggctcaagcaatcctcccacctcagcctcctgaatagcagggactacaggcaccaaccgggctaatttttgtatttttagtagagacaggatttcaccatgttggccaggctggtcttgaactcctggcatcaagtgatctgcccacctcggccctcaaagtgctgggattacaggcacctggccacaactttgatagtcaagggaccctttgatgtcaattagaaccatctgttgtttttataattggaaaaatggggctcagggaagtccagactttggtcacagtaagtttcttcattcattctaaaaatattagttgagctttactatgtgctgggctctgtgctgggtgttcataatattatggtgagcaaaatagatacagttcttgcctttgtggtgcttatagtctagaagggaagtcagacattaatcagtaatcacatatataattactaaccgtgatgagtgttctgaaagaaaactacgagatttagtgagatcctattaaaagatatcagatcagggctgggcttggtggcttacgcctgcagtcccagcactttgggaggccgaggcaggtggatcacctgaggttgggagttcgagaccagcttgaccaacatggagaaaccctgtctctactaaaaatacaaaattagctgggcatggtggcacacacctgtaatcccagctacttgggaggctgaggcaggagaatcgcttgaacccaggaggtggaggttgcagtgagccgagattgcaccattgcactccagcctgggcaaaaagagcgaaactccgtctcaaaaaaaaaatatatatatatatcagatcagatccagttggagccgtagaacacttaaggaagtaacactcgatacagtgctcaggctggagagaaagggatgatgggagagaatttcaagcagggaacagcatgaacaaaaactctgaggcaaataaaaggattagcacattcaaggaactagaagaaagccagtgacatacagaataagagagaataacagattactctggccgttaggagactgagagggtcttccacttaggaagcttttgcagttgttcgaccgtaagatgatggaggctttgacaagtgtggtggtgaagataataatgggtagacaaatgtaagaactattgaagagattgacagacttactaatgtaatagatatgggaggacaggaagagaaaagtctgtatttttatgggtgatttatgggcttctggcttgggcaaaagaagggctggtattgtgtgaagattgtaaatttggaatttgtttttttcttgtctttattgagtatatataaaaacatatttataaaatatgagtatgatagaaagtataataaggcaatgagccctctgagctatccctcaggttaagaaaaagaacaatgtgtttatctttgaggttccctctgtgcccttcactattccatcccattcctttttcctttggaagtaagtactatttggagattgcttcattgtctactttgctttctaatgttgtcagttttatccctaaactatcttctttagtttcccatgcttgttaatgttatataaatcattctgtaggtatttttctaaacttactttttgtgctcaacattgcactcctgaaaaacattcatatgatacctggagctataatttattttttctcaattatatagtaatatagtagggacataccaaaattttaatttttgtcgatggtgggttttttttttgttttcgtttttttttttttttttttttttttgggtgtcagggtctcactctgtcacccaggctggagtgcaatggtgcaatcatggctcactgcagcctcaaattcctgggtgtaagtgatcctcctacttcagcctcccatatatctgggactacaggcttacactaccacacctggctaattaaaaaaaaatttttttatagttaaggtctcactatgttgcccaggctagttttgaattccaggacacaagcaatcctcctgcctcagcctcccaaagtcctgggattacaggcatgagccactttgcctggcttgtgaagatttttaattactgaatagatttccttaatggtaattctaagtttatgtatttcttcctaagttttgttaatttatatttttctacataattgttcatttgctataagtttaatgttttggcattgtatttcttatattctttttttagttgctcccctatcttcattcatagtagtatttatgcattttctatttttttctagtttattcttaccagatgtctgtcagtttggaaacaaaattttactttaattcttttcattttgtttttatttaacccacagtgttcagaattacacattttttactctactggatagcagttcctcaactgtagccattatctttcaacttcccaatttatgttcttcctaacctgtattgtacttaacacaatattttcatggaattcaccttacttttttttttttacttaaataagtatatttatgtatttatttatttatttatttatttatttatttagagatacagtcttgctctgttgcccaggctggagtgcagtggtgtgatcttggctcactgcagcctccacctcccaggttcaagtgattctcctgcctcagcatcccgagtagctgggactataggcacatgccaccatgcccagctaatttttgtatttttagaagagacagggtttcaccatattggtcaggctggtcttgaactcctgacctcttgatctgcctgcctcggactcccaaagtgctaggattacacacgtgagccaccacgccctgccatttattttattttatctatctatttatttatttttgagacagagttttgctcttgatgcccaggctggagtgcagtggcgcgatgttggctcactgcaacctcaaccttttttgttttcaatttttttacttttgtagagaaaagatctccctgtgttacctgggctggttttgatctcctggctttaagcaagcctcctgcctcggcctctcacagtgctgggattacaaacataagccactggtctcagcaccataaatacatttataatgaaggaaaaaaaggcatgttgggagaaccaaaaggatagacaagtggttaacgcttagaaaggaagtggaaacggtgctagatgaggctgggaaggtatgcagggccagttgtatagactaaatagtgaacatgaaatttcataaataatcattagtgaatatttaacaagaatagctgagcatttaccctgagctcagtattcaagagctttacagatagggactcatcgagtcctcacaactaccctttggttagacagtgttttcctattttacaggtgatagtaatgggcatctgacatcaaaggctaaatgatttgtcaagaccgtacagctggagtcaatgacagagccaggattcagactcatgtctgtctgaatcaagtgaccaccacccagaattgatgcagtccatattctgggactataactgtgagacccagactcgggagggagtaggtgaagagggtgatcattaggaaaggggcaggtttgatgtcagggagtatggcttggtaactgttcccgtagtccacatgaggtgtagagggcctgaagtaaatcagccagcctggagaaggagatcgcatatcagtatgttgcacaagaggcataagtggaacttggccactgattctttttctgtccctaactttgcctaacacagtgacctgtgtaagatgtgttgttttggttttaactggaatgggtcatctatacctcttgaattcagattgatgtgtaggggaacaaatgcagactttggatccagaagacctggatttaaattcttcatctatcgctaataggtatatgcctttgggctagtccctaagcttcagtttccttgtaaatggatgtgataaagagcatttgtaaggactagacataataggaagtgcttgcagcgttcccttgaccctatatgtctgtctttacgctattaccacactgtcttggtcattgtcactttagagttgaaatcaggtaatgttctccaactcttacatcaacagttactctttttctttcctttttttttttctttgagacggagtgtcgctcctcgctcaggctggagtgcagtggcgcgatcttggctcactgcaagctccgcctcccaggttcacgccgttctcccgcctcagcctcctgagtagctgggactacaggcgcctgccaccacgtccggctaattttgtttttgtatttttagtagagatggggtttcaccgtgttagccaggatggtctcgatctcctgacctcgtgatctgcccacctcagcttcccaaagtgctgggattacaggcgtgagccaccacgcccagcctacagttattctttttcaagattgctgcagcaatcttgttatagctgcttctgctatattacagttataactattgctagtattaacattagtaataagagacccataaagatgggtcaacatggccaaaactggctttttttttcctatcacactcactcactttcctgtgttatccaccttgcataatgttaccatttgcccaggtgtctgagccacagacctgagagttgtgttcagctgttctttcctcctcacccagcctctagccttgcaggacttgtctgttacctctttgtatgtgctgccctttatgcagaatgattgttcctcttccaccctctttcacctggacttgcccattcaggaggcctgatctgattctcccagttaatccctcttgcatctcatatctcatagcacggtgtgtgtccctctgttgaagcacagttgttttgtaattagttgtgtgtctgtctccaccaccagcctccatgctggaattaatgttgattgtatcctcagaaaacaacagatagagttcaggcttgatgaaagtttattgaattgtggggtcataaatctagtcttcagacttcccctccactatctctgttgtccacctgtgagaattcagaatggcaaatacttcttcccaaaaccatacaccctggttgctgcatcttatcctgaggagagatcggccaagttacaactgaacatgaaagtttatggcttgaaatggagcaacggaagtgtaagataagggaatttgagggaacagagtacatgtaaagaggtacaagtcttcacagtgagattttgttgccctacaaccttttctggggaagaatgggcatcctcagtggggatgtaagaactcatgtattcaaagcttcctggatcctctgctttgacattgagcagtgatatggttaggctccgtgtctcatctcaaattgtaatgcccacatgtcaagggagggacctggtgggaggtgatcggatcatggaggcagatttctcctttgctgttcttgtgatagtgagtgagttctcatgagagctgatggttttacagtatggcacttcccccctcgctcgcttgctctatcctgccaccgtgtaagatgtaccttgcttccccttctccttctgccatgcttgtaagtttcctgaggcctcccagccatgtggaactgtgagtcaattaaatctctttcctttataaattactcagtctcaggtattctttatagcagtgtgagaatggactaatacaagcagcagttgaagattagtagcagtaaaaggaaccaagttagtcccaacctgttgctaccaccactaccatcatagctaaagagatagactggccaggcacagtggcttacgcctgtaatcctagcactttgggaggccgaggctagtggatcatgaggacaggagattgagaccatcctggccaatatggtgaaaccccgtctctactaaaaatacaaaaaattagccgggtgtggtggtgggcgcctgtagtcccagctactcgggaggctgaggcaggagaatggcgtaaacccaggaggtggatgttgcagtgagccgagatcgcgccactgtactccagccaaggcaacagagcgacactccgtctcaaaaaaccaaaaataatagattgaaataaaacgggcagctgttggtctaaagccaaggtatgagaagcatggcagctctgctgtggtccctgtcctgtgagccaggtgaatctcatcatttcagaagttctctctttagccttaaagccactacatcagcactgttactgctttatccagcccctcagctttcaggagcattgttccataggtcattgcaggctgagtgcttcttggtgggattagttctgctgcctctaccacgtaggtaatgcctttgttccagactgtcagttgtttaattgggaagagtgtttgcttcttgctgcactaggtctgagctggatccctgagttttgccaggttctaatcttgcattttctgtatcccattttcaggaagatctcttagctgtttgttcttctaggatacagttgaggacagagttgcaggaaaatgtgatggcccaaaagaaagcaggaaggaaggaagagagggcttctagtatagagtgatctctgctttcacctgcaggtcactgctgaaactcaagagaaagaagacgttatcacacatttgcaagagaaggttgcatccttggagaagagactagaacagaacttatcaggagaagaacacgtgcaagaactcctgaaagaggtaacttctgttctctttgggctggctggtgttggaaaggcagggttgattctggtgacttcacaattcctagagtttcagagctgtagggccagcaaacagcatggtaacaaaagaagtgtctccaactttggcttgtcctgcttacatcagaaagagccttatgtcccctgtgggtgacatgcttttctcagggaaagggagagctgtattcagagatacatacaaacggatagcatctcatcaccaataaaccacacctagtgatttccgccacttgggctgccttgtctttctgcactgccctcttccccaccattttgtactctgcagtggccaaggtaaatagctacatctgccccttggcaaaagcaagaattaccttgggcagcattctctccttcccaagggaggctgttgtgcagactggcctcttccccagtggtgcaagggaactttctcatcaggctgagctcattgtctgcacacattctgctcttccctctctttctgttccagtgattggccacactgtgacaaaggtgacaaagcccaggtcatgaggctcctagattagaccctccctttctttcttcagtcagtttcaactaaatacctccatctccagtgccactggttgtacttcagggtttccagcaaatctagcctagtctatgttagaagtctccagattggcctacccagcatcagtctctcttccttcactctctgacacagtctcccacgctcactgccaaactgatcctcctaatcagcactggtgaccatatcactctcttaaacatcttctacaattcccttcaacagtctacaggaagtgtaatgtgggttctagggaataaattgatttctagaatcagaatgtccatgcttgcattttgcctcttctgcttaccagctttgacttggagcagcagttcccaacccttttggcaccagggactggtttcgtggaagacagtttttccacagatggggtcaggttgggtcgggtgagggggtggtttcagaataaaactgttccacctcagatcatcatcgtccctagattctcataaggagtgtgcaacctggatccctcacttgcacagttcacaatagggttcatgctcctatgaaaatctaacaccaccactgatgtgactggaggcagatcttaggtggtagtgcttactcaccactcacctcctgctgtgcggcctggttcctaacagactgcaaggtctgtggcccaagggttggggacccctgacttagagcaagtaatttaatctctttgtgtttgcttcctccccaataaaattggttttattatactattaaactcagaattgttgttagggttaaataagttacaatatgtgaagtgcttagaatgataaccggaacagagtagggtctcaatgtatgtcagctgtaaacatgatcaatattattattgtgccatcatcattattataatgtttaatgtgcatagaaattacttgggaagtttgtttaaagtatatatctctaggccaggcgtggtggctcacgcctgtaatcccagcactttgggtagccgaggcgggcagatcacctgaggtcaggagttcaagaccagcctggccaacatggcaaaaccccgcctctattaaaaatacaaaaattaggccaggcgcggtggctcacacctataatcccagcactttgggaggccgaggcgggcggatcacaagatcaggagatcgagaccatcctggccaacatggtgaaagcccgtctctactaaaaatacaaaaattagctgggcgtggtggcacatgcctgtagtcccaagctactccggaggctgagggaggagaattgcttgaacctgggaggttgcagtgagctgagatcatgccactgcactcctgcctggtgacagagcgagactctgtctcaaaaaaataaataaataaataaattagctgggcatggtggcgggtgcctgtaattctagctactcaggaggctgaagcaagagaatcacttgaacccaggaggcggaggttgcagtgagccaagatcgcaccactactttccagcctgagcgacaagagtgaaattccatctcaaaaataataaataagtaaataaagtatatatctctggccctaccctcagaaattctgatttccttaggcttggagcaaggcctcaaatctgtgcaactagctgagattaacaactatctcagtaacagctatctcagctaagtctacatttctttttttttttttttttttgagacggagtctcactctgttgcccaggctagagtgcagtggcgtgatctcggctcactgcaacctctgcttcccggggttcaagtgattttcctgcctcagcatcccgagtagctgggactacaggtgcacaccaccacatccagctaatttttttgtatttttagtagagacagggcttcaccatgttggtcaggctggtctcgaacttctgacctcgtgatctgtccacgtcggcttcccaaagtgctgggattacaggcgtgaaccaccgctcccagccccatttttttttttaagacagagtctcactctgtcacccaggctggagttcagtggtacaatctctgctcactgcaactccgcttcctgggttcaagtaattctcctgcctcaacctcccaagtagctgggattacaggtacccaccaccacatccagctaatttttaaaatatttttagtagagatgggatttcaccacgttagccaggctggtctcgaactcctgacctaaagtgatctgcctgcctcagcctcccaaagttctgggattacaggtgtgagccaccacacccggcctagaatttctactttgaaaaatgttgcttacagaatcaagttctaactcctttttgcaacattcaaaagcttctcatgagctggcccttttgcctatctttctagtcttgttttttgacctaaacccatcatcattttggcttctgaggagtagtagttccctcaacgtagcaggctgttcacatagccgttggtcatccccctgcctgggaggctccctgaaccctaacgactttgtgagttctaaagctgcctacctgccctgtggcagggagtatctcccaccctgtgcttcttcctctttgtggacacttactgtactctattgtgtaattttttattagtcttttgttccagcctcaaggtcaagggactatttcaaatttatctgtgtgtactttatgatatgtgaattatttctcaattagctgaattattaaaaatgtattcatgtctcttgtgcctagcacaagtcacaatatgttgtagataatctgtaaatatttattcaactgaggaatgatagtcttcttttactcttctttcaacttacagaaaacacttgctgagcagaatttggaggataccagacaacagctcttggcagccagaagcagccaggctaaggccattaacaccctggagactcgggtactgaccttactcctggtgtttcctaagtttgggtggtaacctggctgaatggcaacatggtgtgactgagaatcttcttggtcagagttttttcactagaagggattatttttggatcttacctatacagggatgagttagtcattttcttcatccttgtcacattactatgattgagttatatgtttatttatacccttttatccccattggcctccctcccataggataccattccgttgtggttcatatagatgctctttttgttgggttgccttaaaatatgtagcactgggtttttaatttctgtaaatgatgcagctatgggtatgttttctctattacttttagctgcctcaacttctgtctgtacccacttcattgtactttgtagttatctatgtggtagacatccagattgcttccttcttcctgccacctcagatcatgcataaaacctaaagagactaagtactataggagaagattgttcccagcaagcctgcacctggctctcctcctccagcatgcatgagcgttcctatatatgcctttctgacttttccagcattggcatttccaagcctttacaatttttgccagtttactgagtgtggagtggtatttcattgctttaatttgcattgctatggtgattaatgagtttggccttgtcttcatgtgcctgttaattcctgggggtttctgcttttggaattgcccattcatatcctttccttattttctttgggggtttcagtcttttcttatttggtttgtaggatttcattgtatattcttgttcctaatgctttatcagtttcagtcctgagtcattctgttaactttgtccatgtatcctttgttgaatagactttcttaagttcagtgttaccagattcatcacatttttgctgtggagtttgaagttccatttagaaaatctattcctgttcctaagtcacagagatctactgttttttccctattaactttataatttttccttcacataataaatctctaattcacttacaaactgtctttctgtatggtcttaggtagggatctaaatatggagaaattctgcatatttctcaaaatcatttactaaacagtctgtcctttctgaattgattcctcttgctaactttatcacgtattgtttccgtctgcacatgggtttgtctctgcattctctgtccattggtctgattgtctgctcttgtgtaaacactacaatgtttttattactatagtgatatctgtactatatctcaacacccaataagacaaattctctttttttttcaaaggttgactttaactatttatgggcctttaaaatttttaagtttttgagttactaaaaaattcaacttgaatttttattgggattgcattaaatgtataggctaattgggaaaaattgtccattttataatattaattattccttctaacaatgtaaatatattccatttattcagattattttctgtgtgttttattaaaattttacatttttctcaatagatgtcttattttcttgcctaagttgctaattcctagaaactttagagtttgtgttgatactgtgatggtatcttttttttcttttgagacagagttttgctcttgtcacccaggctggagtgcaatggcacaatctcggctcactgcaacctccacctctcgggttcaagcgattctcctgcttcagcctgccgagtagctgggattacaggtgtccagcatcacgcccagctaatttttttatatttttagtagagacagggtttcatcatgttggccaggctggtctcaaactcctgacctcagatgatccgcctgccttggcctcccaaagtgctgggtttataggcgtgagccaccgcgcccggcctgtgatggtatcttatttttaatctttctttttttttgagatggagtctcactctgtcgcccaggctggagtgcagtggcactatcttggctcactgcagcctctgcctcctgggttccagcgattctcctgcctcagcctcccaagtagctgggattacaggcacgtgccaccacgctaagctaatttttatgtatttagtagagacagggtttcaccatgttgaggctggtctcaaactcctgaccttaggtgatccgcctgccttggcctcccaaagtgctaggattataggcatgacccactgcgccaggcccttatttatttatttatttatttatttatttatttatttatttattttttggagacacagtctcactctatcccccaggctagagtgcaatagtgccatctcggctccctgcaacctccgcctcccaggttgaagcaattcttctgcgtcagccttctgagtagctggaattacaggcacgtgccaccacgcccgactaatttttgtatttttagcagagacggggttttgtcatgttggccaggctggtctcgaactcctgacctcagcctcggcctcccaaagtgctggaattacaggcacgagccaccacacccgaactttatttttaatcatatttataattggttatttctggttattctagagaactgccattttttaaagttgatcttggatatcacacccctgctgaactttcttactctactactgtgtgatttttttgttgtttttcttaggtagataatcatattatctatgaaaaaatgacaactttatcttactccttccaatcttcccacctcttattccattttctgttcatatagcattaaagacctccagactgagtgaagcaataaaagggttagtgggaatctttgttttgttcccagtcttaaaggaaatatgcctaaagtttcattatttggtgtaacatttgcaggtttttggtatgtatgtatttatttatttatttatttgaggcagagtctcactctcatccaggctggagtgcagtggcatgatctcggctcactgcaacctccgcttcccaggttcaaacaattctcctgcctcacccacccaagtagctgggttaaaagatgcctgcctccacgcctggctaatttttatatttttagtagagacggggtttcactatgttggccaggctggtctcaaactcctgacctcaagtgatccacccatctcagcctcccaaagtactgggaatacagcaccatatatttatttatttatttatttttattttattttattattattttttgagatggactcccgctgtatcacccaagctgtagtgtagtgtcctgatctcagcctaccacaacctccgcctcccaggcacaagcgattctcctgcctcaacctcccaaagagctggaattatgggtgtgtaccaccacacccggctcatttttttttttgtatttttttaatttattttattttatttatttttttttttttgagacagagtctggctctgtagcctgggttggcgtccagtggtgcaatcttggctcactgctctctctgcctcctgtgtcctggttcaagcagttctcctgcctcagcctcccaagtagctgggattacaggcatgtgaccatgcccagctaatttttgtatttttggtagagacaaggtttcaccatgttggccaggctggtcttgaactcctgacctcgtgatccacctgcctcagcatcccaaagtggtaggattacaggcgtgagccactgcgcccagcctttttgtatttttagtggagacggggtttcaccatgttggccaggctggtctcaaactcctgacctcaagtgatctgcccacctcagcttcccaaagtgctgggattacagatgtgagtaactgtgctggccaatttgtttaatttcttgaattgaatatttatctcatttttaaaatctttcttatttcctgataaatacattttaaactatatttttctgaaaagactgttttattataatttcaattctgtttctgaatatcctttttgatcagtgtacattgtcgtacaaccatcaccaccatccatctccaaaactttttcatcttcccaaacagaaactctatacttattaaacagtaactccccaattcctcctaccccagtctgggaaccaccattctattttctgtctctttgagtttggacactctagatacctcctgttggtggaatcatacaatgtttgtccttttgtgtctggcttatttgacttagtatatacatcttcagtgttcatctatgttgtagcatatgtcagactttcattccttttttttttttaacagaattttttttttttttagaatttttttgagatggagtcttgctccgtcatcaggctggagtgcagtggcacgatctcggctcactgcaacctccgcttcctaggttcaagcaattcccctacctcagcctcccgagtagctgggactacaggcgcgcgcctacaggcacgctccaccacgcctggctaattttttgcattttagtagagatggggtttcaccatgttgaccaagatggtctcaatctcctgaccttgtgacccgcccacctcggcctcccaaagtgctgggattacaggtatgagccactgtgcctggcctattcctttttaagactgaataatattccattatatgtatagaccacattttgtttctccattcattcattgatgaacacttgaattccatttgtcttttttttttttttttttttttggtctttttctcccctttttgtggagaacagggtctccctatgttgcccaggcaggtctccaattcctgggctcaagctatacctttgtttccctaagtgcttggcttgcaggcacgagcccccgttctgtaagcccagtacttagggaggcaaaggcatagcttttttttttttagacaaaatctcgctctgttgcccaggctggagtgcagtggtgcgatcttggctcactgcaacccccaccccgcaggtttaagcagtttttgtgcctaagccttctgagtagctgggactacacatatagaccaccacgccttgtatttttagcagagatagggttttgccatgttggccaggctggtctcgaactcctggcctcaagtgatccacccgtcttggccttccaaaatgctgggattacaggcataagccaccgcacccaacccacacccagcttttgatggacatttgcgttgtttctatcttttggctgttgtgaataatgctaccatgaacgttcctgtacaaggtttttgtgtggacttagtgttttcatttctcttcagtgtatacctaggaataaaattgcagggtgatatggtaactttttctttaatctcttgaagatctgaatctatcttgaacttggcttctaaattgagacttaggtattttctgatctcaggagtgtaaaacaacgtcttagttttggcgctaccaccaataaaatttgcagtcatgagctagtaacaatcctgttcttctccgtggactagtagcccctttctcatgggattgtttcggttaaatctaagatgtgaatgtatgtgaggagcctaggccttaaaaacgtcctctccttggctggacacggtggctcatgcctgtaatcccagcactttgggaggctgaggcgggcggatcacaaggtcaggagatcgagaccatcctggctaacacggtgaaaccctgtctctactaaaaatacaaaaaattagctgggcatggtggcaggcgcctgtagtcccagctactcaggaggctgaggcaggaaaatggcgtgaacccaggaggcggcggagctttcagtgagccgagatcgcgccactgcactcaagcctgggcgacagagcaagactgtctcaaaaagaaaaaaaatcctctccttgtgtgtctacctctccttcaccaagctgcatacagccttccttgtgcttatgtttaataataaagctccccagctgggcgcggtgaatcacacctgtaatcccagcactttgggaggccaaggcaggcggatcatgaggtcaggagatcgagaccatcctggctaacacagtgaaaccccgtctctactaaaaaatagaaaaaattagctgggtatggtggcagttgcctgtagtcccagctactcaggaggctgaggcaggagaatggcgtgaacccgggaggtggagcttgcagtgagccgagatcatgccactgcactccagcctgggcgacagagcgagactccgtctcaaaaataataataataataataaagctccccaaggccagaccttattcagtaaataagaaggctttctaagagaaattcatagatgtagcttgaatctggtaaaactgccatcttggagagccaagtgcaactcagtactagacagtgagtccctgagggccagtctacatctgtcccactcacggcactggcctcgtgcccaggtgcagttcctggtatggagtcagtcttgctcagtatttgtggaatgagtaaatcctgaatttgtattgtgaacagtaattccacttcaaggaatctgtcctaaggaagtgattcaaaccagttaaaaaaatactgtgtgtcctggccaacatggtgaaaccccgtctctattaaaaatacaaaaattagcaaccaggtgcggtggctcatgcctgtaattgcagcactttgggaggccgaggtgggcggatcacgaggtcagcagatcgagaccatcctggctaacatggtgaaaccctgtctgtactaaaaatacaaaacattagctgggtgtggtggcatgtgcctgtagtcccagctactcaggaggctgaggtaggagaatcacttgaacccaggaggtggaggttacagtgagccaagattgcactactgcacgccagcctgggcaacagagtgagactccatctcaaaaaaaaaaaaaaaaatagctgggcgtggtggcatgcgcttgtagtcctagctacccaggaggctgaggcaggagaatcgcttgaacccagcaggcggaggttgcagtgagctgagatcacgccactgcactccagcctgatgacagagtgacactccatctcaaaaaaaaaaaaaaaaataggccgggcatggtggctcacgcctgtagccccagcactttgggaggctaaggcaggtggatcacgaggtcaggagatcaagaccatcctggctagcacagtgaaaccctgtctgtactaaaaatacaaaaaattagctgggcatggtagcgggcacctgtagtcccagctactcagaaggctgagggaggagaatgacgtgaacccaggaggcggagcttgcagtgagtggagatcatgccactgcactccagcctgggcgacagagcaagactccgtctcaaaaaaaaaaaaaaaaaaatactgtgtgaagatgttaattgctgcattcttttagatgggaaaaacagaaagcctaagtaggcagcacagtaggcaaatgggtcagtaaattacaaaacactctagaggaaataataatctgaggtctaaagattacatggagacagaaggacatttaagagtagggaaaagatacaaagttttacattgtcctattaaaactttatataaagctataaacaaaagtcattaaaagagagtttaagaaaatacgttagaatgctagtgttttataatggtagacttatgcagtatcttttttctcaggttacatttttctataatgtacctgttttatttaaatcgctttgcattttaaagccatttgttaccactcttcagcttcttgtgaacagaaagaatgcttctgcttccctctcaggtgagagaactggagcagaccttgcaggcctctgaggagcagctccaacagagcaagggcattgtggctgcccaggaaactcagatacaggagctcgtaagtgcttattggagctgctgcattccaggcccttaatgctttctctccaggcctttgcagatgctccaaactcattccgaacttcggcaacggtacctggacctgcccatagatacagttcttgtgctggatgtgagcaggccagcagcagggggtggagggagtcaggacctaatggtcggcctgagttacctgggaggtgcaccagcagctcctttccaccttacatcccaccttctggtccagcctggtcctggggctgtcagaggtggcagctccgctaggagtcaagcctcaacttgcaatcaggggcggggagaacaagtccagactctggggaggatggcctgtgatgacaggccaagcgtggtgtggagttagaagatagggaaatcaaaccagccagcgtgtatttcatattcgccatgtcccaggcactgtgctcagtgctatgcacgtgttttcgtttagtccttgcaggagacctgagaattatgcactgtcatcctcatcctgtagacgaggcaagctcagaaagattggctcagtagcccacaggctcgcagccagtaaatggcagaatccacatctttctcctgtcaaagccctgttcttcattgctgtattatactgcctccccagtataatttctccccagggaaagccgcagccactgaggcaacactgagtagtgtgaaggaggcctgtgtctaagggctggctggtgcccagagctgtccccacacaccttgaggatggagtgatgacatcaagactccatcttctggacaggccagggtccaggagcaacaggcagagcctgcaggggggacctcagcaacgccaggggggatggggtcaggagagagttgtttctgttggatactcatcttctcacctagggccagactaagatcccccactggaaaccattgtcaccctgactgaccgtcctttggtctccccgcaggctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatggtgagtgaagagctaagagagggtgggcccaggagcaccagggtcccccacagcgaagtcagcctcgtgcttgacagtgtggcaccgcctctgcactaggaaaccactttagaaggcagctttttttttgtttgagacagggtctcactctgtcacccaggctggagcacagtggcatgattacaactgactgcagcctcgacctctcagactcaagtgatcctgccacctcagcctcccaagtagctgggactacaggcgtgcaccaccacagccagctaatttttaaattttttggagagacaaggtctcactgtgttgcccaggctggtcttgaacgcctaggctcaagggatctgcccacctcagcctcccaaagtgctggaattataggcatgagccaccgcacccagccgagagcagttcttatctttccagagacacctgctcatgagactggatgtataaaggctgctttttataaaacaaaacagatgggttttctttttccttggagtttccacagagacttcctactttctgaccagtcccctctgcttcttcccattggcttttaaaatgtatattgttcctccctatgccttcttcctggtccatgctccctgtgcccagggaaatatggtagtgaagacttcttttatatgtgttcttctgaattggcagagacaactggagcaagaaaatgcagcccttaaagaatgcaggaatgaatatgaacgttctttacaaaatcaccaatttgaactaaagaagctgaaggtatttatctaattgaatcaaagtttcataaaagtgttcatgttttctacatgtgtatttacagtgccccacttctcatacttacagtacaggaggaggagaattagcatttgttcaatagttctgttaggcatcggccagaaattgccacttcattaagttctctcagggatccaggacagtaggaagaattacattcatttggcagttaatgtcattgaggttccgagggtaaaccgtttgtgcaagttgcatagttggttagaggtgatgctggtctgacttcaccctaccacagaggccagcccttcctctgtggaatcaacagctgcttgaaagtcatgctgtcaaaacactgctcttgctgatatttccagggagaccttaaagcaaggccttaaaagatgataaggacctttgttttgcttgtttatatcagggaccatgtacagaaatgaagaaacaatctgctggattgttaaactttctcttctgcaaacttggagctttaatcagaggatgcctctttcattccctaaacataactggataaaaaggaggaaagattctgtcactttcttatatgcccccagactcccgtggcccctttcaaagcaccttggataatgggacattgtagtacttgcccagcttggtcatgactcaaagatcttattgatcccttggcagcagtcttctctgagagtgtccatagatgaatgcctgcacctagtaagcttccagtaatcagatctgatgagtgacataggtactaatgtagtagcattgcatcatgagaagcatggactttggagtcagatttttttttcatgcattccttcaataaacatttgagtcctgtaagtgccaggcatcactgtaagtgctaggatgtattaaatagcaatgagccagtgcggtggctcacgcctctaatcctagcactttgagaggccagggtgggtggatcacctgaggtcagaagttcgagaccagcctggccaacatggtaaaaccccatctctactaaaaattcaacaattagcctggtgtggtggtgtgcgcctataatcccaactgggaggctgaggcaggagatttacttgaacccgggaggtggaggctgcagtgagccaagatcatgccactgcactccagcctgggtgacagagtgagactccgtcccaaaaagtaaataaataaaataaaataaatagcagtggaaaaaataggtaaagttcctttcttgtggagtttgtaactagagatggtaaccaagttacaaattaacaataaatgctatgaagaaaatagagcagggcaaggacagccaatggggaggtgggagaggagaggtctcttttccatatggagttagggaaggctttgatgctggcagaagggcctacaatgtgaatatttgaggaggaatattctagactgaagaaataacaaatacaaaggctctgaggcaggaaaaagcctagtctgttcaaagaatagcacagaggccagtgtggctgcagctagtggccaggggagagcatggctggtggtgaggcgggacacaggcattaaaaagaatcatgggaagccctggcaggtctttttttttttgagacagggtcttgctctgttgcccaggctggagtgcagtggtgtgatcacagctcactgcagcctcaacttcccaggctcaagcaatcctcccacctcagcctcatgaataactaggactacaggtgtgcaaaatttattaatttttcttttgtagagacagggtcttgctatgttaactaggctgattttaaactcctgtgctcaagcgatccactggccttggcctcccaaagtgctgggattacaggaatgagccactgctcctaaccagctatggcaggtcttaagcagataagtgatgtgagaagttttgttttaaaaggatttctctggctgcctgtgaagaatgtttggtaagggaggcatgagcagaagcaagaagactgtttaggagactttttaggaatctaggccagaagtgactagcacattagtggtggacttgggaagaagtattcagatcaggatttattttagagatagagctgttttgtttgctttttgttttttgtatgtgagacggagtctcactttgtcgcccaggctggtgtgtagtggaacgatcttggcctactgttacctcaacctcctgggttcaagcagttctcatgccccacctcccaagtagctgggactacaggcacgtgccaccatgcctggctaatttttgtatttttggtagagacagggtttcaccatactggccaggctggtctcgaactcctgacctcaagtgatccacctgcgttggcctcccaaagtgctgggattacaggcgtgagccaccatgccctgcctgagatggagcttttaggacttaggaatgagaaaaaaataggaattgtagatgacacctaggtttggtttgtataactcagagtttctccacctcagcgctattgacgtttgaggccggatggttctctgttgtagaggttctctgttgtggatggttctctgttgtggatggttctctgttatagagggtctctgttgtggagggtctctgttgtggatggttctctgttgtgggtgggtctctgttgtgggtgggtctctgttgtggagggttctctgttgtggagggttctctgttgtggagggttctctgttgtggagggtctctgttggggatggttctctgttgtggaggctctctgttgtggaggttctctgttgtggaggatctctgttgtggatggttctgtgttgtggagggttctgtgttgtggagggttctctgttgtggagggtctctgttgtggatggttctctgtcgtggaggctctctgtcgtggaggctccctgtcgtggaggctctctgtcgtggagggtctctgtcgtgggtggttctttgttgtggagggtctctgttgtggatggttctctgttgtggatgggtctctgttgtggagggttctctgttgtggatgggtctctgttgtggatgggtctctgttgtggagggtctctgttgtggatggttctctgttttggatgggtctctgttgtggaggttctctgttgtggaagttctttgttgtatttgctgcaaatatgcatgataagatgcttaggagcatctacccactagatgtcagtagcagccccacttaggacaaccacagtgtctccagacattgccaaatgtctcgtgggggcaaaagcactgctggcagagaaccactggggtaactgaatgaatagggtacgtaccattcactgagatgggggtcctgggaggtatgtcaagagtggattccattttgggcatgttgagcttcagaggcctacccaacaggcatatctagtagtctgtaggctgacaagtctggaaaattggagcagattctgagtagacatataaattaggaagcctgtgtgcctatagttccagctgcttgggagcccaggaggcggagcttgcagtgtgcaagatcgtaccactgcactccagcctggatgacagagcaagaacctatttcaaacacacacacacacacacacacacacacacacaaaactttaaattaggaaaccatcaatcagcatagctcataggcaaaattacagccaaatggctatcaatgagtgcagatagaaaagaggccaaaatgaaggccagggccacacccacaagcacaggctcagaacaaaaggaggggccgacagagaagacgccaaaggagccgcaggtagggtagcagtaaaagcaggtgcatgtggggctctggaagtacagggcagaaagcgctacaagaaggattgagtagtgaactctgtgatatgctgccaactggtcaagaaaggagacaaagagctgaccattagatttgacgagactgagtttgttggcaacgctgggaagaatagtcaccgtagagtcgtagggaatatggttgacgagagcaggttaaaatgagactagagagatgcttccacttgcagtaaaggcaaactaggtaattcagaccagctcacctgaggactcccagaaaaactggccaaaataagagaacatctgcttgtaggagcctacaggactgaggaatggcccatcctgcccagggacgggagtccagcatgcaaagcagcttttgccgtggtggtatctgctgatcctgaagaggctggaagtttatctaagtttttcatagtttctcagagttaggggaataaaatttggagtttaaattttattaaagcttggatccagcctgggagatcctgaaagctttggttaggcacaccacaggactacacgctaggagtaagcttgaacgggaagtaaccagcaccccatctgcaccccgcccccagctttgattgcactaactgaaggacacggggtggcccaggaaaagcccattagctaattttggattaaaatgatcccaggttattagtgctcctgggtgactagaaaaaacaaaatcaaagataggtaaacaaaaatacaaaacaacacaaaagaaacagactcacaagggctcagatatcatatgcttactatgtttaaggagataaaagacaaaatttaaaatttcagcaagatgtggaatagttctattattatagttatgataaaagacagcagttttaaaaaaggaatcaaatagaactttagacctgaaaaatagaataactgaaattaatacaataaattacaaaaggacaggaggaagctttctgggggatgggtatttttactatttttattagggtgatggtttcatcacagttcatcaaggcatacacctgtagtcccagctactcaggagactggggcaggacgctctcttgagcctagaaggtcgaggctgcagtgagctatcatcacaaactggactgcagcctgggtgatagagcaagaacccatttccaaaaacataaaaatttaaatgtaaacatatagaaaactcttatatgtttacatttaagaaatacactttcttttttttttttttttgagatggaatttctctcctgttgcccaggctggagtgcaatggcgtgatctcggctcactgcaacctccgcctcctgggttcaagcgattctcctgccttagcctcctgagtagctgggatcacaggcatgcaccaccacactaggctaattttgtgttttcagtagagatggggtttctccatgttggtcaggctggtctcgaactctcaacctcaggtgatccgtccacttttgcctcccaaagtgctgggattacaggcgtgagccaccatgcccagcctgaaatacactttcaaataacccataggtcaaagaaaaaaatcacaatggaaattttaaaatattttgaaataaagttgggcacagtggctcacacagtgagctgagattgtgccattgcactccagcctgggtgacaagagcaaaactctgtctcaaaaaaataattataatattttgaaataaatgattttgtaaatactgtggatcaaaattggtcaagtataactaaagcagtgcatggaaggaaatttcagtctcagtggcatctcttaggaagaaagcctgaaaattgagccatgtatgcatctcaaaaagtcagaagaaggcacaaatcaaactcaaggaagaaataacaaatataagcacagaaattaatgaaatagaaaataaaatgggcccggcgtggtggctcacccctgtaatcccagcactttgggaggccaaagcggatggatcacatgaggtcaggaattcaagaccagcctgaccaacatggtgaaagtccatctctactaaaaatacaaaaattagctgggcatagtggcacatgcctgtaatcccagctacctgggaggctgaggcaggagaattgtttgaacccgggagtcagagattgcagtgagctgagatcgtgccattgcactccagcctgggcaacaaaaatgaaactctgtctcaggaatgaagtgaagaagggagggagggaggctgggcgcagtggctcaaaccagtaatcccagcattttgggaggccaaggcaggtagatcacctaaggtcaggagtttgagaccagcctggccaacatggcgaaacccggtctctactaaaaatacaaaaattagctgggtgtggtggcacatgcctgtagtcccagctactcgggagggggaggcaggagaatcgtctgaacccaggaggcagaggttgcagtgagctgagattgcgccattgcactccagcctgggaaacaagagagaagctccatctcaaaaaagaaaaaaaaaaacaaaagaatgggaccctctcatagtagcgaggactgctgaagcctgaggtggattatttgaaggtgaataaaatcgctaagctctgggtgagacagatcaaggccatatttagtttaacagtctacttgttccatcagctactaagaagggtgtgctcagtcttccactacgatggtagatttgtctctttcttcctttagttctgtctgtctttgcttcatgtattttgaagtgctgctattaggtgcacatacatttagaattgtttttctccatccacgctcttcaaagcagctgttccctaagcccatcctggagaatcatcgcagaggcagccgtgcatgggtggcctggtggcttctgcaagctgcaggccctgctttgtgccacagtgaacctgagcaggcactgtcaaccccacctcccacagtgctggatcttacgtggctctgaggcgctagggcagactttggagccacagagactcagttctgtcttgtcagcctagcccctcactagctgatgcttgaaggaatccattttcctgcagccttgacctcccggacacaagcaatcctctcgcctcggcctcctgagtagctggcactacaggcatgtgacaccatgctcggctaatttttcttattgtttatagagacagatcctcactgtgttacccaggatggccttgaactcctgggttcaagcgatcctcccacctcagcctcctgaagtgctgggattattggtgtgagccaccgtccctggtcattacttcttcttctttccataaccaattgttccagtcccccactccattcacgtggcctgcgagtctgacttcttgttcttggctactgtccttagaccagctcttcaggataggcccctagccttggtgtgggtcctggcgggggtgctcgtggggcaatcgatcctcagtggtgtgccatttccagagaagtcggtgggttgcctgccaggatagctctgagagggatactgagggcatggcagggaggggccaggctgggagcctgggaagtggggagcatgttggtctggctctgcaaagccatgccctgtctgctgggcttcttgcgtggcatacagctaaaaaactgtgaactaagttttggggctcagtggttttctgcattgtaggaagaatggagccaaagagaaattgtgagcgtggccatggctcaagccctggaggaggtgcggaagcaaagggaagagttccagcaacaggtgggccctgtttcacgctgaggggcgatgtccccctgcagtcccacaggcagcaggcccatcctgccgtgagactgttggagagggcctgtctctccagggtagggtagtagactcaggactcagggaatgcagtcagctgcgtgggcccctgtgctctctaggaagctgggagacaaatgttataaagaaactcttaccccataggatgcccttttctgatttttcaactataattacctggaaagtggtccatgtccacgggcctagtgggctctaattctgtgaggtgacctatcattgcccacctgccccagaggccacgtaaggttgggttgagtttttgcaggaagtatgggaaagcctcccttgaaggtagactttgcatctgaccccagagcttctagttaagtggctttaggcctttggtaagtccttaacaaatctgagtctcctctgatgaggactctagccttctacttacacctctgggaaactattctgtaatgaggcaacatatatcaaatgcgtgtctagtgctggggatgttgcaggcactcaggaaatggaagttatgacagcttgttgggctgggcagaatggccacgtctctggttgacccactgttggccagggggcagtgggaggcgactgcccctgtgcagggcccctaccaaggagaatagatttgtgcatgttcataggagcagagcttagctgggggtttgctctgggtcgtggacttcagggagggattcgtggtgtaccctggagagcggggaagtggagatttctgtgggaagatggagtcactgctcacaaccttccctcttgttgatttttctctccaaggcagctaacctgacagccataatagacgagaaggaacagaatctgcgggaaaaaaccgaagtgcttctccagaaagagcaggagattctccagctggagcgaggtgaggagtcggtccctggctgagccttctctccttttcaggcccagcatcctgccttgtgacggccttgccaccaagcagcatggagtcactgggctcacagtgccccctcccctcctccccgacctaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtaagtcccagctgcacctgcatgggtgctacagcaagatgcagggcaggtgccgagagtgcccctaaggaggcagcagtggggacacatggtggacacgacgctcccctgcatgtagggtcctttctttgaagtagggcacttggccaggcgcagtggctcacgcctgtattcccagcactttgggaggccgaggcgggtggatcacgagttcaggagatcgagaccatcctggctaacacggtgaaacccagtctctactaaaaatacaaaaaattagctaggcgtggtggcgagtgcctgtagtcccagctactcgggaggctgaggcaggagaatgatgtgaacccgggaggcggagcttggtggagccgagattgcgccactgcactccagcctgggtgacagagcaagactccgtctcaataaataaataaatagataaataaataaagtagggcactcatatggctaggaggccatgagtcctgaagagcccatcacagatggcacccctgtcggtaggcaggggagagcaagccccttcatcccagcaaagactagtcgtgtgattagttgtgggcattgggcattggatcttctccaggaattgcttcctggccagttgcctgttggagcacaacgcccatacctaagggacgagtctagctccccttccctgtgtacctgtggctcagcttcacctgacctgtcctggctctcaatttgctgctgccaccttgtaggtgacctcgagggccatgcaggaccctgtgttccagcttccaactgcaggaagaacaccaaatggtgaggttggggccatggatctcacacagctacagaaggagaaacaggacttggagcagcaacttctggagaaaaataaggtgaggatgccttttgcatggctgtttctgtctccaccaggtcctcaccctcaggcctaaaatgacccagtccatccttggaggtttttgtggtttcccccgcacctcctggcaaccatgacccctctcacccaaaggccttcctcctgatcttccgttcctcctgcactgtcctcctccacaccctccccagccctcttctccccacccgctggagaactggacaagtgtcaggcttgggcagctgcaagcctgcatgttccctgccagctctgctgtccccagccaggccatagcgacagtcctctttcgtctatacttcctttctacagctgtggaagtaaagcactgatagctgcctttaagggtttgtttgggtgggaggagggggttatgaaatgaaggtatttgtgaaccgtcctataaactttataaactctctggtatttggtagaggctcaataaatgtcatggtccccacccttcaccctccagcctttccacctatataaatgcaggatctcatttaatcctggttcttaaagtgtcctgtgaagcttagtgtgccagccggctattgctctggcctgacattctgcccccaaattgtgtgtgtgtttgtgtgtgtgagtgcacgtgtgtgtgtgtgtttagatcttttacaagggggaaagtgttcattatgtctaatataaaatacagaagctttgcagcagtggcagtatcgtagccaatgaggtctatccgaggcgcgattattgctaattgaaaaaaaaaatacacacaggaaagtgtacaaaacaaatgtgtgtctcagtgaattaacagaaagcagacccatgtaaccaccccgatgcgaatcaggatattgccagcatcccagaagcccagccccctgagcccctcccagccctgtcagtcactccgatcccagcccttctggcaatgactgccttgcttttttccctagtgtcacctcagctcgcattgctcaaccccacagtttcgttttgcctgtttgcaaatttcccgtttgtcccctaggacctccgtcccttgagcctctggccttaccagctgtgctgccttcctgcctccttgttcagcgtcgggtctgtgtctgtcacgggatcactgccttcccgacacctgcggtcctctggcctctctccctttcctcagactgtcctagccaagctctggttaaacttgggctaaacccaactcttccctgctccctgcctgcagccatggaggcagacctggctggagagtgccatcacctgggcattcaggtcccctcgaagctcaggaccatggtcctgcgggcagcccagtgttccccgcaaccccacctcatccgtgggccttcacgcccctctgcccctaaccccaacttcatgtctaccttctctcctctcttcacctcaaccctgcctcacccaccctggtgctcccacctcctgcttctctgagaagggacgtgccacagcctctcctcatatcctgttcccccacctccccaagcactacgccagccgcctcccccttcttgcctaggtcgttttttcttggaatcgtcccatctactgagaggtgcgccgttgtgcaggcaccttatgaaagccctcggcttgcacccctttgccctgctgctgcgtctctgctcacctgccgtgctgacatgttaaaacttcctatatctgccatctccattcccactcctcttctctctcaacctttcctccaccactccacagaaaaacactcttgtcaagctcatcagtaacatctgcactgctaaatccagaaggcagttcctaattttccctctgattggcctgttggcagccttggacaggcgtctcttcctcctcctgaagctcccatccatggcctgctccttctccgtctcctctgacaggccagtctccttcccactgccacccgccgtgcacaagggcagccctcacagctcttctctgcactgtgcgccctcctctgcgatctcagccatgccctgcgcagctgactcccctccctacctcccgcccagacagctccacggacactagcctcacaaacctgtctccacatgagctctaaggtgtctgaaactcaaaacatcggaaaacacacttcggcttcactgtgttccctggctgccatgccacctttcccatctcagtagacggcaaaagccttggagttgtcctatctgccttggttctttctctaccagcatccaggctgttagcagattccttcagcacccccttcacacatttcccagaatccaccacttcacatcgctgccacctgcttcaggttaccattgtctcttctctggaagatggtatcagacttctaactggtttccctggcactcttgtcttagccctctgatgaaagcctgtctctgttgatctcttatgaaagcctgagtccttgcagaggcccgcaaagccctgtgtggtgtggcccctcattacccctgccagctgagcccctcctgtcctcgtcactccctctcagccacaggggcctcactcccatcaagtaccctccaacctcagggccttggcacttgctgagccttccgtttggaagtgcctttccctggtcatcctcactttctttatgccaccctgaccagcctcaccaccagaaccccaccctccctcaccatgctgcctcttctccatgcctcttcataccctctgatacactgtggatttgattattgatttcttttttttttttttttgagacagagtctccccctgtcacccagactggagtgcaatggcgtgatcttggctcactgcgacctctgcctcctcggtgcaagcgattctgttgcctcaacctcccgagtagctgtgattacaggtgcccacgatcacgcctggctaatttttttttttttgagatggagtctctgtcgccaggctggagtgcagtggcgcgatctcagctcactgcaacctccgcctcccgggttcaaacaattctcctcctgcctcagcctcccaagtagctgggactacaggcgcgctaccacgcccagctaatttttgtatttttagtagagatggggtttcaccatgttggccaggatggtctcgatctcttgacctcgtgatctgcccgcctcggcctcccaaagtgctgggattacaggcgtgagccactgtgcctggctttttttgtatttttagtagagacggggttttgccatgttggccaggctggtctggaacacctgaccttgtgatccgcctgccttggctcccaaagtgctgggattacaggtgtgagccaccacacctggcctgtttattgattcttttcccctcgagggtgaacttttgacttttttgttgccgtttctccagcccctagaacagtgcagggactcagtaactattagatgaattactgagtgaggaaaatccaggaaaccaaaataacgtaagataaagtagccaatgtacttttggggcagtgtccagcctcatggtcagccaagagaatagaaatcaaagccacaaggtgccattttacaaaattgggtgtgttggaggtcacttaagatgcctcacagtggagaagttagaaactgtggtcttctgactcagtcattctatccccaagagaaacaatggggattcctcgcttggggaaacaaagcttatcccagctttgtttaaagtggaagcccagccacgcagtaagacaagggcatccccgggagttcctgtcacattagacattacaattaggaaagctggaggaggcagtgatgactctgatacatgaaaaatgtatttacaattccagccacgctgtgcaagaatggggatgtggactgggggtacatggaagaatgcattttgatatattaccattcagagactttgaataaatttttatttaaaaccgggcgtggtggctcatgcctgtaatttcatcactttgggaggccaaggcgggcagatcacctgaggccaggagttcgagaccagcctggccaacatggtgaaatcctgtctctactaaaatgacaaaaattagctgggcgtggtggcacacacctgtaatcccagctactcaggagactgaggtgggagaattgcttgaacccaggaggcagaggttgcagagagccgagatcgtgccactgcactccagcctcagggacagggtaagactccgtctcaaaaaaaaaaaaattttttttccctatattatgaagtttttagttgagaaaatgtctcagcctgtctagtgaataatggaatgtgtatggaatgtgtaataaatgtaaggctcataatactatttaaacatcaaagaaaattagccaggcgtggtggcgcacagctgtagtcccagctactcgggaggttgaagtgggagaattgcttgagcccaggagttcaaagactgaatccagcctgggcaacatagtgagatgctgtctcttaaagaaaacaaaaaaggccgggtgcggtggctcatgcctgtaatcccagcactttgggaggccaaggtgggtggaccacctgaggtcaggagttcgagaccagcctggccaacatggtgaaaccctgtctctactaaaaatacaaaaattagccgggcgtggtggtgggaaccagtaatcccagctactcaggaggctgaggcaggagaatcacttgaacccagaaggcagaggttacagtgagctgagattatgtcacctgcaatccagcctaggcaacagagcaagactctgtctgaaaaaaataaaattagctgggtgtggtggcacacaactgtaatcccagctacttgggaggctgagacaggagaatcgtttgaacccaggaggcggaggttgcagtgagccgagattgcaccattgcactccaacctgggcaacaagagtgaaactccatcttaaaaaaaaaagaaggagaagaagaagaaaaagacaaaaatgagtcgggcatggtggtgtgtgcctgtaatagctcccctagagcctgaggcaggagaatcacttgaacccaggaggcggaggttgcagtgagctgagatcgtgtcattgcactccagcctgggcaacagagtgagactccatctcaaaaaaaaaaaaattattttccaaattatttatctaaaactggatgttgatgagttgtgcagaaaaaccatgatctttttagggtgttcaaaataagcattgcagattattaatgtatttcaagagagcagtagtgatgagaaccgtaagtcctcgcctaagtatcctacttggggatcacagcataaaaatcgaattttgagggcaaaatctatggtccagagccttttccagctgggctgtgtgtggtggaccaagcccccgggaagggataggcagcgctggggcactcatgtcaacacagagggactgtggcccctgtgggacgtggagactcaagcgtgtgaaagcagtggcccaagagggatgacagcccaacagtcgtaggcacaagcatgcgacagctgagcaccagcctctcaggatgacttctcagggcagaggctcctcacaggtgtacaggggatcccgtgggatcttcgggtctgtttcctttggtgaaacatgcatctaatgattggctttctgtggggtggggcttgtcgcagaccataaagcagatgcagcagcggatgctggagctccggaagactctgcagaaggagctggtgagtactcgcatgggagctggccccacttcccagcactccccctgctgcctgtgcccggtcctcctgaggtccctcgccgcctgactatgctccctccaccccctaattaattgcaagggatcgctgggcaatccaacgttagctggtgggacagcctgccagcctgcatgcacctctgaagcagctccgtggctacagccctgttcctgccttctctgagcctgcatcctcatctggaagtggggttgcctgccacgccagcgcagtgatgctctaacagtgtgtgtgtgtggcagagtgcttggcctgatgcgggatgcgagcagcttcaggccccagggacgtgtgttcttgccatggaaaacggaatgtctgaatttacccaaacgatgtcactccctcctcaagcctacctggaggtgcttccttcccaggtggggccctttttgccctacgatagtgatcatagtttggaccaggtgaacctcccgtgtgattttttccacctgtctcagagggttcggtgtagcatctttcccactggtttttcagaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggtaaagggcttttgaggtgtcttttgggtattgaggccccgccctacagtctgtcctgcagggacccctgcccagcccctttctctcttttcctcgtacatcctggtttgacgcccttgtggtcacccagtcatttctcctgctggcgttggcctgcggagtgagcggctggcgggagaggccgtgcaggaactggctcctggtgggagacataggctccacttctaaatcctggcctgggtgctgaggccagaggccggaagccgggaacggaatccacccatcgctcctgggtcctgccaaagggtagggtagctgctggggcagttcccttaagcctgccaggcccccgaggatgcaggggaagaaagaacctatcattgctgccaaacttcagagtgccagagcgtcacccaccacctggtcctgctaaccaaagcaagcaggaaatgccacgtagctcccccgaccccaccccgcctcaccttcaccaaggcctatggcagcaaaacttactgtgtttcaggcttttcatcttataaaagctgtgtcagtgttgctgaacttttcccaagaggaggagaacatgctcaaggaaactctggagtataaggtagggttctctggtctactgttccagcttccaagatacgttgtcagttatcccagcagtagcagtgtaagaccccttagacccacacccgagtgtaggcaccagcacagctgcatgatcagcttggctgcttttggatgaacttgatccaagcactttttagcgatgacatcctttgtgcccaaatgtctgtgctgtacttgaccaacaggccacgtatttttcaaagcattttcattgatagcgctttatcgagagccccaggtctggctcagcactcagattccaaaagcgtctgcataaatgctctaataggaaaaaatacctgcagttccactaccttgttcctgtcaactcagtgtttttctctcatttccctcctgtactgagcacgggcctgcagactggttactggcaccatcttcttgctctgctcagagccagaggcaggatgtgtggggggcaggagtgacaggctcacgggaggggaggggcggttcagtttccctggcaccaagtcctgatttgcatctcagaagccttttctgtttcaaatgcagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatggattttactagtttggtgtgtcagtatttctttgactcattaaatctggtattttgtgtctcatatttaacactccaaggccaacctcaagggctagagaatgtttgtctttctttcagaaagaaccttcccagactggatttgggtgaataaatatacgtaatttaatgaagccaacagccccattctaccccccccaagaattgcagtggttctgaagagggactgaggaggggagagctgtggaggggaggactgtgtcactttggtcaaagtctgtatccaaaggctgtatgacccagaggagcttctggagtgtgaatggggccctaacctttaacagaatgcaagctgcagtcacatgtgctgaaaaggaaagaaaagcatttttgcccttcagagaagctctgttattggttatggggaaccaaattataccatctatttgctgattgattgctccccatttctgacgtttagttctttaaagaaagcttgtccatgcagcagtgattctgcagcacagccaacccagcatcaggagacgtgaccaggcacatctgaggccccaccctcaaaagattccaagtgcaatcccacaaactgaagacttttaaagcctagatcaattattaaatgtttggcactttattaaattaattaaataagctccaaaattaattacatacaaatcaaaggaataagaaacaataaatagtttattcagcaaacacctctctgcagcagccggcagctctgaggccgaggctggcgtcctgtggcagagggcctgtggattgccatgctcgctcccaggggtggctcaacagggacacaggtctactccttccacatcgggtttccggaacaacaactgaactctcattcattaccatcccattcattaccatttttttttacatacacgaaacacaccgcaatgtatagactaataagccaagagctttattgatgcagcaggcactttacaatgagcccaagagtgtccaccttctctgggaagacaggatgtctgtacaaactcttgggtttttttccacttcaaaaacacaagctctcccgtttaccacagcccttggatctgcacctgcccaaaccatccctcccccagtgcacacaggtgcatctgaccaacaccagccgccacgctggtagaccgtcaaaatgtcagttctgcagtactcggagacaaaggcatagactatcagatcctaaacaggatttaggaaacagacgattttcccctccaccttgaaaataaaatacatttcagcagatacatgtcctgaaatagtttacttgggagttcctaggaagatggtccattgtcaatcccttcttcaccagcctgggcatccagaattcttctcaaggtaacatgagtctttttattttttttaaacagtctttcttgctgtaagaactcttataatggagcctagtcctcctactgctaaggcctgtgggggcaggaaaagaaaacgtgtcagatgagacctggctggccaaggggagcctggcttgccagagacaggggggacattccctgacctagatcccgtcacagatcctcgaaagaggattcctgagatagagcacattctagggaaggagccctgtcctggagccgtggggtcccgagagctgttggctcttgggcagaactggcttgagaacactgtcaccagcacacaaagcagagccctcgagcttcccttttgagatggggtctcactctgttgcccagatcacagctcactgcacagccttgatgtcctgggttcaagccatcctcctgagtagctgggaccacaggtgtgcaccaccaggcccggctaatttattttttttgagacggagtttcgctcttgtcacccaggctggagtgcaatggcacgatctcggctcactgcaaccctgcctccccagttcaagcgcttctcctgcctcagcctcccgagcagctggg

SEQ ID NO: 12039 - DNA, 6817 bp, Human
ctgggcgggagcaaagccatgtgaacaggcttatgcaagaccaggattcggccagccctgctcagggatccttgcttcactgcctctgccaccaaaccatccatgacgcctctgtgctgcatctggcaggcctgagtcgggggcagtggccggggcaggctcatagcaccccccaggtcaacccggccctgagtctgtctctgaagaaatattcagtgcagggtcagaaaaggttaagaccttgagggcaacatacaaatcccaagcacctaggcggggtagagtggctcacacctgtaatcccagcactttgggaggccgaggcaggcggatcacctgaggtcgggagttcgagaccagcctgaccaacatggtgaaagcccgtatctactaaaaacacaaaaattagctgggcgtggtagcacatgcctgtaatcccagctactcaggagactgaggcaggagaatcacttgaacccggaaagcggaggttgcagtgagctgcgatggagccactgcactccagcctgggtgacagaccaagactcctcaaaaaaaaaaaaaaaaatccaaacccctgcctgtacaggggtcaaagtccaatcacggtgactcagttcccaagtatgagatgagtgtttctgttgccacatgtccaagccacgaagtgaaaaacagagttggaagccaagatgtggggcagtatgggctcgggtgtgcccataccttgtaatgttagaagtgtaagaaaaccctccagacttgtgtttattttctgagcacataccgcgcgtccctgcgtgggcagctgcccctgggggtgggagcccaggaaactccaggttctcagttaagtggtaactgtcttgatgactctcaggtctcagtgcccacattatacaagcggctcagcaaccagacccaggatggggagtcactgaccccctgcgcccatggcaggggtgagggtagggacacccccataagatggagctgtgatgagaagcaaacccaactcagtttggtttcatttacattaaaaaggcaaatcccttggccggatgcggtggctcacacctgtaatcccagcactctgggaggcctaggcgggcagatcacctgaggtcaggagttcgagatcagcctggccaacatggtgaaaccccgtctctactaaaaatacaaaaaaattagctgggtgtggtggctcgctcgtgtaatcccagctactcaggaggctgagtcaggagaatcgcttgaacccgggggctgggtggaggttgcagtgagctgagatagcgccactgcactccagcctgggcaaaagagcaaaaaaactgtgtctcggaaaaaaaaaaaaaaaaaaggcaaatcccggccgagcctttggctcacgcatgtgatcccagcacttttgggaagctgaggctggaggatcacttgaggtcagaagtttgagaccagcctaggcaacatagcgagacccccatgtctacaaaacaataattagccaggaatggtggatgagcctgttgtcccagctactcgggaagcagagacgggaggttcgcttgagcctgggaggtcgaggctgcagtgtgccctgatcgtgccactgcacgttagcctgggcaacacagcaagaccccgtgtcttaaaaaaaaaaaaggtaaataagagttggggacacttttctgcgagttggagaaaccaaaccccctcgacgagtcttaagtagtattctcaggttgtctggcctgcggccgcgctgctgtcaaccagccggataactgcgctgcctcccgacgcgccgccagccaggccacggcctcctagacacaagcgagcatgcgcagtcgccaacaacaagtccgcacgtccggtcccgcccccccttccccgccttcttcccactccggcctcccattggctgacgtcggcgcgagcgctcaacaccgacgcgtctgaccaatgagcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatggtgagctagcgccgcggccgttgccggcccggtgaccgttggggcgggcgcgcgatccctgcctccgctcgccggcgtggggaaccctcaggctccagtgaccttggtggggggcgtctgggggctccccctccccacccccggccgggcacggacgcgggtgaccgtactgcgacgcgctccgcggccctccagaccgttgtaggcgcgcgggctggggtcggggaaggggaaggggttgttccacgcgcgcgggtcgtggtcggggaaggggccgtccaggccgttgcaggcgcgcgtgccggggccggcgtcgggggtccaggcttgcagggggcgggggtccgggacggctggggcggagctggaccgttgagggccacggcggggcgtctccgggccgagcggggctgctgcgcccgagcggttgggggcgcggagggctggaaatcccggatcacgcgcccccgggcgccgccccgcccccgcaccttggcctagcgcggtggcgtcacagtcgcgcagtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccggtgcgcgcggggcccccacaccggctaatgtggcacattttggggttggaaccctctcccggcctccgggtctccggtaaaaccggaccagaagtacaagggggcgtgtgcgtttaaggaggaggagcgttcaggtcttcagggccgcagggcctcggtgtccccgccaccgacccgctcccgatcccttcctgcctcagggtcccgggctcagcctcccgtccacgctccctgctcagcttcctttgccttgcagtgcgcgtcccgggacgactggcgctgtgcgcgctccatgcacgagttttccgccaaggacatcgacgggcacatggttaacctggacaagtaccggtgggcgctcgcctggggtggggcgcggggtcgggccctgggagggggccgtgttcttctgcgctgacgccgccgatcctcgcaggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggtgggctgctgcgtccccggggcccgcagaggcgggtgggtgggggtcggggtgggctccagcctggagagggcctgggagtgtgcagggggcccggactgagggggtgccagcccccgactcactcacacaccttggccgccacaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagtgcgtgacctctggggacagtacggctgctggggtgggggtgggggggctgctgggatgctcacacctccctggggcagaatggctcatggctcggggggcggttgcggggaggtgctgggactctcacatcgcgtggcctcctgggggtaagatggctcagggggacatagagggctgtggaggcagccagggatgcccacacctttgtggcctcctggggacaggatggctcgggggcctgtggggggctgttgggactctcacactgcatggcctcctggggtaagatggctctgggggggcttgggggcactgtggctgtggaggcagccggggaagctcacacccttgtggcctcctggagacaggacagcttggggactgtggggggctgctggggacgctcacgtccatgtgcttcttttccagtgccatcaagtggaacttcaccaaggtaagggggctgtggggggtaggggaccagcttcccctggccacagccgtggcccagatgggcagcggacaggaagggcagcctcagccccttgcaggggtggccccacagtttggacaccgtctctccacagttcctcatcgacaagaacggctgcgtggtgaagcgctacggacccatggaggagcccctggtaggtcctctctagggagcccgcttgaggctcgggggcttgggaggtagctgccctaacccagctttcctccccgacaggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggatctttctgcgtaggggcttggggggcccttttgccaggggcccctccatgtcagggccagttgccgtcagctgccaggctgggggtgccatggaggtggcgtgttgttgccccctcttcctccaggctcggggggctgtgctggctgcagtgctggggtgcagtgagatctgggcccgttggacacccagccctggctcttaatccgtgcagccccacctgctgtgcacaggcagggcctggtgtagtgccgagtcttggaggagataattctaagtggctgtgcttcctggccccgggccttaactgttaggaggtggctactggggcctcccctggccaggaagcagaagtgcagaggcccgaggaacagcgtggccctggtgctggggatgggttgggcacccacaccggcccttggggcctcacctggctggggggtgtgggggtggctgggtggttactgtttgcacagagtccctccgtgagggctggggatggacaggccaggaggggctggtagagcagtaccagccaccgttcatgggacccgggggctgtctggacacggcctggctgcccacctgcacagctagagggactgcagcctgccagggtggctgatcccagctgcccccactgggggtctgtggaatggacggtccatggcacctgccccagacactgggttgagaggtctgtctctcccagccctcgtcccctctcatccacatggggccagcacaggcagtgggcagaaaggcctggtaaccaggagagcctggggggatgcccacacacccctgcccttccctccctgtcccacaggctgaggagcagactccgtgggaagtaggcaaaaggcacatatatttaaaaaagtcctttacatatgtacatcagaacttgctataaatacatagaaaccgcaggcgccaccctgccagctccgcggcctggggcctgggagaggtgagcgggcaataacttaggggtcagggaagggctgggggagggagaattgcatatattagcaggggtctgccccacggagcccccgagacgcggggccctgagcacctggggtttcctgagtttctagctcttgggaccacccggtttcacggatttcaagggtttgggcccactgagcccttgtgggtgcccagtcccagagcagccacccggagccccttcctacttgggaggagaggcacagagagggccctgccacgccccggcccccagctgtcctgagtgggccccgccagggctgaccaggtgggggcccgggtcgggcgctgaaggcactgcggccagggcctagggctcctctgagcagtggtcaggggaccttggccctgctccccaccgctgctcctaggggagaaacggtccctgtgtcttggggcatgtttcgcctaaaggcgtgtcagagaggagcctgggcgccggggaagggtgggctgaactggatcacgctctgccgctcgggaccaccgcccgccgcgccccccgcccccgcgccctcccccagcgcgccctcggagggcggccccgcgtgcagcgagcgcagcatgtcctccagcacctccttgaagttgatgtcgcagccctggtgcgcgagggccgcagggtcggcctgggcgtcgggggtgcccagcggcacgacgccggggccggcgtccagggacagcggcgccgggaaagagaagtgcgggggcggcgggaaggcctcggccggggggctgtaggtgaggtccagcacctctccggggccgcaaggcagcgccagcgggcgcggggcgggcggggcggggcagcccagggcgggcgcctgcctgcgcttcacgtccgcatccatcagccgcagctcctgcagcacccggcgcacgcagccctcggggatcttgatgcctgcgggcagagcgtcggggtcagggccggcgctgggggctcgggccttcccggggcgcccgccgcccactcacc

SEQ ID NO: 12040 - DNA, 24405 bp, Human
  misc_feature (1)...(24405): n = A,T,C or G
tttttgtataaaaatgacaatactctccgtcggactgtattttagcccaaaaaacaaaactaaacccctttttctttgatactccaggttcatagagccaagcctatcaatttttttcttgttctttgttttttggttggggaaagggttttctaagaaatactgaattttccttacctaaaagtagtccaggttaaacaagtcaaactttaaatgtaatacccattgctttaaaatattctagcaaagaaaataaggtctggaagatggtggtaggggatagatgaaacaagactgaaaagtgttgacaatttatgaagttctggaaattcattctgctcttctgtttgacattttccacagtaaggagtttttaaaaatactagctttctcttattttttactctaacaacttccttttgcttgtctttgacaagtcctggctcaggaggaggaaagctgcacaaccagtctttgtgtatgtgtgtgcaaatctctgtgtgttcacttgtgaatacagtttcattaggggagggttcacctttgttatgtattatcagtacataataaatatatatgttttcttttatttttttagagacagggtttcactctgtcacccaggctggagttcagtggtggcaatcatagcttaccacagcctctaccttctgggctgaagcaatcggcctcccaagtagctgggactacaggcccacgccatcacacccagctttttttattttttgtatagacggggtctccctatgttgcccaggctggtctggaactcttgggctccagtgatcctctcacttcagcctcccaaagcgctgggattataggcatgagccaccacgccaggcctatatttcattttaaaacaacgaagttctccttcctcacatacctcaaattcggggggtaccaaatctctgatattatcccaacgatttttttataaccaaggtatcacaattcctttcagaaagggttctttagccactcacaccacgggtttcggtggcacagcgcagggcagcacagacttgtgctacagctctcggccctacccagagcaggatggccctaacctaatttttttgtttgtttgtttggagatggcgtctcactctgtcgcccaggctgcagtgcggtggcacgatcttggctcactgcaacctccgcctcctgggttcaagcgattctcctgcctcagcctcctgagtagctgggattacgggcacccgtcaccacacccggctaatttttgtgtttttagtagagacacagtttcaccatgttggccaggctggtcttgaactgctgacctcaggtgatccgccctacctcggcctactaaagtgctgggattacaggcgggagccaccgcgtccgacctaattttttgtattttagtagagacgggatttcaccgtgttgcctaggttggtctcgaactcctgacctcaggcagtccacccgcctctgcctgccaaagtgctaggattacaagaatgagtcactacgaatgagtcactgcgccaggcccctagcctcacttactttgggcctcagtttccaccgcctgaaaaaagagcagttcgattgcacccacttccccgggccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaaaccatgggcagccccgcccaagggcggagactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctactctgccctccgtgcctctctgctgccgcagtcgctggcggcggcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgagtctctggtcggttgggcagtgtaagtgtggctggggtgaatgttgaggccttgttccccgcctggcccatggtaggtttcgtgaggctgctgacgcccccacctcgcatcttcttgctttccgccggctggttgtgaagttgcgaggcccgagcccgccggagggttgggagtttccgtgcagcccgagcgctaggcctgggcggccctcggcgcctctcggtcggccgctgctgggaaggtgcgcgcacacagttgcgtgggctggcttgtagggaaggagcctgtccccatcgcgccgttccctctcctgtccccagggaaagacgagctgtcccggtttactgaaggtcacctctgcaactccactcatacagaaggtctttaaggactgtgtgtcgcctcgtctgggaaagcagtttggagatttagctgttggggggagggggtgaatgggagggagcgttgagggttgaggacacaacttggggtcccaggaatgaatttgcaatgttttcctttccattttttctttatttttttagaaaagtcggtgtgtagttagattgcaaatattttgtgctttgtagatgaacctttctcttcttggtacgtggcatctgggaagtgtctgcacactttttaactacccagcccctgattccttaggtcatatttatcttaattcaatttgtgcttctcctttaacttagggagactgggaggctaatcagcatggctgctgtctgccagtggctgagctaattgatttgaatcctggcccaatactttacgctgcctttttctgtaaaagcttgtgatgcttatggaattatggaaaaatggggaaagttgtctacaaaaaccacaacaaaaccatctccagtaaacctttgtgagctagcttctctctttttttttctatgaaattgactgcagtgatatctgtagagcatctactatgtgttagacactgcttacatttattccttaaaactaaacattaagccttttttttttttttttttttggagaccgagtctcgctctgtcgcccaggctggagtgcagtggaatgatctcggctcactgcaagctccgccttccgggttcacgccattctcctgcttcagcctcccgagtagctgggactacaggcgcccgccactgcgcccagctaattttttgtatttttagtagagacggggtttcaccgtggtctcgatctcctgacctcgtgatccgcccgcctctgcctcccaaagtgctgggattacaggcgtgagccaccgcgcccggcctaacattaagccttaatgaaaattatagatagggctgggcgcggcactttgggaggctgcggcgggtggatcacctgaggtcaggagttcgatagcaggctaaccaacatggtgaaactccgtgtctactaaaaaaatgcaaaaaaattagccgggcggggtggcgggcgcctgtaatcccagctacccgggaggctgaggcaggagaatcctttgaacccggggaggttgcagtgagccgagattgtgccattatactctagtctgggcgacaagagcgaaactccgtctcaagaaaaaagaaaagaaaagaaaatgacagatagtagaaagatatctctgtccttagtccggtagagtgcaagtctttttttttttttttttttgagacggagtcttgctctgttgcccatgctggagtgaaatgccgagatctcagctcactgaaacctctacctcccgggttcaggcgattatcctgcctcagcctcccgagtagctgggattacgggcacacgccaccacacccggctcattttttgtatttttagtagagatggggttttgccatgttggccaggctggtcttgaactcctgacctcgtgattcgcccacctcggcctcccaaggtgctgggattacaggcgtgagccaccgcacctggcccagtagagtgcaagtcttaaagcctgagttgtcttcttaggttatggttgtagtgcttcgtggattcttactaaattccagttttacttaatccgataaaagagactttacaagtctgtagcctcacactgctgccgttgtctttaagatctttcccttaatcacttggtctggcataccagctgacagaggaatattcccaaggcgtcctgctgtcttgttgatttacccagtcctcagtgtcttgtattaacttatctttgcctaccaagtgaaggacacacattgagctccacactcaaggccctctgctctgtggtaccaacctcttttgccaggtcaccttctttcgctcctaatttaaacagttggaattaattgctgtttttcaaatgggcatttggtcgtactgcttctttctctcgccttcaaactggaataccctatcttttatatcctcataaaaattctatccttccttcaaggcccatctcatgtcacatcctgattcatctgttagtgctctgatttgaattcctgtagtattttgtatcttaattatagcactcagtatctcatcttgtatgcttatcgtattctagatagctatttcagatgagggcggcaaacactgtgtgtaggggcaatcaaatatttgtcaaattgtcaggacctttcttgtgttgccttaactacaccattgttagctataatttggggttgatgaattttaaaacaaaccctgaatgaaatttgtgtcctgccaaacctttaggatatacctgcttatggcttttggatgtacaatttaagccaaaacaggatgggttacattggtgaagtttactttttgcttctgaaataacatctagaatgttagtttgtagaataaacattttctaagaatttttttacattttttacctgtaaatgcaactctttttacaattcttcatttcctttggaaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcaggtatattttatgtatgttttatttatttattttttttccttatattgtttctcacaagcaggtatgtatgttttaagtatgtaattttgtctgagtaaaaggtagtgctacaaatccatgtcagactacgctgtcaccttcctttttgatggttgggaactgtctcattctggttggttgcatataccaaatgataccatgtgtgctgtttgcggtatgtaacgaattgaaagactttgggccaggggcagtggctcaggcctgtaatcagcagtttgggaggccaaggtggaaggatggcttgaggccagtagttccataccacactgggcaacactgtgagactgtctcaatttacatatgtataaagactttgaatgcaacaaaagtattttaacgttaagactgcatagtatgggccaggcgcagtggctcacgcctgtaatcccagcactttgggaggccgaggcgggcggatcacaagctcaggagattgagaccatcctggctaacatagtgaaaccccgtctctactaaaaatacaaaaattacccaggcttgtagtcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtagcgactgccaccacacccagttaattttttgtatttttagtagagctggggtttcaccgtgttagccaggatgatctcaatctcctgaccttgtgatctgcctgcctcggcttcccacagtgctgggattacaggcgtgagccaccgtgcccggctggtatgatggaatattacgtagccctcacaaagagtgagattatgtgctttgcagcaatgtgggtggtgctggagaccattatcctaagcaaactaacatggaacattaaacttaatactgtatgttttcacttacaagtgggagctaaacaatgagaacacatggacacaaagaggggaacaagaagacaccagggccaacttgagggttggggagaagattaaaaaatacctatcgggtccaagtgcggtggctcacgcctgtaatcccagcactttgggaggccgaggcgggcggatcacgaggtcaggagatcgagaccatcctggctaacatgttgaaaccccatctctcctaaaaatacaaaaaaaattagccgggcgtggtggcacgctcccgtagtcccagctacctgggaggctgaggcaggagaatcgcttgaatctgggaggcggaggttgcagtgagctgagttcacaccactgtactccagccgtggtgacagagagagactctgtctcaaaaagaaaaataaaacctattgggtactgtgcttgctacctgggtaactaaattatctgtataccgaactcccataacacatggtttacctatgtagcagtcctatacgtgtactaaataaaagttgaaaaacaaaattacatggtttgaaattatttttctctgtggtattaatatatacatatcaaaaagtcaagcctgtcagtggaaatatggaattaagggtgactctttatgtaatacagacatttacaatagaaggtcacttagtatcaaggaataaagttcccttaataacatgtttggagggtttacatatctgtgggatttttttttttagtttctgtatctgactatgatttatttttattaatttttttgagatggagtcttgctctgtcacccaggctggagtgcagtagcgcaatctcggctcattgcaacctccacctcccgggttcaagcgattctcctgcctcagcctcctgagttggtgggactgcaggcacctatcaccatgcccggctaatttttgtatttttagtagagacagggttttgccgtgttggccaggttggtctcaaactcctgacctcaggtgatccaccaccttggcctcccaaagggctgggattacaggcatgaaccaccatgcctggctatttcattaatttttttagctgctccttgtggagcaggagtaaatcctaggcagtatgcccagagtgagcctggtcaaacttttttttaaagccacttggccacttacatcttggactactcccattataaaaagtatgcagtatgaaaaggggaaaaaggctgggtgtggtggctgatgcctgtaatcccagcactttgggagactaaggtgggaggattacttaagcccaagagttcaagaccagcctgtgcaacaaaatgagaccgcctctctacaaaaacaaaaagttaaactatggtaataaaattactcatacaggaaatattttagagacctatggagatgattttaaaggaagacacttatgtataaatttaactatattgtatttccttaagtgattgtagaaacattgcaatagaaataatgaattttgtgttgggcctatcctgatttgctatttaatgatcaggaaggagatcataagcttctgtgctaaggtttgcttatcttttctacttggaaggttttagagactaaatccttattggtgtttggatgacttcagtgatggggatttgtgtaaggaatatgacacttgtttcctgctttgttgttggaaaactgcattcttgtgacttacataattgagctaaaagtttgatttctgttttcaattgattttgctcatacacttttagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaaggtatgtgaagtcagattatggctttttgggatcattgcattaggttttatacttttcaaggtagtttttatttgatccttaataatgaagtatttagattgtatgaatgcattcttttataggatgtgaaaataaaacataaagagataaagtttcttttttttgtgggggggatggaatctcactctgtcacccaggctggagtgcagtggtgcgatttcagctcactgcaacctctgcctcctgggttcaagcaattctcctgtctcagcctcccaagtagctgggactacaggcacatgccatgatacccagctaatttttgtatttttattagagatggggttttaccatattggtcaggctggtctcaaactcctgacctcaggtaatccacccgccttggcctcccaaagttctgggattataggcgtgagccagtgtgcctggccaatgaagtatcttacaagctgtgagaaataaagaagttatgcccgcatggtaaatatgcaataaatgtcatttgttattttctctagagaagcgcataaagattaaaatagttattgaattctcagataacccagcaagttgtaatgattttttttaatgggtttgttcctttgttatgtaaatttttcatccctgttgtgttttttcttcgtagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggtactttgcagttgtattatgcttgggagctcatatcttttttcccttggtatctccttctatatcttagatgagcctgtttctgggcaaaggcatgcagttatattaggttctttaggggagagctcttcacttaaatttctaatatttatagattttgtatgtgtttttgttctatcaggcagattttaggagggaagtcagatttcagaataatttcatgagggttttactattgaaggaaataacttctcataatagttgctgtatttgtgtaagacaataacaatttatataatttaaaagtattttctaattcctagaaccattagcagtgaagtctgtgatttctattgtttcctagtatataattaacagcaaaaaaaaaaaaaaaactggtggggagaattgtatgttttgggtgggcttcttggaccttacctattctggaaatacaagtatgtaggtgttgactgacttttgactgcataataattttcttcctgtcaagcgtgtattcagttttgggactggcaaaacagaataaaaattttattagtatgtgaatgatggtgttaattctaaggataaaaaagcctgctagtagcattaaaatctcttggtgtcctaggactgaatatagttgacattacttttgtgatggactatagagggaggcgaaaaacaggggaagcctatgtgcaatttgaagaaccagaaatggccaaccaagccctgttgaaacacagggaagaaattggtaatcggtgagtaaagcagatactaatgatgcagaagtgttacacattaagtcattttgatgaatgtgctgtaatatgactgaaaagttatccaaacatagaaaagtagagagagtagtgtagtgagccatcaaatgcccataatttagattaacaattttttttcgactgctccttttttttttttttgagacagagtttcactctttttgcctaggctagagtgcaatggcacgatcttggctcactgcaacctctgcctccctggtttaagcgattctcctgcctcagcctcccaagtagctgggattacaggcgcctgccaccatgcccggctttttttgtatttttagtagagacggggtttcaccatgttggccagggtggtctcgatctctcgacctcgtgatccgcccgcctcggcctcccaaagtgctgggattacaggcgtgagccaccgcatccggcttgactgctccttgtggggcagggactaacccatagacagagtacctagagcagctagattaacacatttatatatagaatgtaacatctgttatatttgcttcatctgggttttttttagtatgcatcttttaaaaaaatttttttacataatttcaatgttatatctaacactgttagcaatagtatattatctaataacagttcataatagcattttcccaattataccaaaaatagcctttttttttttggcaacggagtttcactctgccgcctaggctggagtgcggtggcgtgatcttggctcactgcatcctctctctgcctcccagtttcatgtgatcctcctgcctcagcctcctgagtagctggaactagaggcatgcgccaccatgcccagctaagttttgtatttttagtagagacaaggttttaccatgttggccaggctggtctagaactcccggactcaagtcattcacccacctcggcctccaaaagtgctgggattacaggtgtgagccagcacaccggacaaaaatacagaatccagataaggtctacacactgcatttgattgttatgtccataattctctgtgtgtgtgtgtgttttttttttttttttaagacacagggtcttattctgtcacccaggctggagtgcagtggcatgatgatagctcactacagccttgaattcctgggctcaagcaatcgtctcgcctcatcctcccaactagctagaacaataggcatgtgccgccacacctggctgtgtgtatgtgtgtgtgcgtgcgtgcgtgtgtgtttgtaggtggggtcttgctgtgttgccctggctggcctcaaactcatgggctcaagtgatcgcccgctttggcttcccaaaacgctaggattacaggtgtgagccactgcacctgaccactgattctcttgaactagagcaaatcccccttacttattcttcccccctttttaaaagcaattgacttttgaagaaattagatcagttgtcttgtacagtatctcatgttgacatcacctcaggatgcacatgatgataagtgggttcatttgtgttttaactttaactttggaggtacagtttaaaatgtcaaatgttaaatcactgtttcgttaatttttttttttactgttttctggccttttaaatcagctcctttgaagtaaacaaaacagccattccaaagccagtgtttcaggatctactgatagaagtggttgaaaggttttttggttttttgagacaggatcttgctctgtcacccaggctgaagtgcagtgccacaaacactgctcatttcagccttgaccttctgggctcaagcagtcctgccatctcagctttccttgtagctggtaccacaggcatgcatcaccatgcctggctaattttagacagagtcttattctgttaccctcgctggagtgcagttgtgtgatacagctcactgcagttgtggcctcctgggctcaagcaatcctcccacttcagcctcccaagtagctgggactacagatacatgccaccacacccagctaatttttgtatttttgtagagacggggttttgcatgttgcccaagctggtctcacactcctgagctcaagtgatccacctgcctcagcctcccaaagtactgggattataggtgtgagccactgtacctggtctcctggctaattaaaaaaaaaacaaaaaaaaacttttgtagagatggtgtctcactttgttgtccaggctcaaaggttttttttttaaagaagtagtgctcatctaatctttatagatttgtaaacacaagctagttttataactcttagtttagaaggccatgttaagaaaaaggaaactgtgctgggcgcggtggcccatgcctataatcccagcactttgggaggccgaagtgggaggatcacttgagcccaggagttcaagagcaacttgggcaacatggcaagaacccatgtctacaaaaataaaaaataaaaaaattagcagtgtgtgggctgggcatggtggctcatgcctataatcccagcactttgggaggctgaggcaggtgaatcacctgaggtctggagtttgagaccagcctggccaacatagtgaaaccctgtctctactaaaaatacaaaaaatcagctgggcgtggtggcgggcgcctgtaattccagctactcaggaggctgaggcaggagaactgcttgaacccaggaggcagaggttgcagtgagccaagatcgtgccattgcactccagcctgggcaacaaaagcaaaattctgcttcaaaaaaaaaaaaaaaaaattagcagtgtgtggtggcaggtggcagtagtccccagctactcaggaggctgaggcaggaggatcacttgagcctaggaggttgaggctgcagtgagccatgttcacaccactgcacaccatcttgggtgacagcaagaaacccaagtttcaaaaaaaaaaattgttccagaagcttgggtttaatagatagtcagtcccctcctgtgatagcaagtcataattgatacttagttcttgaattctcagccttttagtgaagttctggggaagttagctcttcttttactgtgacttttaatatcttatacagatatgattaatttgcacagaattgaatttcagagcttcaagagattgttaaccagcaatttaaaaaacccttatgagattaattttttctgtatacacaattaacttaagcatagttgttctcatgaagcaaaacagagtagaaaatattattaaaatgtatgtgaagaaaaagtgttaccttgatgcaaaaacttaaatcagtgacctactctgttgtatattttcatgggctactatctgtatgcattattagttttccctacctgttatcttttgacacctgtgtttcataagctgttggaaatataatgtatacatgtttattttaaatgagttcagtataaagttactttgcaccatttgtgcctgtttacttttgctttgacatagatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaataggtaaggtcctgcctcttcttgagactcattgggtctatcttgaatgttttgggttttgtgatttttttttttttgagatgaagtctcgctctgttgccaggctggagtgcagtggtgcgatctcggctgactgcagcctctacctcctgggttcaagtgattctcctgcctcagcctctttgagtagctgggactacaggcgcatgccgccacgcgcagccaatttttatatttttagtagagatagggtttcgccacgttggccaggctggtctggaactcttgacctcaagtgagccgcagcctcctaaagtgctgggattacaggtgtgagccaacacacccggcctaaagatttaataggactttacatactttgagtatatgcagaaaggcttaattattttgctaggtttttaatttaatcatttttattaactatatcaaaagctgggtagtaaaaatgtgataaaaggaagtaagatgtcaacatttaaattaagatgggggaagatttggataatgagcaggaatattgactgaagtaaggattttttttttttttgagacagagtttcactctgttgcccaggctggagtgcagtggcgcactctcggctcactgcaggttccgcctcccaggttcacgccatcatcctgcctcagcctcccgagtagctgggactacaggcgcctgccaccgtgcccggctaatttttatatttttagtagagacggggtttccccgtgttggccaggctggcgttgaactactgacctcaggtgatctgccggcctctgcttcccaaagtgctgggattacaggcatgagccactgtgcccgcctgaagtaaggatttttgtttgcttctggatttaattatttctttgattcctaacccagggcaacatttggaatcttttaagtttcataaatactttttaaactggtaccctgggattatcttgtcactatatatatgtgtatatatatttttgttttttgagacaaagtcttgttctgtggcccattctggagtgcagtggcacaatcatggctcactgcaaccttgaactcctgggctcaggcagttcttccaccccagcctcctgagtagctggaactataggcatgcatcaccatgcccagctaacttatttttatttttattttttgtagagacagtgtctggctgtgttgcccaggctggtctcgaactcctgggctcaagtgattctcctgcttcagccttccaaagtgttgggattacaagtgtgagctaccacgcccagcctttgttcttttttttttttttcagtgcctgtaatctagaaagtctcttttagggtttaattcataatcattttacctgctctctgatgttacaaaaaggggtaagttcttaaactggtaatggtctgaggcattcagtgcttatgggtgttcaggtgatatttgttgagtggcagaaatttcagatcattttggcttttaatgctcttaagaggaattgaggatttggacataaaagtcatacctaattagaatctgttaataacccttgaagctgttatgttttaacagtgctttctgttccacctctcagaattgcctaaggaggtgccagaaaagcttccagaggctgctgattttggaactacgtcttctctgcattttgtccacatgagaggattacctttccaagccaatgcccaagacattataaacgtgtgtggcagtaagatatccaatctcaatagatttgaacaaaagttctaaaattgaacttgtattaatttggggaaggtagagaagaaaatatagtatttctgcgttggatagtaagatggcatcttcctggttgcaaagcttgcttctttttctgtagctgaaaagtgtggcttggtattacttttttttgtgacagagtctcgctctgtcgcccaggctggagtgcagtggagtgaacttggctcactgcaacctctgcctcccgggttcaagcatttcttccgccttggtctaccgagtagctgggattacaggcaggcgccaccatgcccggctaattttagtattttcagtagagatggggtttcaccatgttggccaggctggttttgatctcctgacctcaagcgatccactgtcctcggcctcccaaagtgttgagattacaggtgtgagccaccatgctcgctgagagcagatatttgaaatgtcactttgagttctgagaaaaagtaaaaagccagaagacatactagatatataaatatattactgcttaaaaagatttcctaaaaagaaatgtatcaagtgtatgaatcaaagtctgaaagaaagatgaagagccaccagacttctaggtaggtttacatccatcatgttcctcttgactgcctttgtttgtcgtttagttttttgctccactcaagcctgttagaatcaccatggaatacagctccagtgggaaggccactggagaagctgatgtgcactttgagacccatgaggatgctgttgcagcgatgctcaaggatcggtcccacgttcgtaagtcctgcctttggcttttgttgtcatttttgatgcttgtctttgcttacaaatatctttttctgttttgggattgtagaatttttccttgagaaatttgtattcttttagtactagtaaattaaacgtaacagataaaacactatattataatttaaaaaattttgtctgctaattatcccgcaaatctctttctttcttttttttttgtcacccacgctggagtgcagcggtgccatctcggctcaccgcagtctcagcctcctgtgttcaagcaattctcctgcctcagccacctgagtagctgggattacaggtgcctggcaccgtgcctgactaatttttctatttttagtagacacaggtttcgccatgttggccaggctggtctcgaactcctgggttcaaatggtccacctgcctcgacctcccaaagtgccgggattacaggcatgagccaccgcatccagcctgtttgtccattttacattttgtttgtttgtggttgtttgagacggagtcttgtctgttgcccagtctgtagtgcagtggtatgatctcagctcactgcaacctccgcctcctgggttcaagtgattgtcctgccacagcctcccgagtagctgggactataggcacccgccaccacactggctaatttttgtatttttagtagagatggggtttcgctacattggccaggctggcttgaactccttacctcaggtgatcctcccacttcggcttcccaaagtactgggattacaataggcgtgagccaccgtgtccggcctaaattttgtttttaattagggaaaggaaagggcaaagggtttgagttgctgtctgaactgtgagaaaaatggctgtaatatttttctaccttttcaactttttaaaactaatctttctcattatcctcagatcataggtatattgaactgttcctgaattcatgtccaaaaggaaaataagactctaggggctccagataataaggtaaatttaagaggtaatactgtgggctgggtgcagtggctcacacctgtaatcccagtactttgggaggccaaggtgggcggaccacctgaggtcaggagttcaagccagcctggccaacatggtgaaaccctgtctctactaaaaatacaaaaattaaccgagcatgatggtgggtgcctgtaattccagctactcaggaggctgaagcgggagaatcacttgaacccgggaggcagcggttgcagtgagctgagattgtgccactgcactccagcctgggcaacagagcgagactcaaaaaaaaaaaaaaaaaaaaaaaagagagatacaactgtggaaattatttgctattgataaactaataatcattcactcactaatttgtaatatggtagaaaccattctctttttatttttcaaatttttttagggactaggtcttgctctgttgcccaggctagcagtggtgcgatcatagctcactgcagcttcaaccttctgggctcaggtgattctctcacttcagcctcccaagtagctgggactacaggtgtgtactaccatgcctacctaattttttaattttttgtagagatggggtctcactatgttgcccaggctggccttgaacttctggccttaagtgatcctgctgcctttgcctcccaaagtgttggaattacaagagtgagccaccccgcctggcaccattcctttttaataaagatcaaactaatgataattgaagtgtcaatataaggaatgaaaattctcgctctggcttctcagatgtggggggcaaaaaaaaaaaagaaaattctgctgggaaatagaattaattatgatattttttcattttttttaaattttattttatttatttatttattttttgtgagatggagtttcactcttgttgcccaggctggagtgcaatggctcgatctccactcactgcaacttccacctcccgggttcaagagattctcctgcctcagcctcccaagtagctgggattacaggcatgcaccaccacgcccagctaatttttgtatttttagtagagacggggtttctccatgttggtcatggctggtcttgaactcctgacctcaggtgatccgcctgcctcggcctcccaaagtgctgggattacaggcgtgagccactgtgtccggcctactttttattttttttgagacagagtcttgctttgttgagcagactagattgcagtgatgcagtctgggctcactgcaaactccgcctcctgggttcaagtgattctcctgcctcagtctcccgagtagctgggactgcaggtgcccgccacaatgcctggctaatttttttgtatttttagtagagatgaggtttcaccatgttggccaggctcatcttgaactaactcctggcctcaagtgatttacctgccttggcttcccaaagtgctgggattacaggagtgagccactgctcccagccataattccttatgatttatatggtagctttgagcattatctccatatagaatttttatgcataatttccaacatcatgctgtttgccaaaaaatagccacctttagtagctataaatcgtaatagactggatatgtgacttgcattagctttttttccccacttaaatttaaacacgttttccattttctcaggttacttttttttttttttgatatgaaatctcactctttttgcccagggtgaagtgcagtggcacaatctcagctcactgcaacccctgcctcccgggttcaagtgattcttctgcctcagcctcccaagtagctaggattacaggcattctctaccacatccagctaatttttgtatatttagtagagacggggtttcaccatgttggccaggctggtctcaaactcccgacatccagtgatccgctagcctcagcctcccaaagtgctgggattacaggtgtgagccaccacgcccagccattttctgttttaaggtatttttaaaaggataccatgtgaaaccagagtgtatcatccataaacacagttaatgtgccactgtttccttttcctaaaatggcattttttttttgccttaggaagtacataattttatagtgttaacctacccgtgagatttgcttaatacatcttgatgttccttgcctcgattaaatatatggtgtcttttttttttcccataaggtattgtaagtattactgttgtattgcagtcacttttctacaggtaatggctcattcttttgagacacttacctgtaatgatttcttgaaaacacatggggccaggcatggtgggttactccagtaatcccattacttcaggaggctgaggcaggcagatcacctgaggtcaggagtttgagaccagcctggccaaaatggcgaaaccctgtctctcctaaaaatacaaaaattagctgggtgtggtggtgcatgtctgtagttccagctactgggaaggctgaggcaggagaatcacatgaatctgggaggcggaggttgcagtgactgagatggtgccactgcactccaccagcctggatgacagaacgaaactctgtctcaaaaaaaaaaaaaaaaaaggaacaaaaaaacacggacattcattctattactatatcctattctattgctttttttttttttttgggagacggagtctctctctgtcgcccaggctggagtgcagtggtgtgatctccgcttactgcaacctccgccccccgggttcaagcgattctcctgcctcagtctatgaagtagctggggctacaggcgtatgccaccatgcccggctaagttttgtattttatttttatttatttattttttgagacggagtttctctcgttgcccaggttggagtgcaatggcacagtctcagctcactgcaacctctgcctcctgggttcaagtgattctcctgcctcagcctccccagtagctgggattacaggcatgcgccaccacacccggctaattttttatttttgtggagacggggtttctttatgttggccgggttggtctcgaactcctgacctcagctgatctgcccgcctcaacctcccaaagtgctgggattacaggcgtgagccaccgtgcctggcctcttctgttgctatttttggatatgaagtcccacaattctttggtgttaaatatttataatagctaaaatctatttaaaatatattctgaaactcagttttttgtaccagcctgtaaacactaatgcctgactagttttcctcactttaactcggtttatcagatagcttgcactaaattagaaaggagaaaaatttgaatttgcaattttaaatggtatgggaatgtgtgccatcctttttcatcttgagtaaatgtacaatattttttgttttatttttagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagattacctaagagtatttattattggagtctgtgagtcaactgaatatattattacctcaagtcctgctatattaatataagtagtaagggttaattttcgtgtgtgtgttctctaaaatcctgtgaacatgacttaaccagcttaacatcatcattagtactgcctagatggaaatgcgttttcatatatggttgaatatgccaagctatgagaactggtatctgtagttgtacgaactattagaatgtgatctttgttgctctttcacatttggtatctgatttgctgtggaaaagatctgtggggcctactgtgaggaattcatctgcaattgatttaagctaatgagttttatttgcacatctctggaaaaagaatgcaagcaaagcattaaaatgctatatgatggatgggtaaggttgaaaggatatatcttcttggcacgctacaggctgagttttctgtacaaaatgtggccattattgggaaatcattttatgtatttgaatgctcccttttgtttttgttcatgatctaggctagtacgtaagtgattgctaaggtggatgtagttatgggaaaggaagagaagcacataatacagtaaaagtaatcttatttccatgcaagtggaagacggtaccgtctccccacatttgagaagactgttttgcatcactctttgctattgaaggaagcagtgatggtgaatttccttctgtttgggttccttgtgtctataacttcctttgtggtaaagccatcaggaagaatagtgggagtggggtatatggtcagggtgctcatatcctgctttagcctagctgcttcttacggagtgcaagggagaactctgagaagcagtatgtaaataccagggagctgattgctgaatattgtggtctcatctgaatattgtggtctcatctaaatattgacaccaggcaatgaagcagaaatagagtatgtgtccctttatgcgtgggtaacttaagcttctgtcatgtgggaagggggaccgaatcttccctgggaggaaggctccaaattctcactacttctgtgttacttgaagggggaagcataaggaacccagtttgaaggcaacattgtgtgccatgaatctgcttattaatcaacatgccttgttaatgtcctctgccctgaacagcccttactcagttctcatttggaaagttattttttggggttacatcctgtttgtttcagaatttaaaaccctccatggtgggtcacttgaggtcaggagttcaagattagcctggccaacttagtgaaactccggctctactgaaaatgcaaaaattagccaggtgtggcacacgcctgtaatcccagttacttgggaggccaaggcaggagaatcgcttgaacctgggaggcagaggttgtagcgagccaagatcacaccattgcactccagcctgggcaacagagtgagactctgtcaaaatcaaaaaaaccaaaatacaaaaaactccattgttctgagagtttcccctaaattatcggaagacactcacattgaattggtaggacctatagtatagaggagaatggtatgtatgtcagcagtagagttccaatccaaattgcgctatcgcattagaaatacattaccctcccactccccaagttcagcaaattagaagagaatctgaagtttgtaggaagggaataaagctgctataaacatttatgtgcaggtttttgtgtagactcgttttcagctcctttgggtaaataccaaggaaccaggttgctggattgtaagttaagagtatgtttagttttggaagaaactgccaaactgttccaacatgactattttgaattcccattgacaatgaataagagttcctgtagctcctcaccctcattagtatttggtgatgtcactcttgcattttagctaatgggtgaatagtggtctcatcgttttaattcccaatcccatagtgatgtggagcacctt

SEQ ID NO: 12041 - DNA, 25231 bp, Human
tatcatcccattttacagtggagggaaccgaggttcagtgagaggcagggacttgcccacgctcccagtctcatcccatactccccttctctctgttccagccccatatcctactccccttccctctgtcccagccccaacccatactccccttctctttgtcccagccccagggggcttcagttctttgaatttgaaactcacttctcccttgctgtttcctctgcttggaaaatccctgcctgccccagttccttctggccacaacttccatctggccttctctagcctccatctagagcttccccccatcactccttgtctgagacacctatttcctccacagcaatggccacagtctgtcatgatcttctctgtttactcgttctttttttttccttcttttccttcttttttttttttttttttttttgagacggagtttcgctcttgttgcccagactggagggcaatggcgcgatctcggctcaccacaacctctgcctcccaggttcaagcgattctcctgtctcagcctcccgagtagctgggattacaggcatgtgctaccacgcccggctaatcttgtatttttagtagagacggggtttctccacgttggtcaggctggtctcgaactctcaacctcaggtgatccgcccgcctcggcctcccaaagtgctgggattacaggcatgagccaccgtgcccagccgtttactcgttcttgtctcccccaagccagacactccatgagggcaaggactatttctgcctccctcattcctatattcctaggggttggcggttcctgacatttagtggtggatgagaaataaatgaaaacagacacatcgacggtgtctgtagttcatggcccaacttttgtgtcttgcccgccttccctttgcttagccaactcctatgcatccctcagtgcccaactgaaacctcccctcttctctgagccctcagagccccgctgtgcttctcctgctccttcctgggttgtagattcccatgctgtgactctgtctcttccacgacactgtaaccctcgagaggacactgtaatcctccgtggggagctggtttgacagattcaccttgcggggccccgaacccaggaggtgctggagtatttgcgaagtggagcaatgaatggttgcgccgtgagcatgcgcagttgtgttactgccatgattcgggggatgtgtgcatgcctggaacggggtaggggatcctgcatctccctcctgttctcggcagcttccttcccttccccccaggaagccagccagccgcccccgcgacgttacccttctcctggggcctcagagccctgcccatctcgggcagcttggacttgcaaagacccatccggccagcagctcttggggtggtcgcgccccgaccccgcccaggctctgacccctcctggctcggctcaacgtcacaagggtccccgccccggtcattttgcgggaatgacggggtccaccccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctagtgagtgtggatttggcggggttcgggggttccgacggcgacctcggcgacccctcactcaccgcttcctctttccgcagggccctagcagccagaatgtcactgaatacgtcgttcgagttcctaagtaagtccccagccccatctcccactcctctccaccccccaaaaatgaaaaccttcacgatcttcttagccagccatttctggccctgtctgtggttctccctccagaccgggagagacttggagggcagggctgggattaagctgaggcttctctggggacaacactgcttttttgaacgaatgaatgaatgagtgcattaatacacggtgatccagccccctggcctaaccttcgaggagtatatggtcccatgatgcccaggccagctgtaaggacatattcctcgtcctgtttcaaagtggtcaggctgtctttcctttccaggcctttgtacatcctgttcctctgccatgagtgcctcccctcaacccctaaactgtgactctgctgggtgaattcttgatgattctgcaaaactcaactccagtatcttcctcctccaggaaatactccctgcctgtcctccctcctccccaaggctgagttcacaataatctccacatcttgggttcccccaaatcttcgtccctccatctgctcttcttctgcctggggtcaggagaggatgggtctagcttctctggcagactgggaatccttggagtcttccgtatccagtgttgccaggcaaaacaggctgaatgaagctgggtgggtttgttgagtgaattgaattgaattaatgattcaattgaatggaatgattgaattgaattaatggttcaattgaattgagtgattgaattaaagtaatgatttgattgaattaacgatccagttgggtggttgattgaattaatggttcaatagcattgactgattaaattaatgattgaattgctgtattggattgacactacctcttctcatccactccaggaatacaaccaaaaaatataacatcatggcttttaatgcagccgacaaagtcaactttgctacgtggaatcaggtaagtctctgagtcctgggggtcaggggctggggtggtgagagaacttgaccctgaccttggtggttgtgatagttgcttaactgtcatagtcactaagtcttaattttctcacttttctccaagtgaagaaaagatagatgacaaagggttgggtgcagtagttcacacctgtaatcccagcactttgggaggctgaggcaggaagcttgcttaaggccaggagtttgagaccagcctgggcaatacaatagcaagaccccaactctacaaaaaaattaaaaagttagttggggctgatagcgtgggtctgtagtcctacataggaggctgaggtaggaggatcgcttgagcccaggggttcaaggctgcagtgagctatgattgtacgactgcactccagcctggataacagagcaagaccctgcctcaaaaaaaaaaaaaaaaaaaaaaaaaaaaaaacggaaatggcaaaggcccaggcctagctcctgggtgtccctgtaagttaggtttggtaggcccaccagaggcctctccttaaaggagaacatttagaagctgtgcccactgttggacatttttggccatggtttatctgggcaagggaggggactgggctgggggctttcccagagcccctgccatcagaggctctaaaaaggactttgggagccattaaagcatcttcaattgggaagttgtagtgtgtgtgatctggctgctatggggagacaaactgtgggtttgagggcaaataaacggagaccaaggtagaagcaactggactggtctaggtgagtcctggcagggcactggaggcagtggaggttatgagatgtggctgattctagagtgttttggaaatggtatatatggaccttaaatcaagagcttaagggtaattcggatcacattagccatgtaggtcacgataaattgttaatttgtagagattttggtgccttaatgtcagcaagtgttgcacaatgagtttctttttatttattttattttatttttttgtgatggagtctcttgtcatccaggctggagtgcagtggcgcgacctgggctcactgcaacctccacctcccaggttcaagccattctcctgcctcagcctcccaagtagctgggattacaggcgcccaccaccacgcctagctaatttttgtatttttagtagagacgaagtttcgccatgttggtcaggctggtcttgaactcctgacctcaagtgatccacccgcctcagccttccaccatgcccagcctttttatttttaggaaatagatataggatctcactatgttgcccaggctggtcttttttttttttttttttttttttggggactgagtcttgctttgtcgcccagactggagtgcagcgccaggatctcggctcactgcaagctccgcctcccgggttcacgccattctcctgcctcagcctcccaagtagctgggattataggcgcctgccatcatgcccggcttattttttgtatttttagtagagacggggtttcaccgtgttagccaggatggtctcaatctcctgacctcgtgatccacctgccttggcctcccgaagtgctgggattacaggcgtgagccaccgcgcctggccttttttttcttaagacagagtgtcactctatcacccaggctggagtgcagtggcatgatctcggctcactgcaacctccgcctcccaggttcaagccattctgatgccaggctggtcttaaactcctgagctcaagtgatccttctgccttggcctcccaaagttctgggattacaggtgtgagccacagcacaatgagtttcgatatgcatgcattctggagagatgtgtggaaattctaggtacttagacattttttgaaaagaatcctggaaccagatgcctgctgtagataatagggaagtctaattaattacttctacattcctcagataaggaattttgcctccgatggcctgcttgatggtcaccaggtggtctttttctctttaattttaatttggaaataatttcaagcttttaagttgcaaaaatagagcgcaaggctcgcccaaattccctttacccagatttgtcaaaggctaccgttctcctcccttgttgccaagtggtaagttggttttgagaatctagagcttggcctagggcaaggaagggcgttcctggaggggggcactgcgcaagcaaagccagggaccctgagaggctttgcttcctgctcccctaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagtaagtggtggggcggtggcggtgccggcttagtgaccagtccacatccccaggcctcaacttacatactttgtggggtaccctctctgaacctcagattcccactgctgcagtggaagtgctggcacttccatccctgtaggattttattatttatttatttatttatttatttatgttatcttattttacttacttgtatttttttgagacagagtcttgctctgtcgcccaggctggagtgcagtagcacgatcttggctcactgcaacccacacctcccaggttcaagttattctcctgcctgagcctcctgagtagctgggattacaggtgcctgccaccaccacgcccagctaatttttgtatttttagtagagacagggtttcaccatattggtcaggctggtctcgaacttggcgatcctcccgcctcggcctcccgtagtgctgggattacaggcgtgagccaccgtgcccagcctacttatttattttgagacagggtctcactccgttgcccaggctggagtgcagtggtgcgatcgtagctcactgcaggctccaactcctgggctcgagatcttcccacctcagcatcctgagtagctgggactataggcacgccccaccatgcctggctaatttttgtatttttggtagagatggggtcttgctgcgttgctcaagctggtcttgaactcctggggtcaagtgatcctcctaccttggtctcccaaagtgctgggattataggtatgagccactgcccaggccctggggttgtgtttttgaagacagttcactgagttggtgcttgtgcctggctctgaggcagctctgagtgccacaatgcaggaagcttaggtggccagccctgggagctcatgacacttgagatgacctctcagagggggcagactgagggcagaacaggaggggtccaggttaggttgatgaagggtgctccaggcacagcagttgggtgatagtgacagacacaggcagctcacacagggcagtgggtgccaggatgtgctgggtccagcggagccttggaaagctgtaggcagggaagaggcactcacccagactgtccggaactttggggtagaaaagaatgaggtagaggcctcaaggaggctgggcagttgtttaggcttgaggaaatggtggcccgggccaggtgtccacttcagatttggccatgccatggctgggcgcggtggctcacgcctgtaatcctagccctttgggaggcagaggcgggcggattacgtggggtcaggggttcgaaactagcctggccaacatggtgaaaccctgtctctactaaaactacaaaaattagctgggtgtggtggcagacacctgtaatcccagctactcgggaggctgaggcatgagaattgcttgaacccgggaggtggaggttgcagtgagctgagatggtgccactgcactccagcctgggtgccagagcgagactccatctcaaaaaaaaaaatttggccatgccttcccgccccatcttctcacttggctcctcagtttcccgggtgtggcccacagatagcagagctggaggcaaatgtagacagtttgactgcagggttgggctctcctgagataatctcacacagtctttccagaaatgatcccgatgtgcacacgcccagcactttgcagggtaggtgcgccggccctgttccccagatgtggaaattgacgaggcccaggtggttgaagggcctgcccaggcctcatgggcatttcttggtcttcctcctatggcaagtgccataaaggaggcaggccccggggggacacgggggggctggggctggtccctatgggccaggccatgaccgtggctccctgcaggttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggtgagtgggctgggtggtggctggggacagaagtgagggaaatggggtgccttgccatggatatatcaccaggccctgtgctgggagctggggactcaggggtaaccagggcagaccccactcggccgtctcagagctgtcagttcaggaggaaacagataggaggccttagggccacaatggggcaccccagagggtgctgccagagccagagtctgtgacccggagctcaaattggcagagcagggtggggtctaactgcccccttggctttccgcaggctgcaggtcacacagcctgatccactgcagggcagcagctccaggcagggcacccgaggagggtttctctagcagtgacatcggcctcagaggtggggcgggtgcagttaagggctgtggagggacacagtgcatgaggccagtgcagagtgactgtgggcagggggacgaggctgggggcccagagcacttggtcttggatgtatggctttggatgagaccgtagggccaccaccaccctagggtgcttgcagatggtggggagggcactctggacgcatctacaaatggcatttgcacaggtcacagatgagcagatgctcaaagagtcgatggctcccaaaggttaaaaaaacacctttttcggctgggtgtggtggctcacgcctgtaatcccagcacattgggaggccaaggcaggcggatcacgaggtcaggagatcgagaccatcctggctaacacggtgaaaccccgtctctactaaaaatacaaaaaattagccgggcatggtggcgggcgcctgtagtcccagtactcgggaggctgaggcaggagaatggcgtgaactgggaggcggagcttgcagtgatcctagatgttgccagtgcactccagcctgggcgacagagcgagactccgtctcaaaacaaaacaaataaaacacctttttccctctttggtgtttttttgtttgtttgtttgtttgtgtgtttttttttgaactgagtttcgctcttgttgcccaggctggactgcagtggcgcaatctcagctcactgcaacctccgactcctaggttcaagcaattctcctgcctcagcctcccaagtagagaaatgggattacaggcatgcaccaccacgcctggctaactttgtattttttgtagagacagggtttcaccatgttggccaggtggtctcaaactcctaacctcaggtgatctgcccccctcagcctccctaagtgtggggattacatccgtgagccaccacgcccggcctgttttagttttgttgttttgtttttttgagaccgaatctcgctctgtcacccaggctggagtgcagtggcgcgatctcagctcactgcaagctccgcctcccgggttcatgccattctctggcctcagcctcctgggtagctgggactacaggcgcctgccaccatgcccggctaatttttttctatttttttggtacagatggggtttcaccgtggtctcgatctcctgacctcgtgatctgcctgcctcggcctcccaaagtgctgggattacaggcgtgagccaccatgcccagcccctgctttagtttttaatcattttctttggttttaaaatttctgaagagtcataggttggctcagctccaaaagcaaccccggtaaatggcacgaagtcagagcgtcctccccaccaggtcatgagcctccgagcctgtggggcagtttctgtacccctgctcccctggaacaacagcccccaggtctgcctgcctgctccactttggttgagttcctggggctccactgtaaaatcagtcgatcaatcattgctgggggggcaggttcgcttttgctgtattttccttagaatctgctttgtaagttttagggagaagaatttggcattttatagaattgtgtaaaacctggatgttaaccaaaggagaaatgccatctctttttttttttttttttttttttttttgagacagtctcactgtcacccaggctggagtgcagtggtaccatctcagctcactggctcattgcaacctcgacctcctgggtttaagcgattctgcctcagccttgcgagtagctgggactacacacgtgcacctccccacctggctaatttttgtacttttagtagagaaggggtttcagcatattgcccaggctggtctccaactcctggcctcaagtgatctgcccgctttggcatcccaatatgctgggattacaggtgtgagccatggtgcccggccagaatgccatctcttgatcagatgttaaatctacttagctaagaactgttcaggctgggcacgtggagagcggatcgcaaggtcaagagttcgagaccagcctggccaagagaccagcctggccaatttggtgaaatgccatctctactaaaaatacagaaattagccaggcatggtggcgggcacctgtaatcccagctactcgggaggctgaggcaggagaattgcttgaacccgggaggtggaggttgtggtgagccgagatcacaccattgcactccagtctcggtgacagatcaagactccaactcaaaagaaaagaaaagaaaagaaaagaacaaatggtgatggtgtctcgccatgttgctcaggctggtctcaaactcctgggttcaagcgagcctccagcctcggcctcccctcccaaagtgctgggatgacaggcttgagccactgcaccaaactgtcactgttttttggtgcatggctcagtgtggtaaagccactcacagtgttaagcagcagtttcattatctttcacaccagcctgggccttgcccatgttagatgcattcctattaaatgcagtcctttttttttttttggagacagattcttactctgtcaccgaggctggagtgctgtggggcaatcttagcttactgcaacctctgcctcctgggttcaattgattctcctccctcagcctcctgagtagtcaggactacaggcacatgccaccacgcccggctaattttttaattttttgtagggatgaggtttcaccatgttgttcaggctgttctcaaactcctgacctcaggtgatccacttgcctcggcctcccaaagtgctgggattacaggcgtgagccaccgcgcccaacctggcctgcagtcctgttttttaaagcttccctgagcaatgagacaacgttacattgttccaatggaaacagtatgttttgtcattaaagaaaaatacatctataaattaagataacaaaagatctggctgggcacggtggctcacacctgtaatcccagcactttgggaggccaaggtggatcatgaggtcaggagttcgagaccagcctgtccaacatggtgaaaccctgtctctactaaaaatacaaaaaaaaaaaaaaattagctgggcgtggtggcaggcgcctggaaccccggctatctgggaggctgagtcaggagaattgcttgaagccaggaggcggaggttgcagtgagccgagatcacatcactgcactccagtctgggcgacagagcgatactctgtctcagaaaataaaaaaataataataaaaaatagcaagaaaccagtgtgactggattggggccagactctgagtccgagggaggtgctgagactccagcagcacatggggacctgctctttgagggactcggggcagaacgggaaggcaggaagggctggctctatccgtgtggtttcagggagtcctgtgccacagcccaagtccccgggggccacatcaccttgaaggctatgtgggtggtgccctggggctcgccccctgcaagcacagatgcagggtggtgccaggcccggcatgagcccccctgtgcctggcccgcaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggagggtgagtacgggcgcctgggcattaggtcacagaggtgcctgctcaggcagtgccagtgaaggcaaagtctaccatcgctcacagtggccctagaatgagaggcaagtggggccgggcacagtggctcacgcctgtcatcccagcactttgagaggctgaggcaggcagatcacctgagatcaggagtttgagaccagcctggccaacacagtgagaccgtgtctctactgaaaacacaaaaattagctgggcatggtggtgcatgcctctagtgccagctactcgggagactgaggcaggagaattgcttgaacccgtgagatagaggttgtgttgagccgagatcacgccactggactccagcctgggcaacagagagagactccgtctcagagaaaaaagaatgagagtcaggcgaggccgcctggaggagcagtgatgtcagtcaggaggcaaggccagagcccgggagagctgagccatggcccttcttttttttttttttttttttgagacaggatctctctctctctcacatgggctggagtgtagtggtacaatcacagcttactgcagccttgacctccgagggtcaaacgatcctcccacctcagcctcctgagtagctgggactacaggcgtgcaccaccacacccggctaatttttttttttttttttggagacagagtcttgctctgttgcccaggctggagtgcaatggcgcaatctcggctcactgcaacctctgcctcccaggttcaagtgattctcctgcctcagcctcccaagtagctgggactacaggcatgcaccaccatgctggctaatttttgtatttttagtagagatggggtttcaccatgttggccagactggtctcaaactcccgacctcaggtaatctgcctgtctcggcctcctaaagtgctgggattacaggcgtgagccaccacgcccggcctaatttttgtgttttttgtagagactggggtctcactcactgtgttgcccaggatggtctgaaactcctgggctcaagccatcctcccgcctcagcctgccaaagtgctgggatgacaggcatgagccactgcacctggcctggctgtggcctttacgggggttcctatgagaaactgcaactctaggttgaccagtttcaataactcctgtgcgctccgggctgtaggggctgtgtccctggttatcaggtgcctcgcccgggtggtctgggagagggggagtggtctgtgagcgctagagaaggtgggtgggggtgtggggtctgccgggagtttgtttaggagagctgagctcctgggctggccctggaggtgtagtctccccagtcagtgaggccccccaggatgtcaaaactgcacaaaatgtgaaaaacacaataaatacccactgccttcctcctcactttccctcctttccttcctttcctcccttcccagggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccaggtgaggccgacgggaggcgcctgcgagaccccatgcagcctcgcgagcgcgcgctcatcctttgccatccccgtcttacagtagctcccaagaagagcctgagagcaaggccaaggcgccgcagcaggaggaggggcccaagggtaggcgatggctgggcgggccggggagatgggggcggtgcttccctgctcttgctcataccctgcccctcccaggtgtcgatgagcagagcgacagtagtgaggagagtgaggaggagaagccgcctgaggaggacaaggaggaggaggaggagaagaaggcacccaccccgcaggagaagaagcgcaggaaaggtgcggcgcatgtggcccccatattggaggcttgggtcgggccctggcgccctgccacctcctcccctctcccctgcaggcctccctcatctgcagtggaggcaccagtgggcaccgggtcccggggttgctctggccctgacccctttcctgtgccccgcagacagcagcgaggagtcggacagctcagaggagagcgacattgacagcgaggcctcctcagccctcttcatggcggtaaggcccagcccggtggcgggggaggcctgggcgtctgtttgcagactcacccacctcccaaccctgacctctgcagaagaagaagacgccacccaagagagagcggaagccgtcgggagggagctcaaggggcaacagccgcccaggcacgcccagcgcagagggtggcagcacctcctccaccctgcgggcggctgccagcaaactcgagcaaggtgagtgcccgtggcctccccgctccccacagccacagccacagcctcctgacctctgttggggctcaggacagagaggggatggagatgcgggtggaggcctgtctctccctgatccccttgaaccctaatcctggcactgcccagcctggggtcctgcccaggggttctgcctcctgcctgcaagactcagccctgaccccactcccacagggaagcgggtgagcgagatgcctgcagccaagcggttgcggctggacacgggaccccagagcctgtctgggaagtcgacaccccagccaccatcaggcaagacaacacccaacagcgggtaagttgacgaggacagcagggggcagggcaagggctactggggacaatctcactgatgccaccttccccgtcctcccatcctcagcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattgctcagatttctttgtttcctttttagatctgctactctgtttggataatgtcttattccttatgttttggtcccatctttcatggttttatttttatttatattttaggttttgagacagggtcttgctctgttcaccaggctggattgcagtgtccaccgtcttggctccctgcaacctccacctcttgggctgaagcgatcctcccaccttaacctttcaagtagtgcacaccaccacgcccagctaattttttaattttttgtagaggtgaggtctcactgtattgcccaggtcagtcttgaactcatgggctcaagcaatcctcccacctcagcctcctgagtagctgggaccacaggcgtgtaccattaaatgcctggctaatgtgttttgtttttgtttttgtttgagacagagtttcactcttgttgcccaggctagagtgcagtggtacaatctcggcttactgcgacctctggttcctgggctcaagcagttctcctgcctcagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgcctgcagccactacttttgaacccatcttccgggcaatcccttctgtcttgccggtggttggaaacttgcaggtggaagtcttccccacccagttctgcagcccttggctgccgagcaggaatgcctgagatgtctggctaattcctcggaatgtcccagttcaggccaacctccctcccccttctcccaccaggccttcttgggcagcagggaggcagctctggagggagccgctgcctcagcagtttcgccccagccacccccactgcctgggccttcatgtaaggaggctgggtggtgaggccctgtggtgaggagcaggggttttgcattcacggaggacctgggttcaaataccaggaccgttgcttaattctgggtgacttcaggcttttttttttttttttttgagatggggtctcgctctgtcgcccaggctggagtgcagtgacatgatctccgctcactgcagcctccgcctcctgggttcaagcaattctacctcagtctcctgagtagctgggatgacaggcacgccccaccacggtccagctaatttgttttttgggtttctgagacggagtttcatgctgctgcccaggctggagtgcagtggtgcaatcttggctcactgcagcctctgcctcctgggttccaagcgattctcctgcctcagcctcccgagtagctgggactacacccagctaattttttaatagagacggagtttcaccatgttgaccaggctggtcttgaactgacctcaggtgatctgcccacctcggcctcccaaagtgctgggattacaggcgtgagccactgtgcctcgcctaatttttgtattttcgttagagacagggattcaccatgttggcctggctggtctcaaactcccgacctcaagtgatcctcccacctcaccctcccaaagtgctgggattataggcatgagccactgggccccgccaggcttttttgagacagtatcgctctgtcgcccaggtttgagtgcaatggcacaatctcagctcactgcaacctccacctctcaggttcaagcaattctcctgcctcagcctcccgagtagctgggattacaggcgcccaccaccatgcccagctaatttttgtatttttaatagagatggatttcaccatgttggtcaagctggtctcaaactcctgacctcaggtaatccacccgcctcagcctcccgaggcatgagccaccacgccaagcccaggcttttctttccatcggaaaattatcatctcaataagcacttcagtaagaaaaaccacaacataatcatcgaagcaatccctcacggatggagttgaggccacttccagactttcctaatatgaagaaggcatcagatgtccctgtgctggctgtttcacttgcctgtgtgggaggaaccccgcaaacagggctcctggggcagagggtgtaatttacaattccccagtagcagctgctcatccaaagagctgctagcaatttacacccccaccaacagcacagggtgcacctgggtcacacgggttgtgtgtgagggttttctgattttccccaatcttgtgggtgcttagagtcaagcaccccttcggacaatcacaagctgtttgcttgtttttgcattcgaagctacgggcactgccttacactctaagtgcccatctctttcctcaccaagccgagtaggaggggttctgaggagctcccctgtaccggtgaggggactgggctcacacggggctgggtatggaagcctcgagagcccttatctgtctgcatcgtgctagacgttaccatgacctggacagcctccatcgccccgggggctctgacatgctcagatcccaggatggggctgcagttataggggtctcaggttggccttcccgagacaggcgtccctgtccccttgtgtccccacccttggctgtccccaggcctctcccttttcctgttttgatgctggctcagccaggcccggagacaggggcatgatgtcctaatcctccaggcgggagccaccatggagggttcccgtggactcagtcccctgccaagccacctttcccagcactcacatatgctccacctggcacatgatacacgtgggggctcctgagccccagcaccctgacttagtggggagggaccccaccggggtcccatgaagccccctgacttccactccaggcagcaggtcgggggaacaccagttgcctgccctggccgccagcacagcactcgtaaatcagggggtgtctggggcgtcggaaatggctgtgtggaatgtcggggtggggtaggctgggggtgagcccttaactcttagaagggtggggtgtggggcagaaggagcagatgcctggattcgagggtgcaggagatgggctggtgcagacgtggggcctcctggctgcaggggccggcagtgaagaggttagctcccagcccaggcagggcataaatttggggcacagctcccactctcaggacctgcccgtcacaatggccgtagggaagttcctgctgggctccctgctgctcctgtccctgcagctgggacagggctggggccccgatgcccgtggggttcccgtggccgatggagagttctcgtctgaacaggtggcaaaggctggagggacctggctgggtaaggacttccagggaccctctgtgacttcccaactttccccagccctgaccctgctcactgtcagcgcccttccctcccacaggcacccaccgcccccttgcccgcctgcgccgagccctgtctggtccatgccagctgtggagcctgaccctgtccgtggcagagctaggcctgggctacgcctcagaggagaaggtcatcttccgctactgcgccggcagctgcccccgtggtgcccgcacccagcatggcctggcgctggcccggctgcagggccagggccgagcccacggcgggccctgctgccggcccactcgctacaccgacgtggccttcctcgatgaccgccaccgctggcagcggctgccccagctctcggcggctgcctgcggctgtggtggctgagggtgcccggcctggcacccagaagctgcagtgctgggggagctcggctgacttatttattggagacctggatgcagagacaacgaggaggggagtgggctggggcgaccagcagtgagtgcaataaaggacaccactctcccggccttgtgactttgaccatgtgtccagccagccacacctggagctccctatgggccagtgccatcctgggttcccctgcaaatcccggccccagcaagcagccactgcaatgtcccagttaggctgtccattccccaactttattcacaaatctggtgtctgtagaaagctgggggtcagcaggctgggggcggctgtccagactcccctggccccatgccctcagggagggagcggcagatcacggagatgcgccggccccggggaatccggcgttccccaaagaaggactcttcatcccgaaggatctcatgggagaagtcataacgggctgagcccctgcaggaagaaacaggctgtgactgggtgcaaggagggcagcccctgctccaggcagacctggattccagcctcctggattccagccccctgctgcctcccacacagaccctggggtaaaggcgtcttcggggagggctggattgagggaaagtacccagggcacagggtgggcggatggcacattcttggaggggtgggtgctgcctggatggaggtacctaaggatgtagagggagcccggctccagcaagagttccagccactcccccggctcctgggtgtgcaccagccgcataacgctgggagacaggagagacaggccggcgatggtggccccgcagaactgcaaaagaggcgtggggatgggtcaggatctaaccgggcctgcctaccccctggctgggagtgccaaggcaccgtcctctgcccaccttgatgctgtccacgtggggcttgatgtagccgcgggcttccaggtccagcacgtgcacggaggagagcagggtctggccggggccaaaggcggccgcctgcacgcgctgcaggatggcccggctggcttctgaccagcgcgacttctctgtctctcggaagccgtggatggcctgcacagagagctcggttaagcctgggagctcccagagggaacaaggaaactgaggcaaggaggggcagaaaacggcaaggggctggtttccctatgtgactcttgaccctgccctcaactcaaactcccctagcccctcaactatggccctacctaggtgtgacctcagtccttagtactcaccctgaggctacaattccaggtccccaatgctggcccggccccagcattcaattggctgaatctccctacaacttgaccccacccaagtgtcctgtctctgtctctcaacatcatctggctccacatccgtttccgcccctaaccttggtcccaggtcgcaaaagtgctctccctgaccccaaggtcctcatcccccaggtcccgcccctcccacagccagagtttcagcccagcccccaccatagcccagctcccaaatccctgcaatagctaccgaccccaaaaaggccctgccccatcccagcatgtgtctcccctatctccgcccccagcgtggttctgccctctctaaacctcgacttccccgtcccccccacagcatggccccaacccatcccggcgcttgactccacggaccccgccccaagcttggccccgccccatccatgcgctcgacgacctgaccacgccccaatcccagccgccacgttcttctgcactgtaactgctagcagcgtaatcgcaccccaaccctacacccgactccctggccccacccccacgctcgactgcgctgtaaccgcccccaagcgtggccacgccccatcccagcactggtccccactgtccccgcccccagcgtggccacgccccgtccctacgctcgcctcctgtcccgcccccagagtgcccccgccccatccctgcgctgtctcctttgtccccgccccagcgtggccccgccccatccctgcgcccgacccccctggccccacaaccccagcaccgtagccccgcccccacgctaaacggtactgtaaccgcccccagtgtggccctgcccggtcccggcgctcgtctcctctgtccccgctccaaatccccgctctaggtaccgcccccagcgtgtccccgccccatctgatgctccacgtccccaggccgcgcccccgacgagcccccgtccctcgcccccggcgctgccggtctcaccgcgtcccagtgatcgtattcgtagcggcggcggcgcagctcgggctccagttctcggctcagcgtctcctcctctgccgtgctcaggaagccaggccgcaccacggccgcgtcctgcaggcggctcagcacggaagggcccgagcctcgcacccagctgggccctggcagcgtccgcagcgccagcagcccagtcccggccataatcccggagcggggtcatgagagagggcagggttggggaacgcccccgccaaaagccattggcggtacctgcggcagcgattgacttccctcagagtcccgcctctcgctcatagctattggttgctgctagactcgccttcacaggctattggcctttttccagaacccgcctcctctcttgagcttattgggcgccacctcccgcctgacttacaccagtggctgagtcgcaagtccgtctgcagcttagcaccgcctctttaatcattagaaaacgtacaccctaggggttgcctggccaagacttcataaggggatatgggcagtatctggtctgaagtccggaagtcagggggactggggccaaggccacggttatggagtcgactagggctagaggttaagggcagagtacagtcaggccgagataagggtccggggtcaggggactgacgtcaaggccacgattatgtgtgtggtggggccagctatccagagttagggcttatggtcaaaggtcagagcgaggtatcattcatttccccgtctccgtatcactattactttaggtttgaaaatggcattatggttgtctttttgattcctcggccgggcgtggtggctcacgcctgtaatcccagcacttcgggaggccgaggcgggtggatcacctgaggtcaggagttcgagaccagcctggccagcatggtgaaaacccgtctctactgaaaatacaaaaaatgagccgagcttggtggcgcgcgtgcctgtaatcccagcgactcaggaggctgaggcaggagaattgcttgaacccaggaggcggaggttgcagtgaacagagatcccgccactgcactccagcctgggcgacacagcaaaacattgtctcaaaaaaaaaaaaaagagtcatcgttttttacaaacgcaaactgaaaaaaaaatatttacagaaaaaagatctctgggatttgcttccacataaatccaggctgtgggggcagggagggggcgggtagggaagaatcatctttgaccgtgaattaattgttgaattggtgtgataagtacgtggggtctcattaccctgttttctctacttttgtttatatttatttttatttgtttatttttgagacagagtctcactctgtcgcccaacctggagcgcagtggcacgatctcaggccctgaagatttgcaaccgctgcctctggggtttaagtgattctcatgcctcagcctcccgagtagctgggattacaggcaacgaaccatcatgcccagcttttttgttttgtttgtttttgagaccgaatttcgctcttgtcactcaggctggagtgcaatggtgcggtcttggctcactgcaacctctgccttccgggttcaagcgattctcctgcctcagcctcccgagtagctgggattacgggaagctgccaccacgcccaactaatttttgttttttatttttttggtttttgggtttttttttttttgacacacagtctcgctctgtcacccaggctgaagtgcagtggcgggatcttggctcactgcaagctctgcctcccgggttcacaccattctcctgcctcagcctcccgagtagctgggactacaggcgcctgccaccacgcccggctaattttttgtatttttagtagagacagggtttcaccacattggccaggctgatctcaaactcctgatctcaggtgacccgtctgcctcggcctcccaaagtgctgggattataggcctgagccaccatgcccggcctttattttattattttctccctctattgcccaggctggagtgcaagggcacgatcatagctcactgcagcctggaactcttgggctcaggtgatcctctcccctcagcctctcaaagctctgggtacttttgtatgtattttaaatgtgcataatgcaaactgcaacactgtaactgctgagcgtagcgcccccccgaccccggcccgaatgcttgcattttgaaaaatattgaccccatttctccctccagctacatctgcccccccaccctctgctccccttgatagtgtaattcctcgaaagacttgtctatgtctgatatgtttcctcctatcctttctggatccactccagcctggcttttggctcccacagcaccagaaaaggcctgatttaaggccaccagtgacatccacaatgccgaatccaatagccaggtctcagtctgactgttaatgagcctacatgctgatgccgcctacattttgttttttttgagacagagtctcgctttgtcgcccaggctggagtgcagtggcgcgatctccgctcactgcaagctccgctcactgcaagctccgcttcccaggttcacgccattctgccgcctcagcctcccgagtagctgggactacaggcgcctgccaccacgcccagctaattttttgtatttttagtagacacggggtttcactgttagccaggatggtcttgatctcctgacctcgtgatccgcccgcctcggtctcccagagtgctgggattacaggcgtgagccaccgcgcccggccgatgacacctacgtttttatttcaacctcttgaccctgatgtcgagggacatatcaaaacatcaggtataatatatccaaaatcaactcctgatccctccccaagcctgttcctttgcctacacttcccatctcaggcgacaggtctccatcttcctgctttgggccatcagctcggagtttctggaaactgctctctgtcacatcccacctagctagaatctgactttttctcatcactcggccagggctgccatcagctttcgtctagattactccaactatcctaactgctctc

SEQ ID NO: 12042 - DNA, 50 bp, Human
  misc_feature (1)...(50): n = A,T,C or G
hctnmgakrbkngthrntsndstartsndndchrgarntgastartgand

SEQ ID NO: 12043 - DNA, 44555 bp, Human
caaatgctacttcgttcttgtatctgacctctgcagtttgtggggctttcaattttcactgtttagttcgttagtttattaatttttggcttattttctgtaaggaattctctgcaacattttgatgccttcaacctgtcttaccctaagaaattaaggaaatctcttatgattacgtctaaggccagtaggttctaaatgagtctgtaaaagtgacttctctaagtgtgctgcaatgacctaatgacttgtccgttgttacctggcagaactttctgcttctttccaactttccagctgcatttcagataattaaagttattttctctcaggacagaggagcgggactactgttccacgtagacgtatgtgtatgtattaccaaaaaaaaaagttaaactgttaaagtaatcacgggtgcagtggctcacgcctgtaatcccagcactttggaaggccaaggtgggtggatcacctgaggtcgggagttcgagaccagcctgaccaacatggagaaaccccgtctctactaaaaatacaaaattagccaggcgtggaggcacatgctggtaatcccagctactcgagaggttgaggcaggagaattgcttgaacccaggaggcggaggttgtggtgagccgagatcacgccgttggactccagcctgggcaacaagagcaaaaactccgtctcagaaaaataaataaataaataaataaaaataaattaatcattactcattgctgtttattaaatgccttttctgttcccactgtgattctacaatcactgcctctgtaaaaccccggaatgcaggtgttcttgcctccattttatagatgaggaaatcaagactcagggcttccccaccaggccaaaggcattctgtgagtagtttatttcaattcaacatggctgtgctgcacatggcagttggagtaaagatctatcagcatcgggggttcttcatgatctaactaaagtgaatcatgagtgctttcccactgcgtcaagaaggcctggagtttgtgcagcccggctagaggtgagcaaagcctctgtgttgcaaatctccagggcgcagcctctcattgtattcaatgcagatgacagtcccaaaggcaccgcccatacattgtacagacagctggcctggctctccggattgtgcaggataggccttaatggcagaaggtaggggagaggtgggcgtcacaaaagtgcttggggaactataaagtaaacaatgaaaagcagcacaggaaggttcagacatcacacaggagaagcacagggtgttcccctgggtggggatttaaaacaagggcctcaagttccctgcccttgtctctgggcagaaggggcagataatgctatgatacattttttgtaggtggtgccatttgactgcatttaaccaacaaaggtatgtatcgaaatccacgtggaggttttcatggcaaaagtagagcgaattcacaaactgcactgtgtctggcagcttcagacaaaagcaatgggaacaaatcacgactcttgtccagcaattcttcctgttttggaatgatctttgctcaacagcccatccatgagtacagggcccccaaaggccaacaagacagggactctctccagggacaaatgccccgcagctgagagaggccgcccagctatccagcggccgcgcagccagccaagatttcaacacaggtctgccctatttggtcaccatccccgacagtgctgggccaggccatcatgtcacattggggagttttccctgcactccagggggaattctcaaccacaacctctgtatccggtagtggcagatggaaagagaaacggttagaaaagcgtggttcttgcgcaggaaagttggagcaaagaagagttcagaagtgggcgggtgtgtgtttaaaaaaaaaaaagggggtggaaaccccaccagccaagtctgcagaaaaaaaataaatgaagtctgcctatctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcgctccgagctggagaagccgccagcccgccctcccagggcgtgtcgcccgctttctgtttctttgtgcggggcatgtgaaatgtgtggggccagaattgtctccctaaagaacagttaggtgagagttcacatcacaagttgcttctgtgctgctccccagccagggtccgaccggccaggctccggtgaactccaggcaactccagccttgcccagggacttgctcgctccgctgggcgccgcaaaggcacacagatgcgagggaatcctgcggcctggatcctttggggatttgtaattcctcgctgctggttttctcttttaaaccatcacgttttcttgctgagaggaaatcatctgtgatgaaagtctttgtagatgcttggaaacattgctgggcctctctctgccctcttcctctgccgttggacttttgcaataaaaactaccatttgattttaccaaaaaacctaatgtacatccctcttacccccaccctgccgcggtctgattcttagagtctgtcagagaggagatatcctgagcctatcatgtgacaatgataccttattgatatgataatgatatgggtattggagacaccaactcttttataagtctttgaaatccagggggttgtgaggcctcacccctcaccccgcctgagcttggagcttggcgtggaggagtgctgcttcggtctacgtgtgtacacggcactccatgtgcctgtggttgtgcttgcgtcagcctgggagtgcgcaggcatcagtggtgcttgggagcgaggcccctcagtctgcactgggatcatctgcactgcctataaacaaggcagcctctcttagctccagtttcctcatctgcaaagtaggaaagtaggaataataacaggagataactcatccagcagcacgaagtgcgtataaatgtcccggcacggagtctgacacatcctaagtgctggatccgtgctgggcatgtttatataattgcacatgagactgtggttcccggagcacgtaacttgagcatatgtttatgtgtgtgtatacggcaggtcctgggttaaagggacaggagccactgtcattattccaattcagtcactgaggaggtgaggctgagaggcattctcatgtctgaagaggatgggcttgcctgacccccgcccccgtgcccagcccagcccagcagcccaagcagttctccaggactcaggtttcagaccttcaacacttgccttgggagacaaacagcggtgcagcccttgcttgcaagccattccacattagacttcggattgatttatggcaggatccctgctgtgcgagaactgcagggggggtggggggcggctatttcttgctgctaactcaggcaggatgtgtctatatcctgtctcagtttatgtagctgctcatcagagccagaggttagagcggagaggacccacttccgccaggccggcctgctctgctcagctcagctgggctaggccccaatgccacagttactgcgcgtgagtcatgcacagcaatccattgccttgcccttggatggaaggggtcaaggctcagtgagaagacggccaggtttggcagctttatatagaattcaccgcctctggcagaagcagaggattgcattaagtgccaaatgaaattccacctcagccattgctcaattcctccagatgtcactggcactgggagtcacatgatgctggtggtcagcagctggacccttccaagggtgcccgtggttgggcaagtatttctggggacttgcagagctccctggggagcaaagggttgtgaagtacaaggcattctgcgcttgtggtgggaacaagtgaacccatctgcagtgagtaggaagaggtcccctcaacagaggtgagaggttgggccaagtcaagtcagtttgcctcttcaggtggcagacctgtatgtacatctatgcctcaagtgcctgtctgaggccacagccaaaacatcttccagtaactgagcatacccagtgggccaacaagcacgctctaaatacaaaaccaaacaaacagtaaagttaacagtgaatgaagagttaaaaataggagaaagacaccttctccctacctcaatggcaattactttatttattgaggataatccttctagaagtaaatttgctgatacaaatatttcttattttacataataaaaatgcattttatatattttacttcatcttgttttttttccatcagaatatctcttaaaggttataccttgttattttctttaatcagttcctctgctgatgggcatttaggctgtatgcagacttcatttaatttttttaaaccacacacagcagtcctgtgacaatgagtaaggaggattttacatgcatgtgtctgtaaactgttaggataaattctcccacctcagcatttgatttctgggacaaagtgtgtattcatttaaaatgttagtagatcttaagaaactaccctcctaaaggtcacaccggtttctcatgctcacaaatagcctatgaaagtcactatttccctgcgtcctcactcacactgcattttttatcttggccaaactgagaggtaaaacaacaaaacaaacgctgtcactttggaatgagcctctgtaattaagtgagactgagcatgttttcttacttccataagaggttgtattacttttcggggaagtgtcggttgatgcttttgtccatttcctgtcagcaccccacccccgtgaggaaacgtgccccagaagtgaaaggacgtgtcctcatcacatgacgagtgaggggcagagcagaggccagagcaacatccgtgctgtggagtcagccctgggtttgactgccctccaatgttcaccagctttgggagagagaggaaatacctcagcacctcagttttcccatctgtgagtgggaatgataacagccacttccccagagtcacccgaagagcaacagcagaagggcctggacctgctcccagtggcagaggcttgggaggtggcttttgttagcgaaatttattggagcaaacctggcctgaggatgctggtaatttcaggagtcaccctccagacagctgttgtttttcgcttttgataaaataacaacaaacttagatgccgagccctggtaaggggctttcctgggtctcccctgcacacctgctatgataggcattttcttttctttttctttcttttctttttttttttttttttgagacagagtctcgtgctctgtcactctggctggagtgcagtggtgtgatctcaggtcattgcaccctccacctcctccacctcctgcgttgaagagattctctgcctcaacctcccaagtagctaggactaccggcatacgccaccacacccagctaatttttgtattttttgtagagactttcggatgaaacaccagaggctcgggggagataagccgccatagggcacccagacactgagggcgcagccaggctgtagttacaaactgccagaccccacaggcaactgaggccaacccaaggagagagttgcagggtatgtgggcccacagcttgtatgtgccaggcagggcctgctgctgtggctctgcacactgaggaactgcatgcacagacactcaggacccgcctgcctcccccagctcctcagccgggcctgtgtcccaccccagtccaccgttgtgtccatgctgtgctttctgtggtcaggcctggcatgctctgggctgctgctgcccttgcccgccttagcagctggctcggggtggccctcgagccctccctcacgcaccgtcccaggcttgctgcctttccagctgcacctctcacaactgttcacgacaggcccctcaacacgccgcgggcctggcacacactcacctgctggtctgctaggacccagtttcccaagcctagaaaacgacccaccacagccttgggcacagtttgcagccctgacagattcctgagtctgccttttcccagaattctgacctctccaggggctctgtgaccccgcctgtcccccactcagggcctgtcacagacaggggtttgctgagccactttgaggcaggtggatgattgcagggatgacccaaggcccacgctcccaggactgccaccattccaataccaaaagagcctttaaaaagccttcactcaggagctcctggtccagaacttggcatggacttggaggccagtaaatactaagttgaaatggacaggagtcaaccccaaacaaattctaaaggcacagttgttgggccccaggaatcccacctagtccttcccaccttctcacccagctggggttcattttcatatccactcccttcccctaccccacctccctctcatcttggcctggggttttcttcagatccttacataatcggaacttctgacagaatgctggctcctctccttagactatacattttcatttttctacattcttccagaacaatgttcctatacaaaatcttaacccatggcagaaactggcaagagcccatttcccatgtgcaggcagagccaggccggcgacactgggttccttcttaggcaaggcgagggttgggtggaccctggcatgacttctccagcccctggagagcctctgcagttctgaccccttcacaagtgagccctgggcttggtgaggggtgcctgcctcgcctggcatcccccagctgtagatgggggcagagcaagacttgctgccaacctgcctggctctgtggtccctgctccctctcccgttctgctggcgtcaccacccctccttcagaactctctatggaattgcattctagtctctcctgcttctgcttatgcatgtgaaagccagatgccccttctctctctctcttttttttttttttgatacggagttttgctcttgttgcccaggctggagtgcaatggcgcaatcttggctcactgcaacctgcgtctcctgggttcatgcaattctcctgcctcagcctgccgagtagctgggattacaggcgtgcaccaccatgcctggctaattttgtatttttagtatagacagggtttctccatgttggtcaggctggtctcgaactcctgacctcaggtgatccaccctccttggcctcccaaagtgctgggattgattacaggcatgagccactgtgcccagcctaccagatgccccttctcttattgccaaaacactgtggtcacacactgcttggggcccagcaggcacaacagtgacctctttccagggctcaggggaggaagctccgcttcggggcatgtagagccagccctgggcagggtggccttggttatctccctgcacccctggcacaccctgatggctctgtttatctgcactttgcacatgatggtcttgactgacacatcctcgcagagagccactgccagggcgcctcacacccgctgctcccacacgcagtgggcatttttacgaggggctcaggcacagggtctccagctgacccagcccagcactgccactcttcctccttgaactctggcatggagaatcttcacattttgtcagcagccgatgagcacatgtattctcagcacagtcttaaaaggggggaaattatgggttgccagatcaaaacctgataaaacaatgatgcctctggtgtggggcccagccaagcccttctcctgtattcaccgggcaacaggggcccattggatatgaaatccactttcgcttgagaaactcatccagtgctcttgctgaaacctacacacaggccttagcaatgcttgaagcttcaagttcaggttccccttctgtattttttcttaaacctttagctcaaatagactttgtgtcaatttgctagtgataaagggttagctttgaaatctgaggatgaggttttgggtctggatccactatgagctggctgtgacctgggacaagttgctggtccatcgtctggcacagggatggcttcacagggatgggacctgcccagcagggtcccgcacttcctaggtttaatgctctgtcactgctatcttcaaattcttctcttttgaataagaggcctcatgtttttattttgcactgggctctgcaaattctacggctagtcctgaacctgtcaatggagctaataacagtctctacctcagggctttgttcggaggattcagtgcattctcacagataaacatcctagtgtagtgcctggtatgtgctcataattgtgcttaattgcttccgctcactgagtgtgtgcgtgtgtgcttaaacgccagcttcctccccactgccctgctccctccttgctctccagactcctcagatgtttgcccctttgccactgaaagtcatacccaatgacagggggccatctgcatctgtgtggtcccacagagaccagggaaaggccctctcgctcccgatgctgctccttcatggtttttattgtttttgtttttcttttgagatggaatcttgttctgtccccaggctggagtgcagtgacatgatcttggctcactgcaacctccgactccctggttcaagcaattctcctgcctcagcctcccgagttgctgggattacagacatgtgccaccacgcccagctaatttttgtatttttagtagagatgtggtttcaccttgttggccaggattgtctcaatctcctgacctcctgatctgcccaccttggcctcccaaagtgctgggattataggcatgagccaccacgcccagcctccttcatgtttttatccaggagtcagcactgcggtggagacagcccagaaaacacacgcaggccctgctcttggccacgcacgccagctgtgtgatggggagcaagcctcttaccttccggagctccatttcctcacatcaccctggagagaggtcatctttgcccccacctcatcggggcaccagcccctcaaccactcatacctgggccatctggttctccatggagaagagtaggctctttgaaagcaccgtatgagtgaaggaatgagtgaatgagtcagcaaacggatggagggatgtgaaggtccatccatgtaggcaaacaaggtctgcaaagagtgccctgggccccagcattcactgcaccctctccctgccctgggcaaggccctgaccctggtgcactctaagctcctctcagctcagcccctgacctctcccctgtctgccagtgcccctcccctgagtgtgaagccgggggcctccttccctcggctcacctggccctcatgcgctctacctttcaatgtcttctttaggcagtcatttctcctttttccttcatgctcccctttgaatgggcttggagctgggtctctctaaggttctggtctctctctctctctctctctctctctctctctctctctctctcttggagaaagctccttctcagccttttccagcttttccaggtcccaaactcctgggaggggagccaggccttgcttgatcatgccctggatggatttgtcatattaatccctttccttcaacttcagcaaaacttctcattttagcgaaattaatttcagttatggttgaaaatcctgagtattccctttttaaaaaattttcatagtcttttttttttctttgtcactgattctttacactatcctgagccatcctcctcatctggtgacagtagccctgtctcagagagtagagatgaggctccactccacagacgccatctcatttagccctctggcagccccagggaggtatttttatctccattttgcatgtgatgataccgaaactagcaagtggatgtgacttccagagaacctaccagcccctcacacctccttctcttccccctctacattgaaagctcagccagggcctgaccccagacgcagtgctcagagaccacagtgcttctagaggcccacaacagtattagagcttcttttaaaatcagaaggaaggaaatgaacctctaagatcaaatagtacatttgcctttataccagtgcagctatacaatatgatttctaatatttgggaggagaagggacccataaggtaaagcaccttggcccatggaagtcaccctgtgacctgagctcagcccattggaggttgaggggctgaagcccactgcctctgctctccctgcctgaatctgccccttgctcccagggctctgatcctcctctacgttggcagtcctggttccttagcagttctgtctgtcacgggaggactccctgggctgggcatctgcaggggcagcctctacctctccctgtgggacttcactaacacagctggagtagatgctagggaggctcaggtcatgcactacttgctgtctttctctctctctctctctctctctctctgtgtctctctcattttctgtctctatctttctcttactcttttggccttttaagtcagaagaataggctactcttcacttacaagtttaaaaataagttgtctttgccctatttcattattgcagaagcaattcatgttcattgtagaattgtaggaacaagatcaagaggaaggatgtaggaagaatctctatggggaagagggtgactttgagatacaatctcttgccctgatctgagctttcagttacctaaggtacagtacagtaagatactgagagagagagagagactagttcatataacttttatagagtacgttgttacaattgttttacttcattattcattgttgttaatatcttactgtgtctaatttataaaataaactttatcatagttattcgcatataggaaaactatcatgtatgtaaggttcagtcgtatctctggtttcaggcatccgctgggggtcttggaaagcatcccccataggtaagggggaaccaccgattcatgggacagatagatgatcacccagtggcagctcgaagggagattagggcacagataaggctggaggacatcagtgtaaagaggccaccctgtgaggggcccagaagggagccctggagaccctctgggtgcattgatcacctcagatgggggcccaagggatgccgacgcagggcaaagcactacagcagactcggcacaggtgcctggggctgtgcacgccctggcaagcgcccactctgccctgctccgcacctagtgaggacgtgtaacacacacagtgcctcctttaatgctgaaggcatcacacagatgcagatattattaattccagtttaggaagacaaaaagtgaggctcaaagaggtgatttccccagtgcttccctgtgcatcactgacacgctctctcctggaagccaggtgtgtcttcctccagctctgggactctgcagcctgccctgctgggagggggctgcccatgaccccttgcccttctgctcagatcgttacagccctgaggtcgctctcctggcctctgaagaaaaggcctttctttgttccccccacacccggaaccacttgtgttccctctgccgtcctccgcaggcacccacctgtgtcccagcagctgcgaatgcagtgctcagagtggtacacaagggctgggttgtgacagtcctgccagcccaggccaacccactcttcccccggggaaggagtgggcagctgcctcccaaggtcactacaggggcactgggagagaataatgcccccaccaactcctggccaattcctggaatgcctccaccgtggaaccacccctgggctggcaactttattctgtgttaaagtacaacaagccagccggaggatcattgtcactgcatgactgcaatttctgttacactttgctaggcactttcaaatctgtttccactcttcattcgagacatactagtctccctcttttgcaggtaaataaagcagacctcaggaaagttcagtgacttggcagaatttacacaaccaggttgcaatagaggagccagactggaccagtcctcggtccctgtctcctttgtgagtgtactgttcaggccactgaaactcattcatcattcttaagtgggaggggctgaggctgaagagtcattgcaagtaagaaactgtgatgctggccttccattctcctgcccccctcccctccctccctacacacacacacacacacacacacacacacacacacacacacacacacatatgcacgcacacacacaagcacacacacatttcttcctacacaccatctccttgcgtttcttagcagcagacaggtatcagccccagacctgaggcagacacttggggatctggttcgggacagggcagacaggcatttggtgcatggatcctactgacctcccagagataactagaaacaaatgtaagaactgctgcctacaacatcttttggccttgggtgttaggtgccacatgcttttgaaactttttctactccactatttttaggactctgttcccacttctttgctcagtgtagagcatctgccatgtagaatatctcctcatagcctcttctgtctgcttgtcactcaaggtcattgtagccatcagaccccacctagcagacagaggatttagagacagaggatttagagatacgtggatttagagaattcagcaaggctgttttgcttatttttggtttgggttcagcactaagtctcccatacccttctgcaatgaatccctctggagtgtatcagtaaagaaaacagaaacaaccttccccaatcataccccagcagttaaatatttgggtcagtttccagacatgactcctacatgcattgcctatcacatgatctggatatcttttttttttcttttttttttttttggagatggagtctcgctcttgttgcacaggctggggtgcagtggcatgatatcggctcaccacaacctcttcctcccaggttcaagcaattctcctgccttagcctcccgagtagctgggattacaggcatgcaccaccacgcctggctaattttatatttttagtagagacggggtttctccatgttggtcaggctggtctcaaactcccgacctcaggtgatccgcccgccttggcctcccaaagtgctgggattacaggcatgagccaccacgcctggcctgtggagtccttttctaagttccaagtctgcagggacctcttgtgtagcaggtgacctgagccctgagccttgaacttttcatccacttatagtgaatacagtcaagagccccaccattcagatcatcccagtccaatctgatgcatttgattttaatccagggagtccctactgcatgcaaggtgctgcacaggagacataaagggacaaagaccatatcttcaaaggggcttcagcctagtaaggaaggggagatccaggagcatcagaaaacagaataagtcaaaaagctgattagagacacgtggcccagcagactgcttgctgcacctggctcagacacaggtaacagtgccaggctgctttgagattaaggccacatcttcctgaactttcaaaagaaggggttcttcacctgggatccccaccctaaaagtcacacacacacaaaagagcgtcacaactacaaatctctgttgcagtatttttgtttttgactttttttgcagcagtggcaattttataaaattaattcttagatgaagtctagaaatacataagagataaaagtccatctgacccatttgagtaaggaataaggcctggtggccacacccccagggccccttgtgatggctcactcccgagacaagtttgagatctcctgcctggtgccttccagagccagagcagttaactgatgctcggtcactgtttgctctcagggaggacactttgaggcctggatctcagatgatccctccatagcagacgtctctaccccatgcagttgtgaaatgctctcattgtggttaaatatttgcctacagccaactacaatgcacacacagctgtttatcactttaccaattagttccatgagaaaaatgctatcaaacttcagaaggtttacgctcaaactccaggaagaaatctgaaatgttaaaaaagagactggatacaaaattggattgcgagagcaattcatccgcaagcaattactaatcactttagacatccctggttccaccatcattggaaacacttggcgttatggtggttctcccctgccgtcagtcctcagaattgagaggggacaaaggtgtgagatgagatggctgccctcaaagccttgttgggcttcttgggacagcaaggttcacatcatgacaggaataaaaagcatccagtcttcctggtgagaaatttcttatcacacgaattcaggtttcggatcgaattgcctatgacttactgcgattagttgctgaactggctcaatagctatgtagctacttagagaataacttcaaggagtataattcccccaacgtaaatgggtgcttttctagctaataggaaattatagtaaattttgacctagttagacatagtcgcagcttgttgaattaaaatcctgtgcttgaagagacaggttgttggtgatcaatgctgactgctgaggatgctctaactctggagaatgaattggtaaagacaagttgcagggatacgaagcaggaagaacagtgctgatgtccagagctcactacgtgcgcagtgttgcctggcgacatttgtccctggtcatcatcctgtgctgcgagtggatgctccaggccatgccccctcctcagggtacaggacatgtctgtgagtgtcagggctgtgattcaagcccaggggttccaacccctagtctatctcttaatccctgcacggcaccacccctccctcatatgtgcggaaactggggagtttcaaggaagaacagagtatcctctcccaaaaggagggagagaaagttggttcaagcaggctgtcgagtacattgatttatatcaggccttggtaattcgccctgggtcatttcttatttcagaatcctggagcctctgaaaaacccttttgggacaggatatttttaaacaatttatttgagcgaaatgaagcttgtcactcactgagaaaactaacaatgctagaggaagtcaaaatgcctctttcaggacgtggcggtcacaggaggatgaaatccacggtgttccttcgaagttccgatgagctagtgtttcccgctcatgggcacttctgagccttattattattatttcctggaggcttttgtcctctgcctaactctcttcatggtcctaatctcttctgtttccagggtggtgcttttggtaaaagccttctctgaggttgcaacatcccagaggcacaattatctgagtttctggccacatctcgtcttcctcggcccagggctgtgggaacagaggctgaactgtctggaggatgaaaggatgaaaggctggcctctcactgccctgcctcctgccctgagagccccagtggttctcaaagacggttctcctttgaattccctgcgtgtgaggccctccccaaggaaaaacaagttctctctgctccagttcatgatgtctccttctgagaccgcagctcccactcagggaggcttgtgctgcagcacgccactgcccagagctgctctagcctcactggaccaagccttaagtttagccaggactcacttgctggggcccttctgggacaccccgattccaccctggggctcaggattgcctggagaagtctcactgtgcagcgcctctccaaccagtgcactcacagaggggcacaaagagcccagcaggccacccacctcacctccccattgctgtctcggccctgccatgagccagtgagggtggccttggggtactggtttcaccccctttggcctctgcttccccagcaatgcctgtgtcctcacaggcacttctgtaatccctagaagggactgaggcagcagggatgtgcctgcgctctgacaagaagcaggatatcgcatgggtcacaggcttcgagggggccaggctgggctacaggcacagctcagcctcttggtggcttagtccccacaggcaccttgcgtgagaggctgtggatgaagtcccaggcctagcacggggcacacactcagtaaatgttaaccagggagggaccagaaagactcagagacaggcagacttcaacaggagggctgcaaactgagacccactgccaaatccaactgccccctatctgcacacttgaagctttcttggggcccaacagcacctatcatttacggagtgtcatgtgctgcttccctgctacaatagcagcattgaatctttgccatagagaccggtggcccccaagcctaaactatttactgtccagccctttatagactcctgactttaaccaacaggagactctctgatggcacaacttctaggcctgggcccacctgaccccattgcacctcaaccccgtgagtggatgggaagccatggaagaaaaatccaccctgaggtcagggagcaggcagcagccagggaggcccactaacctgggcccacgagaagagcatcagttcccgttccctgaccttccactgcccaggctgctagcgggtaggaggggctcttgtagtcttcccctctctcctgccctcctcctacctcctctggaaatacaggcactcggggctttgcctctgccctgcagaaaatccccacctcactgggcaggtgccggagggagagccagagcaggtgcaagcatgcgaggcaggcttccctgagcccgacagccagggacaaccagctaacacccaagttcagaaaacagtgctttatcacaggcacgagcacaggggagcaacctctccacgcacggggccaggtgtcagctgtgcacttgcatgcttccttattggaacctctccctaccgggaggccatcattagatttggagatggagcctcgggggtcaatgtgtgtccgtattcttccagtcataacctggtagctccagagctcaaccgtggtctcctggagtccacacttctgctgactgccctagcacacacgtggcctgggagctcagattccacaaatggtcactgagcaccagctgtgtgtcaggcccaggccaaagccctgggaataagacagtgaacaaaccagcaggaatcccaagaggacctcacactttggcgaggtggacacatgggtaggatgcccagtacatcagatggcactaagggctgggtggccagtgaagccgggaagggagatggaaggtgaggagtgagggggtgccatcttatagggtggccatagaaggcttcactaagggtggcaatgtttgagaaagccctgaaaaaagtgagtgatccagacatggggccatctgagagaagcatgacaggcagagagcacagcaagtgcaagggtcctgaggcaggtgcaggcctggtctgaccaagacacatccagggccaggtggctgggggatgagggagggaaaaggtaactgagagatgcaggtggacaggtgaggtggtagagagatgaggggaccacctcccggcacctgttacagcatccagaattccaccatcccctctaagtcttggagccttcaaggcccctccagaaggctcatgactctgaggaggtgcccttctgcatctcaccttagccctaacaagagactgagaggaaggcccgggcaacctgtgacatgcggtgggagctgggaaggaggaagagaatagtgagccctcctgcagtccctgaaatggggggcttcacacagtgcccaatttgcacattcacctgcacacacacaaacacacacatacacgcatacacacacaaacacacagaggccagctttcagagcctgtctgaaattgtcagatgtatctttcgggtgcctggccctgcagggaatgagtgtgagtgtgggtcccctgtcccctcagcacctgcagtccacagagcacacaggacccttagggagcagggagaatgtgcatggacccctcaaccgcagctctgggtcagtgcgagccctggaggcatcagcctcagagagagcacagagcagcaaccttctcccctcagggtggaggggctggcccagcagtggacagagaacagaactgtgaaaggaggtggataagggaggtctcgacctgatgcttctaggtccaagctgccacctaacctgggggaggaaggccaggaaccacactcagccccacccacacttccctggcacaatgaaagcacagcccatatacatagcctccttctcctctctgaaatcagagaggcagagagaacagctcggcctcacacagctcaggctagaacccagtattccaccacctcagtcttatcctcacccatgtcagaggtacagactaatgtaactcacccagaaggcaagtcacactcgaggtcaggatcctaatacccagaagggtattgggagacccagaagggtattgggaggtacttttcatctgcttgatgtgatgaacggtccagggagggcaagtgagcgaagccctccaacccaagcacaagggctctttctgtgctctttctgtgtgcctcctgtcctaagtaatatgatgccaggacaagaatccagttgctccggaagagactgactcctgattcctgcgcttctcatcttcacctaacatcttggaagttggcccccgggcatctgtctgtacttggaatcgctcatgcacaccaaaacacattcacatttcttatccctctgtcctcaccacagcctgggacagtggcagggtgggggtggagaaggtgatcacgttcactgagccctccgtgtgccagtcgagctgccagtgtgctctcgggaggagagtgtcattatgcccttgtttaaaagacaaggtctggggtcctaacacaacttggtatcctgagtgttcctaaataaatgggattggaaaggtgtgaaataacaatcctaaagccacaccaatagcaaatggcggagccacgactagaattcaggtgttttccacaacctctgtcccccacagattcctgggcaggcagaccgtgccaactcctcttctcagttcaaccaggtgctttaggtaccataattttaagtggacaaatggtttcatgcttaaacactgccagatcctctccatgagatgcacatgtgtacacacatacatgcacacacactcacacacacacatgcacatgggcacaggcacactgttgggagacttaaatgacacctcttaaatccaggaggatcagcctcttggatttaagctcgagtctctgctgagcttggaccctatgcgacctgagggctcccaagtccttccagagcaggactgtggtgccttgtcctaagagaccctgtctctgaatagaaagtaagacacccgcctcctgtcagcaacatcaggacacaaagcccggactcacaggcaggctgtatgtggctgtgtctgagtgtgcctgggcattgtattataatatttcttccaagggccttctttccatcctcttattcaagcagatggaaatggctcctccacccaggcctgcctctgataagcctccgagcgggagaagcagaactgagcctcttatcagtcagctgcaggggtacctggtgggcctgtgctgggtggcctggtgttgataaaatgggcttgggccagccgctcaccagcttctccctcagacccatccccaggccccaacctcttagaaatgggagcagtgagacccagaaaacttccttactttctgagataccaaagcaaggcaggcttctgggggctatgggcaacaggaaggacctgatgggaaacaagtggggggggatacaggctcggcaaggccgcgggtggagaaaggggcactagagaggccctcgagccctgaatgtggtggtgggagctggtgcctcccacaggtgtgacaggattttgcgtgtgctgagaattccctgtgaggcagactctactgctcccatgtgacggcactgagcctcagagaagatggaagcctttttttaagtgttttgttcatttaaggtatgatgtggtgtggtcgggttggaagccagatctgctggtgccgaaagcccaagcaccttgctccttcctgggagctctggctggaggggttcacccctccgaatcccacccctgccacacacacacaccctgtttgagacagcacattttaccttcagaagttaacttttttcctcagcttctgttactgttaaccccccaacacatttggtgagttcaaacggaggctggcatgcaatatttgggacatacttgtattcaaacaattttcattttttatctgaaagtcagatttcactggcttcctgtattgtgtctggcagctgtggtagaaaaggacctgaacatgggtgtttctgaaagggtcccagatgattccaaggtgcagccatagctgagtgcccagggtgagtggctcctgctgagcacacccacctgctgcagccctaccaggccccgccacaaagcccagggtggacggacccttcgtcatcagaaacatcctccaaggggctttcccagattcccttcccatcctttgcatccatctcgtggattcctcccacaatgaacagaaatctattttgtatgtaaatgtagaatctgagacacatcttaatttttaatactttactgtaattgtggaagtgattcaataacggggcatgtggaaacatagaataataaataattattcataaccctcctacatctcccatcacactgatgttcccttcattcgcttctactcacactcctgcttaaaccccaaattctcagaccgccagcctctcctgcagctcctacctcatacccagacccttgtctctgtccatcatccactcctgtgagcctctcattgtgtcatcctgattctttctcagtagcttcaaagtgctattctaaacaatgggctctcctttccatccctaccctgcttcaaaactctagagaatccccttctctatgacctcttcacctgtcgtggctgttcgtcactacccgagaaaacgcagacttcttagtctgatcttcaggatccttcattgccctttcctcacccaagcaggtgagtaataaaatttattagtgatattcaccgtagtagtgatggtggaagaagtaataagacaaggaaaagaaaaagagaaaaataagctaatgatatgtactgggtttagccatttatattctttcattttttcccacctaaaaccacagagtttatacttcccaaaacaactcagaagtagttatgttaaatgtgtaaagaaaaattaatgcatttgtttcattatgaaaccatctatacttgaaaatgatacaattatttgaaatctgtacaacctggcttcttccagctgtgctgtgagccctccacacaacctggcttctctaggagcctctaatcctgattgaagaaacagatccacccctgtaactgcctcatgtctttttgggtaactgctttcactctgttacttggtttgcttaagcaaaggtttcttgcctttatcaaggaaattagcacaccagtctgacagaagagtagattgtgtttgtgcttacccttcttctcctaaaattaagtgttagctttcaaacttgcttttgaagtgctaagaaccctgatgataaatgatgaacaaagcctcctgtttacattagaagcatcaaaacagcaggactgggccaattcacccattcctgttgatcattagacattaactggttgtccaacttcaaccacatcaactacaaaatcctgaagtgaaacaaagtctaagttagttgacttttctttgattagtctctagtgcatttatcactttctatgaaagaagcatctaatttagatggcagttgatttgtgtcatgggatttcttctgacaggaggcagagttatgtatgtgtttatggcttctttgcctttaaaagattaatgttgggcaaatataaatcacaagacctggatagggggctgggaagatggagcaggagcttgccagggtgatggattgagacgtattttagaggattttcattgctagaaaaacactgggaagttgtggcagaggggtggtggggcagggacagtgaagagagatggctttttctccctaagcacagagaaaggacaggatgggcacttgagccagggcaggtggctttctggctctgtttcagaagcaaaatgaaattgaattggtaacttcctgaagcttctttcctgccctgatacccagaagacaggattggaggacaaaggagggttcacagcacagctggaagtgctcaaggtacccagctgctccaggagataaagtactccctgcctgccccagtcacaggaactggcccctgaagccaggctgccacaccctatcttcccatagaccaagtctaggcttctgtcccctgaggctgtgtgtgtgtgtcagtgtgtgtgcatgtttgtgtgtgcacctgtctgtgcatatgtggaaaagtgcgagaggaatgtgcatgagagtgtgtgtgtgcatgtgtgcctgtgtgtgcatatgtgggagagtgtgtgtaagagtatatgtgtataagtgtgtgagtgcatgtgagagtgtgtgagtgtgttagagtgtgtgagtgtgtgtgagaatgtgtgtgatagtgtgtaagaaagaatgtgtgtgtgattgtgagagaatgagtaggagtgtgagtgtgtttattagtgtgttagagtgtgtaagtgtgtgagagaatgtgagagagtaggagtgtgtgtgtataagagtgtgacagtgtgtgtgtgagcacgtgtgagtctgagtgtgtgtgtgtatgagagtgtgtgtgagtctgtgtgtgtgtgagtctgtgtgtgtgtgagtgtgtgtatgtgagtgtatgtgtgtgagtgtgtgagtgtgtatgttcatccttaaatatatgaggacaataagaatagctcccatgtgccgggcaacaccccgagagccacactcagtgctgctttgtatgtgttgcctgccgtaatccttcgctagggacgagcacacgagggtccgggaggggtgcttggagttgggacccagagcaccaggacttactgtcaaatctctctggcaccaaaacgcatgctccctatgccacctatcaggatgcacccttaaagcacttttaagatgctttttggaaagagccatttgttggtgtgcatttgtcttcaccactgccccaaacatagctgtccaatattcaggtgaaaatgtcccccatcggccgggtgcagcggctcacgcctgtaatcccagcactttgggaggccaaggtgggcggatcacgaggtcaggagatcaagaccatcctggctaacacggtgaaaccccttctctactaaaaatacaagaaaattagccggccctggtggcacgcacctgtaatcccagctactcaggaggctgaggcaggagaatcacttgaacccaggaggcggagcttgcagtgagccgagatggcaccactgcactccagcctgggccacagaccaagactccatctcaaaaaaggaaaggaaaggaaagaggaaagaaagaaaagaaaagaaagaaaaaaataaatgccccccttctttccaacaggctttcaaatgcgagtctgacataaaagacagatcacagcatcaccaacagcaatggctaagatgtacagtgtatacactacccacgaccttcacaggcatcctttcctgcgagcctggtcaccaccctctgctgcaggctccctccccatcccactgagcctgtgtgcctctggctcatacagagccagtgtgcctctggccggcctgagtagggagaatgcagtggcctttcctgaacccttgagttctcacggagccctctctggctagggaggaggagaagccttctagggaatgaggagaagcggccccctgcatcctgctcctgcacttttccttccttccagcatccttcaccactgcatctccaccctttgtgcccataaactgtgggtcctgttgtctctgggccactttggcctccccttcctcagcacatctcctggggaagcacggctatctgccttgggatgtagccacgaacctcctccttggagccaatcctcctgaatgtttgaactgagtttccaggcagcagaatgttccctcctgcctcctgccgcccctgcggtcctgcccactccccacactggctctgctgctcctgcctgtcaaacccggtggaggaaggagaaaaacactttccacatcctgttaaccaactgatgagccttctggaaacccaataacaaagcgtacctaactaaatcatcattatttacacatgcagcccaatcgaggacatttagtcatgtaattaagtacctaattatgctgaaaatgcaattatatgattttttaaatgaattaagtcctccagagaagtggtaaagattagcacgcagcatctgtctggggagcaggtacctcgaagggcacccaaatgtgacaccaagctgcacaggggccaaatggtctgaacccagatcacatgtgtgagcacacacgggcccacacaggctcacatgcagaggatgccagcttcacctctgtgtctccaggactctacaaaggtctggtgcacaccaggaacttgataaatgacagtcattaatgtcattggaagcatagtatacatctatggagtgactattgagcgacttagagaatcttaggaaggttatttatccagcatctgagaggcaggtgtgtagagaaagaaaaaaaaattgagagaaggatcagccaggatatgtcagaggatattttaagcaacatcactcattcattcagatgctaaagcaaaaaaacacagtcagtgtcttctaggagctcaaaaattagtgcagagttggctgggcctggtggctgacacctgtaatacaagcgctttgggaggccgaggcgggtggatcacctgaggtcgggtgtttgagaccagcctgaccaacaaggagaaaccccgtctctaaaaacacaaaatttgccaggtgtggtggtgcatacctgtaatctcaactactccggaggctgaggcaggagaatcgcttcaatccaggaggcggaggttgcagtgagccgagatcgtgccactgccctccagcctgggcaacaagagtgaaaaatccatctaaaaaaaaattaattcagagacagaaaaagcatcttaatggtgatatgaacaggttgttcagcaaactacaacttgtgggccaaatgcaacctgtggcctgtttttgtacagtcaggtaagctaacaatgatttttacctctttacggtgtttcctcacttccatcccatgcaactcaggttccgaggccatagtattaatcactcactgtacatgcacaactccagtggggggtccagagtgatcattgcatccaggagccaaatctcatatttctttataaatattgaaacaaaactgtggagccaaattgttaatgaaagaaagattcattatatcttggaaaaggaagccaatgatgtgaataaggatgaagaggttgaagatggtcacaggaattgtcagaggaggagatggagaaagatgaggccaagaggggaaactgagtctacacacttcagtgtagggtttccctccatgagcccaaaatccaagggacaacccggagcctcccctcaaataatcctggcagcggactctcaatgagcataggaagtgagaggaacctttccagtgtctctaggaaaccgttcacactggagacccctgagaggacagctgagtaacacaccaataacaaactcagggagctcgagaagcaaagtctgtggccagcggccctgtgattccaaatgcccagcctctgacctgctccctgagaggtcagaacttcccttcatttccacctgcagaagcaagggactgggggtgaaccatggactgaagccacagcgcacatttctcagtgtgcaattgcagcccagggaaagggtgaaaggagcagtggtcactgaatgtactgtctcttttccacaacatgcatgtctttcttgaaaatgaaaatgactacttggagcatctcctaaccaggttaggcaaaggatgtgtggacacgagactcagagggccattcagagagggtggtcatggtcctactatccaacaacagcctgacgcctgctcacgggagacaccgccaagcaggtgcaggcatccagtgggaacctggagcaaggcgggcaggtcagggcggcgggaagggaccttaacagaccttctagtcggcgactttgaagattcttcaagacaatagccagttctgaagattcatccccgtttcttcactgtaaaagtaacacgttttttgtagatgacttggaaaatacagacagccatatgttagaagtaaacaaaaccactcctaacccgtctacttcttaaaagccggtacttaacatttgaagcgtatttcttttcatcgctttgttttaaggtttttgtggaatatttttcatcatttctatttagagggtcccgttttcttcacttaacatcaataccctaagcatttcttcctgttgctaagttcacgtgcaccccttccctaactgcataatactgggtcatatgggggtatcataattgacataaccaatgcccaaatatggaacatttagattgctctctctcttcaatttttcattttagactgcattaccatctactttcccgagcacggacttttgttcctgttccagattgtttctctaggatcaattcctagaagtggattgcttgattctcagggtgatacatatgccaaatagtataccagagtattgaaggtacttgtttctaggaatcccactttgacatatcgacgatgagaataattaatattcaaatagcctgacctatgtcaggcactgtgtaccacaaactagcttacaatggggctacactgttgtgccaccgggttttacatgtgaagaaaccatggtttgcagtgagccaagattgcgccattgcactccagcctgggcaacagagcaaaaacttcatccaaaaaaaaaaaaaaaagaaagaaagaaaagaaaagaaagaaaagctacatagcattcctcaaaatggtctggccatgagtatcgtcactgaggggccactccctcacctgtctgcgccatgcctggcaagtgtgctgacttcacagcagggcggccagatgcctggccctgagcctggcagatgggtgaccccaggagcatggtgcgcaggattgcacaccctcaccctcctcagggaggtgtctgggtggagctgggactggaaataggtgtgtccagggtgttctgcgctccagccacctccggtggagcttggagctggcaagtcaagcagatgctgattgggatacacgggccttcctggctcctcagaacacctgcacacagccattttctttgccattttggtaccccaaacacctatttttggagaagcatttccctgctgcctcactggagctcagctatccttaaatcaatcagcagtggtctggtaggtggatcagctgggaacacatgcttaatttcccaacaacaaggccaaggagactgcagtctcaggagctatggagcagaagggtgtgtgcatggaccagaccccggcacaagggccccaaatccctgaacccagcaccaggcatgggggtagacaggggacacgcagaaggaatagattctccgagtcctccactgtgcccggtcctcatctctgtcagggtggggttcttgagagcctggttgccgctcactctcagatggtatctcccgcttctcccctcagcttcagttccctcttaaggactctgttctccttccacttccgctgtgaagatccctcagcgtgatgaagatgcaggggcaagtcagaggttacacagtgggggctgccctgctagtgtgctgaagccacgccaactgttcagggcagctttctgcttccaggaagaacacattgacctggctcctttcaacagtctgggcgttgtcttaagcctgagcttcttcagttgcctgctgaccccagacaccccctccagtccctacccatctccagcagccagatgctgaccaagccccaggagcttcccagacgtaagagccactagaatcgcctcctccccactcttcctgcctctttcaaatttgatttccctagaaatcttccggcagggtgtgtctgctgggggtcaggctgggggaattgtggttctgctttccttcagtctatgccatgagtaaagaaggatatttgtgaacaggtgagatggctcatgcctgtaatcccaacactttgggaggccaaggcgggcggatcatgtgaagtcaggagttcgagaccagcctgggcaacatggcgaaaaacccatctctactgaaaatacaaaaattagccagacatggtggcaagtgcctgtaatcccagctactcgggaggctgaggcagggagaatcacttgaacctggggggcagaggttgcagtgagtctaggtcacgccattgcactccagcctgggcaacagagcgagactctgtctcaaaaaaaaaaggatatttgctgctttcctgataaactacaaatgctgcaccatccacagctgacaaagtcctctccccagtggtggacaagggcaactccaccttgctcagccagcttttatccccagattcttcctccttcagagtgccttgctgatttctgctgttgtcaggatcctggactttggagacgatggttccactttttcatactctcgcctcacaagggagaaaaagcactctttccttttacttagatgtcatagctcaactgaggcagattggttatggtgttgaagtaaggttctgtttaaattttttttctaaggctcagggcgagtaacagggaaatctatacagaggaaaccctggaaccagacatttcaagttctaagtcacggcagcctcactttctttccagttcccctcctgggagtacatcccaaaagcaagtgactaggtatgaaaagttatccagcaagactccaagatgtacataaggaagagatgtcctttcctgactctgccttctgagtgttgagcctctgcttcatcccaatttactgacataggaatgactgtcttctccagggcagagaggccacatctcctcccccctcacctttgcaggcctctacacttccatccagatggtgcagtgcagcctgcgtgggtccaattctgtcatcgatgtggtgttttgataccgcagcagcagataagaccggataagggttaggaggaggaaagcactgctgatcatcttatagagtgtcaaagcagtacagctaaattgcacagcaccttggcagccttggggattgttgggggactgttgtaaggtcacccatacagaccttcagggcaatcattttgaccttgagactttcagacacgttctgaacaggctggtcaagttcacatcaacctcacctgtgtattccatctgcaagaccagacgaatgcacatgtgctttatgcacagataggaagagtggccatgcctgagagtgacggcagattgaagccctcatagcatacatccagcaggtccctggagcccatggtgatcaggcatccagggaagctctccacccaacccagaggcttactgaccactctatcatcatggccttcccttcatgtatccctcccaccaccatgcccactaccacactggcattgcccacccactatctcagaaggacagacttggggccacctcttcaggaagcctttcctgaggatactggagatctatgggttccaacagagagcaaccttttcccaacttacccacatgcatttgtccttgtcggttacacagcgtgctcctgatggcagggacttggccttaacggtggagcatatggctggagcgtagaaggtgctacaaaaggtttgctgaaggaaagaatgaaccggcacaattatgagcatccccattgccatagaatcctagagtcctggggctcagtctcacagttgtgtctccacaagtctccctagcacctcgtcaatgctcattttgacgcttcatcacatagagactgtgggcagtctgacttttgcacctccccagccaagtcatatgcttcagggggacgcgcaccatattctcctctcccctgtaactctgtggctgaataaatgctaactgcttagccaacactggctggcttctaggagaaatggatgcgtgggtaataagctattcatttatttcttgggggcactttattctgagaccctacagcctgtacactgcgtcttttccggaagcaatgatagccagccatcaagggcaagtaaacgcatttgacctttcctaccaaaaagaaaagttagttaatgtacttcaactctcatctgatttctgcttcacttgtgcaaggatgctcaggaatctagagtaggaagaaaaaccacagtgctagctgagaagcacttaccatgtccccaaaggttactgttccttcccccattgctgtctggctcttgaaccccaaatcagacttgcacaaagcctttctgcttcagagtgcttgttaaattgacttttctttctttcttttttttttttgagagggattctcactctgtcgcccaggttggagtgcaatgatgcaatctcagctcactacaacctccacctcccaggttcaagtgattctcctgccttagcctcctgagtagctgggattacaggcacccgccagcatgcccaactaatttttgtatttttagtagagatggaatttcaccatgttggtcaggctggtcttgaactcctgacctcaggtgttccacccacctcagcctcccaaagttgggattacaggcatgagccactgcacccggcctggtaaattgacttttctaaccaggcttgtaggttcctcgcaattgaacactccaggtaactgccacagcacctggccaactgtcaagcagtcaacgttgctgttgctgctgcatcactgtcatcaacaaggtttgtcattgcaggaagtctccaaggacccccatgaaacacctgcatttcctgtcatgattttgaggctgaaatcatcttcctcctcccagaacacctaggtgttctagtctgaagccatcctcactctcaactcccctccttcgagccctcaccctgtgcctgaattcttccttctttgctgggacagatggacaggaggaagacaggaagtggggaaccccttcaacaactcctatggcagaggggagccataggagatgggccgggaaatgtaaagaccagcccacgcaggaaaaaaagagaactttttagcacagtgtcatctgaaaatgcaagagaagagaggctcttggtggcaacagaggagtgtgacttccagcctcagggctagcacctgacccctgctctccgtccacatctgaaaaataccactggccctgagaatccattgcaactgaggttctgcaccccaacagctgcactcaagctgccaactgaagcagagagcactgcccgcactgcagggttgtgcctgtgtgccccgctgcctccaggggtggctgccttctgccagagaatggacagctgacatcctgaggacatagagagttagtaggaatgactgtagccaatggcaaatcccatggatgaaaagccactcccaactccacaaagatgagcatagtgaaggctgcagtttagttggttcgtggttccccagaaggctttcaaacattcagcagttgtcattcagtgccaggcacccagtctaatgctgagtatagagttgtgagcaagacaagcctgaacgtgtggagcttcctgtctggtagggtgttgcagggggccggggggaccttgcaacctggaggagggctgggaagaaaaaaagtaggatgcttgggtctttccaaaaaataggtcctctcatgtctgtccaatcgttgtgctgggtaattgtctatttctgataccagacccaagcttggccgtaatcaacaccttattctgccatgaacccacccccaaggctgcccgcagatcacccccatcctagttgctgagctcagcatgatcctaatctcaacctcagaagtatccctcagctccagcaaggggcaggctttcattccaggccccttaagctggatgcagaccaaccacctactttctgggctggatctgagctcactcagccagtcttctccaaagacctgatatcactgctgctagctgaatgggtacagtgtaagggagtgcgccaaggggggctctcacccctccatctccagaggcttccggagccttggagccgtggatggcaagcagacactggggagaaagctgagaagtggggagagctgccttagatgctgagctctctgcctggaatgcttataggctttgtgcagcaaactcctatttgcccttaaaggactaatcctgatgtcaccgcttctggaagccctctttacaccagcacttcccagcctacagcatgaatcagaatctactatagtaattactgggtcccagtcctagtgtttttcttcagtaggtctgggctggggcctgagaatttctatttctaacaggctcccagaggatgctgtgtatccagagactatgctttgagaattgctgtctcacagcatccgcaccttcccagacagccttgagcttcctctctatgctgattctgatctattaatatagggcagctctggttgggctgaaatgtcactcccctggagtctgtcacattgtgaaacatgtgtaaattcagctccacacacttggtggggtggggggcatggagagagtagttccagctgagggaactttcctgcccaccacgctcctcagagggcatgagcttggagggagcccacattgggaggcccagctggcaatcccaatggtctcccaatgaggccccgaagctctcaggtcctacctcccctcccagcctggctgccctgctggaagtgtgtgtagtctcccagtatacagatttgagtacaaggtccctaaccagaagccaagaaatgcaccccaagttgttcaagccaaatatctcacctggaaaccagcttaccaaggctctacactttgcagtgccctgtaaggctaaacacactgactcaaggctgccagggcttcaaatgattgacttctgactctcaaggtacaagccggggaaaataacacttttctgggacgcagctgccaaatctggaaaatggggctaataataactcctatcgaatggaaatgttgcaaggtctgagttaaaatacattaaatgttgagagcagcacctggcatttagtatgaaattattaactgttttaaaggaagggaaaataacagtcccttctaaccctgattgtgttggacaaactgtcataagaaatgctggtctttacctggaaaatttctaagggcagttctgggtatttgagcttctataaccatccatgcctacttaagcaagatgttattctttctttccgaactttgaggtgcatagtggttagaaaagtctagaactccaccactaaatccattcatttatacatgcatgcatttactcatgcattcagtgaatatttattgagtacctactatgagctagatactaaattggaggctgcacttgttcactgtaataaagtctagcacccacttgaacttgctatggctcctgcttcaggtcttgctactgagaagcactgtgaatgctggatcctctaccctgcctggttcctggttcccaaggtgctgactccagacccagagttcactgggtctcttggcggcctcagtgccttgtattatcttcttccccacctccaagctccttggtggccccagacaccactagcttggcccacctgcttcctgctgtggacccctagctgggagtctgttttcccctcacccactatgactcctgactccagcaggcagttacttataagaaagaggcatctggcagctgcactggggagaatgacctcatagcactataattaaagtgatcatctgagtggaaatgactattatgaagcatccttctctgttttattatgtagagccattgtaatgggaatacgggatttcctatgttaatgctgatatttctgtgatccaataaatccttcttcacaatcatctcccagaggaaagaaggcattctgtgcagcagctctaggaaacatcaggtccccaatgtcctagacatcctaccctctttggccaggccattaagctgtgaaaaaacacactcagtaacttggataatgtcatagagtggtccttcccacagcagagtcaatgtaaagacctatgggagggcttcaggaatgactcctcagacaggagccctgggaagggcttctgcaagagagaaagtgcactccagaggcaagagcactggccaagtcctgacctgatatcggatgagctgtgtgatcatgggcacatcacgtctctgagccttggtgttcttcctgtgagatgggccaataacaccaggcacctcataggatggatgtgaagactgcatgatagagtagatagaaggcagttaaagcaacacctggtgctatggtttggatgtggtttgaccctgcaaaagctcatgttgaaattggttcccaaggtggcagtgatgggaggtgggacctagtgggggatagttgagtcacaggggcagatccctcatgcatacattaatacccccttgagggagggagggagttctagctgtcgtgagactggattagtcactggagagcaggttgttataaaagcaaattcagctttctaaactctcttgctttctatatcaccttgtggtctctttgcgaatgtcagatccccttctgctttttgccatgagtgggagcagtatgaggccctcaccagatgcagctgcccaatttggacttcccagccactagaactgtgagccaaacaaacctctcttctttacaaattacccaagtattcagctatagcaactcaaattggactgagacacctggtgtgagcatcagacactccacaaacattctttcttaaacacaacaagagtccctgccttcatacacagcacagatatctgttgagcatctaccacatgcaggcaccactctcagtggaggcatactgcagagaacttaaatgggcctggagtgacctggtggttcaggttcaaacagttccatcccagtcagtgaccaagcagaacctggttcctggtctgtgcacccctgctaggagtcggtgggtgcaccacactgtctctgtccacttgaacccattctcagagctgctcacacctgagcaaaggatgcagcttgggccaaggtgctgctaggcatggagagtcttcctctctgacctcagattcttgtcctctgttcacagagcctgatccggggatggcctctgcctccaccacaatgcatactaccaccattgcaggtgagttctcatcacagagcctcaccataatggaaactgccgtgacttcagatgagctctcatcacagagccctttaagcagccagggttgggggacttggtgaaaacatccaggggagaactgacctaaggacttggacaggggtggctgtggccattttttctctccctcagaggtggttttgaatgtggaatggaggagtctacccctgggtaaataaatatacataggtatgtcatatgtatctgtatttatatttattggcctttctcagggctgttgactcacaggaactcaggagctggagaggcagcagttttggtgagggaggttgagggtggaggtgagatgagggtagactgaccaggctacttagacttctccaccgtctccctcatcccacattattttcttccctgggtccatgacccccaaccctccatcctcaaggaaacttgagcctgcctttgccttgctttgaaccctgagcaacgggctccccatgggtcatggctgtgactgcaaattgtgtttgaagaacaaccaagtttgggaggtgctgtgtgctctgcgaccttctttgagatccacacttctcagcagcttattaataactcaggaaacatcgagaaggtgaggagagagaaaaagcagcagaagcaagcaatcaaagacacctgttggactctgtgtaacctggcattctccaactcattgcaccactgagcttttattcttcctaggtgatattattaacattatgcagatacaagtgttcccctgaaggcagtaggaagtttaggaaattgttctataaaggtgggacttgggagcagtttcagactttccatattcttcagcagtccctccccaaggcctccaaataaacctgcattctaagaaaagacagaggcttgctctgcagcttcaaagtaaatgcccaaactcaaaacacccccaccccatgagactgctgccccctcactctcaaggtcctgagtgatctgacccctcctgagcagccttacactgtacttccccacccctctggagtcccagcagaagtgaggggtgactgcccctcgcacagccaacaccttggcattctctgcgttaccctctcccacttcagtcctttgtgtggccaagtcctgctcctcctgcagactcaccccagtcctcaatcgccaggagggaatgggagcagggtaggctgaggagcagtcatcgggccattgaaaaacacaaaccacacaacctgccccaagcacagttaatagcctcatttttccccctgtatagtgtacatacagcaaccagctctgccctgttttctgggacttccctggttttagaatgaataatctccaagcagtgttcttgcaactgttgcaaggaccatgttaaattgctttaaatgttgagacctgcacctggcacctagtaagcgattgttagttgttttaaaggaagaggaaataacagtctcttctaacgctgattgtgttggacaaactgtcctaataaatgctgtcttcacctggaaaatttctgagggcagttctgggtatttgagcttctataaccatccatgcctacttaagcaaggtgttattctttctttctgaactttgaggtgcttgttgattggaaaagtctagaaccccaccactaaatccattcatttatatatgcatgcatttactcatgcattcagtgaatatttattgagtacctactatgtgctagatactaaactggaggctgcacttgttcactctatataataaagtctagcacccacttgaacttgctacggcccttgcttcaggtcttgctactgagaaacaccgtgaatgctggatcctataccctgcctggttcctggctcccgagacccagatcctgagccagtgttcactgggtccctgggctgcctcagtgccttgtattatcttcttccccacctccaagctccttggtggccccagacacccctagcttggcccatctgtgtcctgctgtggacccctagctgggagtctgttttcccctcacccattatgactcctgactccagcaggcagttacttataagaaagaggcatctggcagctgcactggggagaatgacctcatagcactataattaaagtgattatctgagtggaaatgactattatgaagcatccttctctgttttattatgtagagccattgtaatgggaacatgggatttcctatgttaacactgatatttctgtgatccaataaatccttcttcacaatcatctcccagaggaaagaaggcattctgtgcagcagctctaggaaacatcaggtccccaatgtcctagacatcctaccctctttggccaggccattaagctgtgaaaaaacacactcagtaacttggataatgtcatagagtggtccttcccacagcagagtcaatgtaaagacctatgggagggcttcaggaatgactcctcagacaggagccctgggaagggcttctccaagagagaaagtgcactccagaggcaagagcactggccaagtcctgacctgatatcggatgagctgtgtgatcatgggcacatcacgtctctgagccttggtgttcttcctgtgagatgggccaataacaccaggcacctcataggatggatgtgaagactgcatgatagagtagatagaaggcagttaaagcaacacctggtgctatggtttggatgtggtttgaccctgcaaaagctcatgttgaaatctgattcccaaggtggcagtgatgggaggtgggacctagtgggagatatttgagtcacaggggcagatccctcatgcatacattaatacccccttgagggagggagggagttctagctgtcgtgagactggattagtcactggagagcaggttgttataaaagcaaattcagctttctaaactctcttgctttctatatcaccttgtggtctctttgcgaatgtcagatccccttctgctttttgccatgagtgggagtagtatgaggccctcaccagatgcagctgcccaatttggacttcccagccactagaactgtgagccaaataaacctctcttctttataaattacccaagtattcagctatagcaacacaaaatggactgagacacctggtgtgagcatcagacactccacaaacattctttcttaaacacaacaagagtccctgccttcatacacagcacagatatctgttgagcatctaccacgtgcagcaccactctcagtgcaggcattaggcagataactcaaatgggcctggagtgacctggtggttcaggttcaaacagttccatcccagtcagtgaccaagcagaacctggttcctggtctgtgcatccctgctaggagcagtgggtgcgccgcactgctcctttccacttggacccattctcagagctgctcacacctgagcaaaggatgcagcttgggccaaggtgctgctaggcatggagaatcttcctctctgacctcagattcttgtcctctgttcacagagcctgatccagggatgtctggatggccggatggcagaatggagacctccacccccaccataatggacattgtcgtcattgcaggtgagctctcatcacagagcccttcaagcagccagggtggggggccttggtgaaaacatccaggggagaactgacctaaggacttgggcagtggtggctgtggccattttttctctccctcagaggtggttttgaatgtggaatggaggagtctagccctgggtaaatatatatatacatgcatacatcgtacgtatctatgtatgtatttattggcctttctcagggcttttgactcacaggaactcaggagctggagaggcagcagttttggtgaaggaggttgagggtggaggtgagatgagggtagactgaccaggctacttagacttctccaccatctccctcatcccacattattttctgccctgggtccatgaccctcaaccctccatcctcaaggaaacttgatcctgcctttgccttgctttgaaccctgggcaaggggctccccatgggtcatggctgtgactgcaaactgtgtttgaagaacaaccaagtttgggaggtgctgtgtgctctgcgaccttctttgagatccacacttctcagcagcttattaataactcaggaaacatctacaatttgaaaagaaagaaaaagcagcagaagcaagcaatcaaagacacctgttggactctgtgtaacctggcattctccaactcattgcaccactgagcttttattcttcctaggtgatattattaacattatgcagatacaagtgttcccctgaaggcagtaggaagtttaggaaattgttctataaaggtgggacttgggagcagtttcagactttccatattcttcagcagtccctccccaaggcctccaaataaacctgcattctaagaaaagacaggcttgctctgcagcttcaaagtaaatgcccaaactcaaaacacccccaccccatgagactgctgccccctcactttcaaggtcctgagtgatctgacccctcctgagcagcttcacactgtacttccccacccctctggagtcccagcagaagtgaggggtgaccgcccctcgcacagccaccaccttggcatcctctgcattaccctctcccacttcagtcctttgtgtggccaagtcctgctcctccagcagattcgccccgtcctcagtccccaggagggaatgggagcagggtagggtgaggagcagccatcaggccattgaaaaacacaaaccacacaaccttccccaagcacagttaatagcctcatcttttttccccctgtatagtgtacatagagcaaccagctctgccctgttttctgggactttcctggttttagaacggaaaatctccaaacaaggttcagtcctggggtatgattctaacgtgtctgcagagtgcttagagtggttagtagcagaactgtgaggaagaaaaagaaaagggagggaaggaaggagaggagggaagaggaaaggagaatcattttaggaaggcacaggttacagtgccaccacacaacaggttggtgaagcatggggaaggaatgaactggcctgtttggtgttggtacagttgtctccagtgtacacggttcaacttatgagttcttgagtttggaatggcgtgaatgcaaaagcattcagtagaaacggtactttgaattttgaactttgaccatttcccaggctggcaatatatagtatgatacactatattataaaatagtctctgggtcagatgattttgcatgactttaggttaatgttaagtgttctgagcctgcttaaggtaggctaggccaagcttcgatgctcagtaggtttggagtattaaatgcatttttcatttacagtatttttaacttattatgggcttacaggaacctggctcccatcataaatcaaggagcatctcttttggttgtggcattgtatctgtcctcacacaacccctgtgggtcttgaccaccatcccaggccccagagcccctgcctcagactgacccttgcacctcttcccacctgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggcgaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcattccgagtccaacagtattactgtagttatctggggaaagataaacgccacccagggcttgcttttcacctgtgcaatattatattctctgacggggccaggacagttcatttctggctcttgtgggggccagttcccagagagcacagccagtacaggcggctcccaagcctgccaagggaggaaggacaagtgaccagctttcctttccctacaggggcaccagctgcaggaaacaaaaggaagggtgaaatgtccctctagaaatagccgttcccagtggccagggcactagctgaagtgttgattttccaaggtgcagtattagaacaaatggacctgatccaaaaatatgagtgagtcttgtccttccaatcacagtgaccgtggcacccaggggtggaagcagaggctgcagagctccgctcgatggctttgggtcccagctcccctttcctggtcccaggaccttgaacaacttgtttgacccctctggcccccgtgttctcctccctcacgtacaaatgatgctgataatgacacctctgttgtgcctgactcccagcgttgagggtcaagtgctcagacctccctgtcttccagtgtcagcaactgtgtgcagcggtaaacaaacattcttcattgcactacttctgcacacttcctgaggagtagctgtcactcaaaatcacagagtaacaggaagagaagatgaactggttaaccatccccttccaggcgagtttttccaagattcccaacagctcagctgtcactccaaggaccagcagctatgaggttaaagactgcacgccaggtgctggggtcacctaggtactccctggggctcaggattcttgaggctgcaccatctccacttgggagttggcagaaaggtcccaaagatctccctgggaggattacggggaatgtgagctcagtggggggtccacctgtcagaggagctggcaatcctggggccgtggtgggggagatgagctgggagctcacagaagcagtgatggcagaagcctggtccaaaagtgagaccttttcctggtgacccgagctcgcaggccttcatctatgaaataaagggcttggctgtatctgcatggcccacactgatcttcagaacaccagtgtggcaaaaatggcgataaataggcccaatgaatatgcacaagtcagtttagaaaatgatgtatcatgtaaagtgaaagcagtgcaggctcctcagcgtcttcactggcccagtgtggatgctgacactggtgggaggggagctgtgcacatagcctttcccaagcatgttgaaccagagaccccatttgctcacacgatacctgctaggaactcgtggaccaagtggtcctcggagcacattttggaaacactcaggtaaatggtttctaacatcccctcctgtggcaatgccatttcaggtttttgagcacccacatcttccaggtttgggagcacagatcactgtccagtgagcacagaggaggcaccagaacctacacatagacactcattggggtgaaaaggctccagaagaggatgagcccagggctctcgaggcctcctagagagcaggtgcctatgtgggggaaggatgatggtaactcattcctttctccctcattgggcccaggggctgtctatactaagcttgactccctggccactcacctccccttcctcacctccctttatcctcactcttttgcctgcctagtgtcctggaaaacaattgaaacacagtctgctcccagtctactgggtccccagacccagccagaatcaggctcagcagcagtagtgatgacatggaagctgcagagctggtttgtcccaggtggcctagctcagatgccacgaggagggaactgttgcaggctaactgcagaggccagatggccacaccagagagcagggcaacttaaagagataatgcacacacacacacagagtgcacactggtggacacttgtggg

SEQ ID NO: 12044 - DNA, 5591 bp, Human
aaaggtaacagggtaacaaggaggtaaggccctaggctgccatcctgaccttgaggaatggggaacctagtcctacatcagatccaaggggaacttgaaagcattaaatagatccacattcctaaagcataggtattagctgaggttctcttcacctctggtccctccaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcaggtgaggatgggaatcgagtttatacctccgtgtctccctttctgcgtgattcttactccagtccatttctccttgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttattgtttatgtaggtatatttcctatatgggcatttttgggtagattgggaggggtggtgggggtacttcctccaacaggatgcctatctctctgccccatcagaccccgtctaacaagaagtgaacagaactgagaccaaacagaacatattgaataaatatttaaatcctgatactagaggtggcatggagggccacaaaattgaagttatcctgtttcctggcatgggaacaaactttcaaagagtcaccgggtgcagtggctcatgcctgtaatcccagcactttaggaggctgaggcaggaggattgcctgagcccaggaattcaagacagcctgggcaacaaaacgagactccgtctctacaaaaataaaataattagccaagtgtggtggagcacttgtagtaccagctacgagggaggtttagcagggaggattccttgaacccaggagttcgaggctgcagtgagctgagatcacactactgcactccagcctgggtgacagagccagtgacacccggtctattaaaaaaagaaagaaagaaaaaaaagaaaacttttaaggggtctaatttcttcacttttccattctccctttgtcaggtaggagaagggagtagggagtgactggacctggaaaggagggctgcagtagctataatattgacccctttcctttaaaaatcctacgccggcacagatttcccagacgctctctaggtggcctcagactccacccctttggtcttccgcttctggtttccgattgtagtgtttaaatctcgcgcgctttacaaggattggctacatcagcggatagttggcagtctgcgtgctacccctcctcctcgccttttctccccgggcaaaaggttttcaaattcgaccaatcagcgggcgcgctccctcagccgagccgcgacacccaagggttaaccgcaaccaaccggaggcgggtattggagaaaagagccaatcaggagggcgcagaggtgtgtcctgggggcttataaaggcggcctcgcggcgcgcgcgcgacagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaagccctttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgctgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaatggagcatttgttttcattttgcaagagagttgtagaattagtgactttctatactttcctgataataggggtgggaggggccatgcaatataaacaggctctactgttaactgaaggggcaaaccataggaatttaagattgtggctctgtttcttggtgttcctgggagacaatttattctgtgtgaaatgaaaactattgaggcagaagcagaaaggacgtaccaggagaactctgggcaaaagtcccagcctctgaggtaaggatgaaagggctttgtgtttgttcctatcttcccgccaactccacacgcgcacacacaacaccttcagaactggtttattagtaggattggttacattcaaaggctgttgcttggacttctctaaagagatgaagcccccacatactgaggaggcaaggcagtcatcaaggccccaaggtgaggcaaatccctggaaggcttgaaccctgcagttcagtctcccggggtaatcactccccagatagcagtgagaatggggcactgaggcccgggatgtaggcactggacagcagcaacccaggcatctgtgccccacaaaccagttaatgggcatcgttaagctgccgtgcaacatccaggatgtttttggctcctttgctcagcaacaagttggccaggctgatgcccaagttctgggcagccaactggggccctcgtggaatgttacgagcagtgatgcctaccaactgtgggtcatcctcagggccatcttcatgctgtatgagggaaggaggtgggatttggtgagaacaagagattatatgcactcttgtttattaccccctcgccctccagctttggtacctgggcagggacatggatggtagcctgcatggtctcttgtatgctatctgagccgtctagactccagactcctccagtcaggtacagctggggaagaaaacagttgcctcagcacagtctgagaggggactacctagaaacctgggatgcacaggaagaaatgccacagtcctcctttccctggcttcccgcccatttccccccacttacttgcccatccttcatagctgtatgcacggctactggcacactgcagcctccttcctgtaacaagaagttcttgtgagctgcaagggctcttaacaccaccctgtgaccacagacctgaggacatcactgaaaaggcaactgtgggcccagacctggtcctatccatacacaacattcaacaagaatgagttagcactgtatacagagcattcatgtaagaaatcttccctgccacctttcccagctctccaagtccccagccctccacaggtggagcacaggccctaccaggtgcctcaggaaggccctttcagcgatgcagcgaagcagagtctcgggatcgtgcagcacacccaccagatccaagatgtcctggtccttggctcgcacttccacgcccaaggccccctgatggaaaaacatcctaggacatcaggcctgatctttccccaaccaatggcgcaaagcatgggaccacctctatctacttgctccccagcgccttttggaccggtagcatcccaaggtctgcccctccctgagaatgctattctggggaagcagatgcagaaggttgtgagacaagcttcttggttgagaacaaagggaaggcatatgtcaccatgtggcttccctggtcaagtgtacctggcccacagcatacatgcattcctcagggtgcaggatctgtggaggcggaacagggagtcaaaagggtggacacgggggtgtctaaaagcacctggcagtgagatgggagttccctatcatctagaaagcctgggtaggcctaagtgtgagtctggcctctttttttttttttttgtaaattttctccatgaaagcctagagtctggcctctgattcacaatcttcccagcctacggtgttagaggtggggtggtcaagaagtgaagacagatggtccttgactt

SEQ ID NO: 12045 - DNA, 26933 bp, Human
  misc_feature (1)...(26933): n = A,T,C or G
aagatagttagacctcttattagtcatctttatacagctttatccatcaccagacagtaagcctcatgaatgtagagcgtgtttgttatttatttcatccccagcacctcgcatagagcttgttacataacaggtgttgaaaaaatatttgttaaatgagtcaaggaatgaatgggggggggtggggcagaaggttaaggtggttcacatgtgcagtcctcagttttctcacagatgtaggaagtaaggtctccttctgagaattagaggtggatgtcgagaaggtcctggcagaggggtcaaagttttggaaagtcactgtgggctggatggaataaaagggcaataccatcaaactatgtgatcacaggactttctctatcagtgtcttctgcctgggtgaacagatatgacagtttcttttaattttaaacagggtcttgctctcacccaggctggagtacagtggtataatcataactcattgcagcattgactgcctaggcttaagcaatccttccaagagatggctgttttttgtgatgactaaggggatgggtgttattccaagtgtagacataagtttagggatgcaaaggaatctcagagtgcttaagaaagagtggtccagtgagcgactagggaccagcttcctaggatagtaagtgaggatgctggtgggaagtggagggatgaagagactgactggaggtcaggtccaaggctggcagtgactagagtaaaagggcagctggaaggttgtggtcagaaggtggaatattggaatttcagatttcttaagtgtgtcaaattcaggtcgtgacagattccagggtgatttcttaagtgtgtcaaattcaggtcatgacaaattccagggtgcagtcatggtgtgggtatctgaagagcaagtttcaataaggctcaaggaagggtagctatttgtacgcttcctgggaagctgtcagcagatgagagggactctgggtatgagtataggtgtttttcttgagcaaccatgtctctcttcccaacagaagtctgatttagtggaaacagacttttcaggatttttctagtgcaataatcaaatctctaaaaattggcttacgatgaaagtgctgcttagtcaaaatagcatctgcatatctttgatgccgtaatcatgctatccagagttccttaataccaatggtaataaggcgggtgcagggagcagttatctgtggtgaagaagcttaattgggtgagggatatccatgtgccaagatgaaagagcatttatggaactttatagctttatgattcatacagaacatttataaagcattatagttacatggagtattggtgtccagatactagtaatcacagacacttctataatatttccactatgccaggtgttgtgttgagggctttacatatatgaactgacttcatcctcccaatagccctttgacatatatactatcatcattaccattatcttcattttacagatgaggcaactgaggcccagagaagtcaaatcacttgcccacaagtcatacacttagcaaatggcagagccaggatttgatcacaggtaaatcctgcacatactggaaggaggcagttagcccctaggccttctgataaggaaatacagggtaatactcacctaatcaaggctaataagtagtagagctggactctcatccacggctgtctgagcccctaatctccaagtcagagtggttcatttgcccagatgacgacctttagttgtgaaaatgatctctggcctttgcagtcttccctggtggaaagaaagcttcagaaaaccttactggtgacaggaagtagttgctcaatacatgtttgtggaataaacaaatgagtgacgattgccacactcccagtgtcacagttggcccacagaacacgttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcaggtacctcaataaatatttgtccaatgcatgaatgagtaaaggtgaaggagggggagtggtttgaaagtctattctcatccttccagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtgggtgagtggctgcaggagagggccgcgaacgggtgcggtttggcctggcttagtctttgcagcattgaacccccacctcagggaaaatgatgagcagaggtcaggcttgccgaggctggccctgtgcaggcacatgccacgcctctggggatcttaagtcctcacacaaccctgtgagatgggtaggattctcctccacctctgatggaggagaaatcagagaggaggtaacttacccagactccagcagctagtaagtaacaaagactagactggtactcaaggctgcaggtctgaatccctttgcagtgactgaatcattttgaggttattttgcctttcgaaagaatccacccccacccccagactggaggccggcagcatagcatcagttcagattttgaagaaaataaagctgggaatggggatggaagtggaattctgtcttgaactttcatctaaacccctggtctctgccctgacacctacctttctgctttttgctctcctcctacataaagatgctaagaccacatgaaaccatctgaagcagttttaaagcagccatttctatagaattcatgggccaatgatgggccgttccttggtttaacagggggaacatggctgtacaatgtgatctgtaacgagtctcccgtgcattgttttagttatagagggtgatgccatgtctcctgacttcattccatctcaaccagaaggagtttatctgtatcctttcccacaggctctttggtctgctctgggggtggctcctgcagatggtggggctgggggtttttccacaccaccctatatgttcctttacctggatacagatacagcaagtaccgggagcctgaaaaggtaagcttcaaaccactttctttttcttcagaaaattaaggccccttatttaagagggaggaaagccaggaaaacttctgagaaaacactgtcaattagaacagggctggccgggagcagtgactcatgtctgtagtcccagcactttgggtggccgaggtgggcagttcacttgaggtcatcagtttgaaaccagcctggccaacatggtgaaaccccatctctactaaaagtacaaaaattagccaggtatggtggcgtgcacctgtaataccagctactcaggagcctgaggcacgagaattgcttgaacccaggaggcagaggttgcagtgagccatgtttgtaccactgcactccagcctgggctggagactctgcctcaaaacaaacaaaccaaccaaccacagggctttatccagctctgtagtggggaaagggggcttggaaaggcattatgcttttgcaccaataagcctcctcttatgcaagatgcatttttatttagcatattcatgtttcacgcaatgatcagatctctgaaatgtcagtttggttctgttggaggtgtccctactctggttagaataatcaagctgttcagactcactgagatccccttcttttgtgtagtacatcgagttagatggagaccgtctgaccacggaggatctggtcaacttgggaaagggacgctacaaaataaaggtatggggagggaggggaaagatgtcctctggccatttttgttgcccgtggaagtctttaacgtgctcagttctgatcaacattttcctagctcaccccaacagctgagaagagggtgcagaaatccagggaggtcatagatagcatcataaaagagaaaacaggtatctttttatctttatgttataaatatttttataaacaaacaaaaatccctgcatttaattgcataatgtctctttttattctagttgtttacggtattactacaggttttgggaaatttgccagaactgtaattcctatcaataagctacagtaagtttaaaacacacatatgttcacgttccacctaccctcatcttttaaatatttttcaacaagggaaataattcacatttgccccaatttacagatcagaggatgaggcttgggttaccttgcatgtgagttggtattgaaaacccaggctggctggtttctcccattgccttccttctgtccctccaaggatttgaccatgattcccttcattttcccagctgagggaacattttctcactgcaatgtatctaagagggtttttacctttctgttgcagggagcttcaggtcaacttagtacgctcacattcttcaggtaagtcaaaacgttgggtgcctcctggatcttgtgtgattagatgaataaagcacagcacagtgtgagttatccagttatagtcacaaaaagctagtttctcaaaacagcatttcaagaactaggtgccgaggtgagaagggatgcagaaagaatcagctgagcctcagaaaaagaaatgggccaggtggagggatggggttggtatgagaacacatgtcccatgccatggagacactgttgcattcagggaaggaaataaagcctggaactcaaagaatgagttaggatgggcatagtgagatgggaaagactgtcaccaatcagcacccatcagatggtaaagaagttgtgctaaggactctggatgctattctaaaggtgagtgggaggtcaggggttcactgaagcttcccaaaaaggggaattgagaaggcaaaactggggtcttaacctttgtcaggaagatggggctcagacaagtcagacaggcaggagggagagtagtccaactacctgagccgagaggagaaggtaatagcaggctgggctacatatgggaaagattggagggagggagggcaattgtcaggagacaaaaaggagtttgcttttcttggagaaaacatcaattctgttttgcaggtgttgggaaaccactaagtcctgagaggtgtcggatgctcttggctttaaggatcaatgtcttagccaaaggatacagtggcatttccctggagaccctcaaacaagtcatagaaatgtttaatggtaatgcaatggctccctagacggaacctctgtggaggctggacatgtaccacagggtagaattgattggccagatgctgaggaatcacctgagaagacatgaaataattgaaatgagtgggaaatgccgttggcaaaaagtaggatagttagatgggggaagaggagaaagtcgatcagagatgcttactcctatgaactttaacttattctgcaagaccctttccctagcatttgtcatcttcaagactagaacaggactcttaagtctgcccttacattcaagcctgcctagaagaaacttggattaagtggtacatgaatatggttagaaaaattgcatgatatcaatgtccatcccaaaggccaattcagtagttctggttggtgcctgggaatctgaaatcgtaatgtcccccaggtgatggccagacttgcacactaaaatccaacttcttgcaagggtagaacagaaatgcaaagaggttaatgactcccttgtaatcaagaagccatgtagtggcaggatatgagggaactcaactctggagctttcttcttggataggaaaattctaatgtggaaaccagatttgcagtgattggaggtattgtcccttctcacaggtaaggacaagccttctaggtcagtggagactcagaactctttgaggggaaggagagggaggagaagcagtgctgaggcagtcacaaacagcaaaacacattcttgagtttccatgttatggacgcaagtggcacgtgaataggatctgccaatgagtggagagcaatttcaatgagcagtctattgtatatacagggctgtgctgaacagactagtagtgattccaacacctatttttactcctaccttggtctgccatactatatagccctaaaatcccagatagtagcactccaaccttaaacccacctgtactttatgggggagtctaaggcacctctgagaattccccagcgtgaactatcagccagaagttggtctgtggatggcactgccatacccgactgacattatttaacagttggaaaaaatgctgctgtcaggaatctgattttatttcagaaaaatgaagcctcttttttggtaactttttgggaatttcttagaaaatggcacgtgttcattgataaggggcagtggagtgtagactgggtgactggcaaaatgaaaagactcagttgcctatgacttctcttcccctgggaaaccttgttaatgctttggtgcaccacctccttctggaacattttatattacttttccaatgtttccaaacattttccaatagctgtgaatggctaaacttggtcaaatgaatgtcctttaatttcatatttagataatttctaactatttttcctataataaacaatgaactgtaaaacaaaaacaaaaacaaaaaaaacagctagttcctgatcacttcttcaagatatattgctaaaatttctacaagtggaagtactaggttgaattagagcacacagattttgagggctttgcatccagaagtgtcctccttccttcttcttatttatttaggagacaggatcctgctttgtcacccaggctggagtgcagtggcacaatctcggctcactgcaacctccacctcacgggttcaagtgattctcccatctcagccttcccagtagttgggactacaggcatgcaccaccatacttggctaatttttgtatgttttgcagagacagggtttcaccgtgttgcccaggctggtcttgaactcctgggctcaagtgatatgcccgcctcggcctcccaaagtgctgggattacaggcttgagccactgcgcctggcccttctttccttcttgctgactttccctccagccctcctttcctccctgtctcctctttaccttcctctcttcttcctctccacccccactcctctttttctttctataacaattcatccaggtcccttacatattagctgggtttgaagaattgtctttccccaggtatctatgccataaagtgatagatattggaggcagggtgtttgcgggggcagtgggggcactcactggcaaagcaaggagagtcagaatgcagtactcttgaactaattgctgcctacttctctcccagcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtaagactcgtagcagcttctatctgcagcaattgccccaggttggacaccaactgtgcttgcatgcttcgtatcacctagtccttacaacagcccagtgagggagctcctactatccttactttacagatgagacagcgaaagcttagaagtcagactaggcaagactgttgttagcttctatactcggctgtcagccttctgggtttggtcatcaccttggtgaaaaggcataactgctactgttaatcccaactatttatcctgcacctacaacatttccagtgcctagcagggaggtcacacactctcacaattttaattacgagctggtctcacaggtgcagtggtatggctcatagcacttactatatggcttctggaaagcaggtttcatttttccctaagctcttaccctagtggctaatcaaaaaagcctgtttttgataaagctttggtgttttcttcatctgtgtctgaatttcattacagcagcataaagcatcatttaatgtatcatccctgatgaactgctgggagcttccctgatagtaagtgaaaggggtagagggccccagaagaggaaacagctaaggaaatagataatccttttggggatgcagcttctagatcatctgtcttccgtgcaggcttgtctttgattatttcactatggacagcgttttcctccgaccaccctcatacagcaatcaccctgacctttctaaacagcaaattcaagcatgttctggtgaaaacttgtaatgcttcccattgtcctcaggataaaggctaaacttaaagtggctttcaagggtcttgtttgtcacattagcccctaatcccttctatgtgtggttctgcattgcagaaactggaggttgcttggagaaggaatgttctgggcagagggtctggtacaaatacgttcttctctctcctatttctgcttctgaaacatcttctagggatcttttgaagccagaagttcaagaccagcctgggcaagaaagcgaggctccgcctctacataaaataattaaaaaattatcctggcacagtagcatgtgcctgtagtcccagctactcaggaggctgaggatcacttgagcccaggagttcaaggctgcagtgagctaggattgcaccactgtgctcgctctagcctgggttacagagacaggtgtctaaaaaataaaaagaaaaatagaaaagccctctaagaagcttccgtctccgctgctccacttcctacctctcgagttccttgtgaccctcctgtatgctctcctagcaaatgattgttttccactgcaccccacccacttcccacatcctcaagcactgaatgtactattactcagattgccctgagcttgcctgtcttcattttgcctactcctagaccgaccccaacacccagaacagaatccagcctctagctgatacttgaatctgtgaaattgacatagtaaatgggaccagctctgtccttctcttaccttaacttccccttccttctttcctagagagaccttaacttaatgactctctacttcttttctttcaagggaagattgttctgcccatcgccccctcgggattctgtctccatctagtagagggaattttataatcccctcttcattggtgctcacacatgtgccacaaaaaccctgctctgaggttttgccagtatttaaatgaagcactaatgaggttagaggactttttaggtcaagctctggaggcaagggagcgtgaactgggaggagtccagcctgagcacaacacagatgcatgtatgtgtgtcagatgcctgcatgtcaggaggcagtggtaaaaaaggtgaactgctaaggtagaaactgaacacgaaggacgtagaaaccaaaatttagggttgattctatagaaaatggagcccctgatttcagtacaaaaattaattgaaagataagtctgctttcatgactaaagaacagaactagagaatagaccagagaacatgaatacagccagttcctgtaggtctcatttcttataagatggacttttgggcataaagagctattattggattccatatgatattggaaataggctagtatttcatttgatacccattttcatatttttaatcattctataggtgctagaagcccatggattgaaaccagttattttaaaaccaaaagaggtaaggaaactcaagaaaaatatgttcatagtgcatgagtttttatttatgcagtattttcagttttaatctcagcctcaatcattccttaaatgcaacttgcatgtttgcttaaagttcatccctgaagaaggggcaactccgtaagaatttaaaagattctttatgccaggcatggtggcggatgcctgtaatcctagcactttgggaagccgagacaggtggattgcctgagctcaggagtttgagaccagcctgggcaacatggtgaaacccatctctacccgccccccccgccccgccaaaaaagacaaaaattagccaggcatggtggcgcacacttgtaatcccagctaccctggaggctaaggtgggaggatcacttgagccctggaggtcaaggctgcagggagccatgatcgcaccactgcacaccagcctgagcaacacagtaagaccctgtctcaaaaaagaaaaaaagattcttcatgccacaatgcatagggggtctcttaggaacttaaaacttcaaatcgagttctgttaggatctctgagagatagatgttctcagcccaaattccttagaatgctctaagctaagagtcttggaccagaattgggtttttttggatgtctcatctataacagtaagaatttaaggaagaaatgcaacctaatgcactaaagattttatgtgcagtctacactccagagctgcattgctgctttgggaatgtggatacttaatgagtgtttcatttgccagatttgtgcttacgagttcacatatgatagcacttattcttcaagggcttaaataaacattactgtcccgcactttagaaaacataaacataattttttatgtttatgactggctaatttttctcttatgaaagcaaaagatacaaaatccacgggtatgtaggttcgttacaataatcacagtaggaaactttgctctctcccccgacagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactggtcagcagggttcttccttttggttgttattcattcaaccagaggtggtggggcggggtggctgagatctttagacacagaagtggtgggggcaggtagtagggaaggagaaaacccaagtgcctgtggcgtacccagtgtgctgcctcttcatctaggctatggcacaactgatctttgaaagaactgcaatttacagatacacacagcccggaagttgagtgacttgcctgagagcacccagggatctgggtgtgtcaagctctgtgctgtcttaggaatctttttacaggacttaggagtcctgtaaaaaggagtaggattagagttggtcccgactagaaaattggggaagaaaaactgtcgaattggtagcttatttagaaagtagtgaattttgacgacctcccaactataatatgaaaaagggcagaacattgtctaaaagtgaatgagttaaattaggccactgtagggctccctcctgttattcgccctgttcctttaaggtaggcccagtgtcttgagtggaattcccagtggtctcaacatatagtttgctctcagatatttaaagtagaaggagtcaagtcaataaggaaaatcgtgctttcggagttaagtttctaattctgagtggtggctaaggacccctgggacttttgagggctgtgtcagcaccgtagatggtcctgaaccattgatggtcatttgttctaatatcagaattactcgacctggcatggtggctcatgcctgtaatcccagcactttgggaggccaaggtaggaggatcgctagagcccaggagtttgaaaccagcctggggaacgtagtgagacccccatctttaaaaaaaataaataaatggaattattcagactttttctccttcatcaattctagacattcatgctcttcgacctcaccgtgggcaaattgaagttgcttttcggtttcggtcactcttggactcagatcaccacccatcagaaatagcaggtctgaccatgtttatgggagtgacctatttggttacgtgttttgtgaaaagaattggtaacatgatccctgtctcatcccctccacctcttccacagagagtcacaggttctgtgatcgcgtccaggatgcatacaccttgcgctgctgtccacaggtaaaataaagaaaaaaaaaaaggtcaataaaaaatgccaataaagtttttctttccccaggttcaggatgaaaaattttaaaataggaaagtgttagaaaaacatgtaatggtcaactatagtccaaatttcttactgtctctatgaaaagttatgtatattttacctttatgtgtgcaattgttgtaaagtttctattctatatggtgaactatttgttttcttttgattgttcaacctactttcagaggacaacctctttttttttttttttttttttttgagacagacaaccaacaaataacctctttgatttggagacagagtctcactctgtcaccctggctggagtacagtggcatgatctctgttcactacaatcttcacctcccaggttcaagtgattctcctgcctcaacctcccgagtagatgggattacaggcatgtgccaccatgcctaatttttgtatttttagtagagatggggtctcaccatgttggccaagctggtctcgaacccctgacctcaaatgatccacctgcctcagcctcccaaagtgctgggattacaggcgtgaggaccgtccccggcccagacaacctcttatgttgattcagtgccctaacttttaaaaattcttagtaataaaatcataaccagttagtagagttgtactgtttctccctgttaagatgaaactttaaccagatagtcagaggtgtttacaggaaagtcttaattatatcattttgaaactcaggtgcatagtaatggttataccttacttgcattttatgggcaatataaattattttaaatgaatttgtgatgcttaactttaaattaaaaatgcagatgacctgggttggcattaggcatctgtattacagatgtgtaatttacatatgacagttagagagccagtcatctcaataaaccatattttggtctgtgccaaatttcagtctatggtgtaatagagagtcctccctagaataaataccctcatttccctttagtcagcaagttatcttttctagctagcttattgagcaatagatcaaaacacctatgggtaagaattgccaaattagatctacaggaagattaagtcctgatgtaagacttccctgatattttaataacgatagcagattctatgtgacaggcaccattatcactgtctttcatttattaattcatttaatcttcccaactataagatactctttctcccattttgcaatggggaaactgaggcacagaattaagtatcttgcccacgatcacacagacagataattacttccttgacttctgggagaaaccagagccaggtgctgctttatagcattgtggctatttctggggtttgtacagcgtagctgccttatgtgtgagcatcttctaatgtgatgccttcgtgcttaatgaactttaccgccttggataatagctaccatttgagtaatctctgcgagtcacatctaagaatttgtttgcattattttatgtacttctcaaaagccataagtgctattgtctcttttctaagtcttcctatcttttaactataaacctaaggaacttgcccaagtcctaccactaacctgggagtgaatctgcctgtgtctagagttggcattcttcctcccacaccatgctgctttgtatagattgatctaatgtgaatatatatgataatgaatttattctaatttgtttcagtgaaaacccaaaagaattataacaaaattatcttcagttcaaataatttccatggttataactttaaaataagatcttctgtattctttataactttaagataagatcttctatattcttttaagaatattggtactcttcaggtaatcaaatgggtcatataccttattttgattgtattttaggtccatggtgtggtgaatgatacaatagcatttgtgaagaacatcattaccacagaactgaacagcgcaacagataatcctgtatcttttgattgtatactaacctgcaattatagaattgcagctggtaattttaggatctactgaaacaatcattttgtgtagcttctcagttccattgctccatttcacagagtaaatgaatcagtacctgaggctcagaggttaactgactttctccaggtcagagctggtaagtggcagaggtgacctgtgaacttactctcaggttccaagtctaacatgctgtactttcaaaatggacctattcaagatttaagaagatatttccagcattggctgacatgtttcctgaagacactggccctaaaacccactgccaaggttgttggtggaagggtgaagacgtgggtcacaaatgtgattgcagaaatgctgaacaatttatgcaggcctctctgctttgagtgagagcagtttgcattatgcagaggtcagccttttaacacttaccaaagtattgattaaagagttatggcttcctcatcctgaggtttttggcatttttttttttgtttatttttagacggagtctcactctgtctcctaggctggagtgcagtggtgccatctcggctctctgcaacctctgcctcacgggttcaagcgattctcctgcctcagcctcctgagtagctggaattacaggcatgtgccagcaggcctggctaatatttgtatttttagtagagacagggttttgctgtgttggccaggctggtctcaaactcctgacctcaagtgatccacctgcctcggcctcccaaagtgccgggattacaggtgtgagcgactacacccagcccccatcatgagtttttatttgtcatgcgcactttgctcaaattagtgcttttgcgtttgttcaaagaaatagtaaaactgattccatttctcaaggatggaggtcctctcttaatggtgtggcttatctcagagccatctggtttttctctggaatgttccatgatggctcagttccccagatgttgaggtgatcagtcaggagtcacactggcacagttttcatggagatagcactgcctctgaagataatcaaacgcctttggaatctatttttcctattccacatctgcctcagttctgaatcctagagaaagtgctgagtaagcagccccaaaagcaggtcacaggctgagttagaagatggttatgtgatagctccataaggtttcccatgagatggcttttgtatgtatgtgttttttgacaagcttacttcagaatgtgtgttttatgttctctcacattgttttacactgaagtcaaacccacactaaataagcctcagaaattgtgggtctctccattcacctcaataccaccccatcccccagatggaatagtagtttttatgaactctatgtagtcttatctcacgtaccagtcttttcactgtagggaagaggtatctattctacatttacatcattgcttttaaagggtatctcatagtttttagaaattaccattcaattactgaatatggggcaggggataattaattcctcactaaattcttctgctaccaattgcctcagcaagaatttcagccaaaagtcttttatttttttcaattaaagattgctaattattgataaatttccaataggctaatatttgggagttctcttgcaatactgctgttacctgaaagaatatgtgtctcaattttctgttgcagatacggagccccatcacacatgctggatattatgggagttaaattctaattgttttaatctaatagccaacaaacaaatttggaacaactagaggacaataaaaacatgtctaagttctaaattgatgcagaattccattgctatagggattcagagaatggagaagaggccaagaccaaggagctagacccaatgggctcacagttacacatgcagaacagagtaatccacacttgagtaggttaatgtaacacatacatctctaactctttcaaagttagaaactttcttgcacacagcaagttctcagttaataggtaatgaatattcttgagcccaagaggcaaagattagctctttagaaccaggaagaaggatctgttactgccttttcctgggtgcttgctggtttaagtaaagtgcatgatggaatagaattatctgaggccgggtttggtggctcacacctgtaatcccagcactttgggaggccaaggtgggctgatcacttgaggccaagagtccaagaccagcctggccaacatggcaaaaccctgtctctactaaaaatacaaaatttaactgggtgtgatggtgcatgcctgtaatcccagctactcaggaggctgaggcacaagaaatcacttgaacccgggaggcagaggtcgcagtgagccgagatggcgcccctgcactccagcctgggtgacagaatgatacagaaaataaaaaaagaattacctcagagtaataatattcagcaaatttaaacttgccacctacttaaaatggattcatgaggacatattggccaccatctgctgttgaacgctgacaccagattactgagtaaagaatttgaaaattttctcaaaattgattgttccagacattttggtagttgctcatcagcagagtttcccattcaacagattcttctatggaacacaaatttgcagtgcccattgaagaaacagaagttgctttcaaacagatgtgttggtctctgttttagtttcaggctataaaccttttgagggcaggtactaaccaccaggttagtacagttatggtgctttagaatctaatctcaagagaaaacatcatttcaaggttcatgttttttcagcctccaaattgggtgtacatgatccacctttaaggctttttgttttttgcttttgtgcccctttatatctcttgcaggaagacttgtctctttccctccacctcacatttgtacacagactgccacctccacgttaaaaaagaaggcaggaaggggttgtacttgaagtaaccagcaaacgttatcttcaagccttaacctcttttgaaagatggtctttgccaataggggagagacaatttctggaggaaacttccatggtgaatacccagccaaagtaagctttttagaactgctcttgacccagaaggcacatttcaatataggctgactaaatggagaccctctttcaggccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttggtaaggacactgcccctttcccagaacacacgcccgtccatctaagggtctttccatttcacctagaagtatcaaatgtggtctgtgagtgagatctaacttttcaccacttttatctgcatcctagttctctcagtgcaaaggtaacaggttaactctaatatttttcagaaaaaaatagtttaaaaacttcgatactgttatgctgaaatataataatacaataataaggctgtaatggacaatttctctgtggaaagcaatttgacattgcatgtgaacttcatctctatagcttttttccaaatctatttgaagactattggaaaaagactaagatggttatagttaatggtgaaacttgaaccaacctataattaaactttgaacttttaaacctataattaaactttggattcatttcactagatataacaaccactaaaaacataaagatgttattgcaacattaaaaaaatgcttataagaatcaggataccctctgtgaagattgagcttcaatatagtttatttctgactcaagattgtaagagacagattaacacatcagaacagtgcctggcactaagtaagtactaagggcctcatttatgttcattcacttaattgcacaattgtcacctgaggtaagtgctattattgttatctatagatgaatatctgaagatctgagagttaagtgacttgcccaatattgcacagctagcaagatgtaaagcagaattcaaaccctgaattttggcatgcaaaaatgtgcttttacttcaattaatgaggatctcattttaatcaatacttaatcctaaaatagggttgtcaaatttaacaaaaacacaggatgactagttaaatttgaattatttgggacatacttgtactacaaaaattatttttttaatctgaaatcaaaatttaactgggcatcctttactttatctaacaaccctaccctaaaaggcaggatagcatgagttattacatgcgtagatgctagatcagaagcccagctctgccatttactagctctgtgagcctctttatcctgttgatcctcaatttacacctgcataaaatggagataagtttacctaagggggttgtttggaggattaaatgaattgatgtatataaagcctggcacatcataagcactaaaaaaatactagttgctattaatattattcccaaccaacacaaataaccaactaagagccactgaattcacctcctctgaccggtatcttctatttgcttacttgcttattaataaaatacccctttaacaggtagaaatttctcacaataacgtagtagtgggggagtagtcattgatttctagagaacaggatggacattgggaagcctcatttgaatatgttttagtttcccaagctgcctattgaggttgtttggcttgctttcattgtagtaaaattagtgtttttctttttttggcccttgtaagttatctttccgaacaagccttaccacagtttacttatctgtatagtccacagtttagggtccaaggacttgggacttacagtgctgaaacctggaaagtccttggccaaccaacatgaccttgacaaagtagcatgaccctagtttaaagcgagatcatcttaggatgcgatcccatgcagcatagaaaacaactgaagcctcacccatgaccactcttaaagccagagaaagaggagaagagtactttgagtctgacctttcctgacttctaagctagggtgagggaacttcataacctaagtttttgctacttatagtgtagtcctcagaccaacaatatggccatcacctgagagctcgttagaacagcagaatttcacgccccacccaaagctcagtatatttgttataacaaggtccctgagtgattcatgtgcactggaaagcttgagagtcccatgtcttggtcctccctagaattcccccacctcccagatatttctggcagtcatcgagcccctgtttacatccatttatgtcatccttgaacactctgaagtgttaaatcttcttgcccaagatttatgggtccagcctcagtccccaaatgccacatcggaattctggtgacacaaccaaattgacgtcaagtacctgaaaatggccatcatgtctctttctcccctagtctccctggcatgctatatgcttcccaggttgtcatcttggccttgttatattagaattcccagttctcccatctccgtcttacctcagaactcactattgctttagagtcctcacttggggaaaaaaaaatgacctgcttccttttcccaaagcagctttctaccatcaggtgcttggataatgtccaagatcttctggagagtgtatcccatgctgtggagcactctgtggaagccacgggtcctttagacagctcatcctatgaggagcacttcttaactggcactggtctcttgcagtttctgagaacaaggctctgtgccatccctcgtctgttgactccctctccaccagcgcagccacggaggaccacgtctccatgggaggatgggcagcaaggaaagccctcagggtcatcgagcatgtggagcaaggtaatgctgatgagttcggggtggcgggcctgcctgatagaccactgtgcctgtggttctcaagtgggatctcccaccagcaacatcagcatcacctggaaacttgttaggaaggcagactctcaggcctccttgcaggctggctaattcagaaactccaggaggagagcggagcaatctgtgtttaacgaaccctccaggtgattctgatcttcactaaagattaagaaccagggaaccatgcagaactaagctggtcctttggctggctttttttttctcttttttttttttttttttttgaggcaggatctctatctgccacccaggctggagtgcagtgttgcaacaatagctcactgcagccttgaactcccaggctcaagtgatcctccttccttagtctcctaagtaactgacacctcaggcaagcaccaccacacctgggtaatttttaaattttttgtaaagatggggtcttgctgtgttgccttggctggtctcaaactcttggcctcaagcgatcctcccacctcacccccaaagtggtttttttttttaatgagacttttaaaacatattcaaagtggagagaagagtaccatgaactctcacaccccaccttgattcaacagcacattcaatttatgaagtacactatgaactctagtgagtgcagacaggtcacagtgggagaggatgaagttgtggaattcactgtggacctggaagcaatttctcatcttctagtccagtatccccaccccgcaattcatatggaattggaaaccacgagatgtaaagcatcttgatgaaatgcatacaattatttaatagaactggggctcaagatgaggatcagctcttctttctgacttccttccctacccacatgacccaaacttggccaacaaacctttgttagaggatgtgaatgggggacatggcagattttgctagtgcagatgaatgggcagcttcctgggtaggtgtgcaggtctggtaattattcaggtaaatgtctcaattctccccttctcagcattaaagatatagtcaaggggttagaaaacaggttaaaatggcaactaaataccaaagcaacttcattctaccaatagacagagaacaaaccatctgttagttgggtggtgatgggtgtcaactttgggaaatccacattccttaagcatgaagtcagactttcataagctaccctcttggaatttcttgtttcagtgctggccatcgagctccttgcagcctgccagggcatagagtttctacgtcccctgaaaacaaccactccgctggagaaggtctatgacctggtgcgctctgttgtaaggtaagatcaaacaggtctctgaaaattacatcagttcagcactgtgaaccctggcagggtttcatgtttggctgatgggcggatgtgctctccctgtaggccctggataaaagatcgcttcatggccccggacatcgaggcagcccacaggctgctcctggagcagaaggcaagctggctccttggcttgtttcttaatttttaattgttacaggaaagcaaagtcggggatggagaaacattgccttattctattgttttctggccattccttgggaatgagcaaaaaggtatttgagcaacaacttgcagcaccactaagaagccatataataaacactaagtgcaccagggtgcagccaacggttgaatatctaaggattagaaacagaaatggattttaaatggagttttgggacaatattcatggggaaaaaaataagatgtcaggttcattgatgcctccccacccctgcaagatgtcctctttgattcaaaagtgcgttcccttctgggtgatgctatcacaactaccaccactgggtgcaatggctgcgtagacctggagagaaaaccaaggcccgggtgtttacttcagaagactttcggtctgtctagtgctctggtgagatgcgggtttttctttcttgcatatttccactggttacattgaccgtatactcagctgccaggtacagatgcccagcatgctggcttatcttttaaatatcgtttttgaagtgctttaaaccttttgaataacttgtgggtgttatgttccctagaatcgcttgatttccttaaaacagttgctctgctctggggcagtgatttttccctgtgattttcacacccattatttctaagcatgccctgcactctggatggggaagctgcttgcctgctgccaactttggtgctaggagggaggtatacgagaggttagcctttaagagtattcatttgctaaggtcataaaaaataataggaaagcctccttggctgtcagtggcaatcagttaaaaagcagatataaaccaaaaacagggccttaatttcattcaatttaaaaaaaaaatttttttagagatgcgggtcttgctatgttgccaaggctggactcaaactcctgggctcaagtgatcctcccactttggcttcttgagtagctgggactacaggcacatgccaccatgcccgtccagggccttactttgagatgatgttatgcttaagaaaaaaaaaaaaaaaagaaaaaagaggttggtgggtgggaggcaaaagctaaccaaggatctgaggcagtgcctctccaacattaaagtggctatgaatctgctgggcatcttgttaaaatgcaggtgtggattcagtaggtctgggtgaaggccaagattctgacttgtcccaggtgatgctgatactgcaggggcacaggccacgctttgagtagcagggtcaaaggaacagagcacctgtggcatggaaataaggcaatagggaaatacaattcactgccttttaccatttaaggcttgctttagaaaacacacaggtccaggccatgtgtggtggctcacgcctgtaatcccagcactttgggaagctgtggtgggtggatcacttgaggccagaaattcgagaccagcctggccaacatggtgaaaccccatctctgctaaaaatacaaaaattagctgggcctggtggcatgcacctgtaatcccagctactcaggaggctgaggcacaagaattgcttgaacctggaaggtggaggttgcagtgagctgagatcatgctactgcactccagcctgggcgacagagtgagactctgtctcacaaaaaaagaaaaaaaacaaaaaaacaagaaaaaaccacataggtactgttaagaccctggagcaactatccttcactctatccacactgaattctctgggttttgttatttgcttgcttgttttgcttaggaaaagtatgcagcttaaaatctttatgatgactttagaaagttttggactttgtatatttacagtctttaatgcaaccaaagactaattgacacaggtcatgtgtcaaatggcttaaaataaaagcaagcaaacagcagctgtgtctggtcatgtatagagtatgttttgacttcggatgaagttgatgtttaatagcatgtggaaacaatgtcgtcaatatttcaactttgttttgtccttgcttttcaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcccacagcaattcagggagcaaaaaatgtgctgaggagactgtttacctaaaggttgttcttggtgctattctttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgccttatggtgtcgctttattcttaggtatttatagcaaagttaagcgcctctaacagcagttaatcaagcttctgaaggattcagttgacagatgtcaaccgttttaagaacaatatgcttgactcaatccactctttttcccattgcttaccacaaaagagtgggaggaataagaatttcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacaaccggcaaaattcaaaagcagtatacatttcatactgctttaaacctgtgtctgatttttgggtctggtcactggattgctttttattaaactttatggttctctttatggttcattttgcttttttttttttttttttttgagatggagtctcggctctgtcacccaggctgtagtgcaataatgctaccttagctcactgcaaacctctgcctcttgcgttcaagcaattctcctgcctcagcctaccgagtagctggaattacgggtatgcgccatcacacccggctaatttttgtatttttagtagagatggggtttcaccatgttggtcaggctggtcttgaactcctgacctccagggatccacatatcttggcctcccaaagtgctgggataacaggcgtgagccactgctccccaactcattttgcctttttgcttacttttgttgagagtattaatttattaaatgtaaacattgtaaatgtaaatgtaaatgtaaaaaatagttggagaacattagtttcagcccagagggtagacttcattagtctaacatacaaaagacagttaaa

SEQ ID NO: 12046 - DNA, 10407 bp, Human
taggaggctgaggtgggtggatcacttgaggtcaggagttcaagaacagcctggccaacatgatgaaaccctgtctctaccaaaaaaaaaaaaaagacaaaaactaaccaggagtggtggcacatgactgtaaccccagctactcaagtggctgaggcatgagagtcatttgaacccaggaggcgaagattgcagtgagccgagattatcccactgtactccagcctaggcgacagagtgagactttcaaaaaaaaaacctgtgaaaaaaataaatacgcaaatacataaaatctgccttttcaagacacacacgtgaccaagaagcatatgaaaaaatgttcaacattactaatgattagaaaaatgcaaatcaaaatcataatgagataccgtctcacaccagtcagaatggctattattaaaaagtcaaaaaataacaaatgttggagaggttgcagagaaaacggaaggcttatacactgctggtgggaacataaattagttcagccattgaggaaagcagtttggcaatttctcaagaaccttaaaacagagctaccattcgtcccaggaatcccattattaggcatatacccaaaggagtatacattgttctaccataaggacacatgcacatgaatgctcactgcagcagtattcataatagcaaagacatggaatcagcctaaatgcccaccaacagtagactgtataaagaaaatgtggtacatatacaccatggaatactccacagacaaaaaaggacgagatcacgtcttttgcagcatcatggatggagctgggggctgttatcctaggcaaactaacacaggagcagaaaatgaaatactgcatgttctcacttttataagtgggagctaaacattgagtacacatggacacaaaaaagggaataatagacactgggccctacttgagggtggaggatgggaggagggagaggatcaaaacactacctatcagatactatacttattacctgggtgatgaaataaatttttacgccaaatcccgatgacacacaatttacctatataacaaacctgcatgtgtacccttgaacctaaaacaaaggttaaaataatttaaaataaataaaaaataaaatcttacttggtattctcaaaaaataaaaaacaaaatctgtcttttcaggggaagaaaagtaggaaagctttatctcattttcctagtggcttcataatgcagggacctgcccccagggaacagggtatagtaggggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtaaggacacttcttctggggactctcccttcccctgctcctgtttcagggtaagggtgttccgttttgtaattgcatttgacaccccagatagtttgtctccctggtatacattcctatagcactttgtactttgtagcaattttaatgtaattaatctgtataattatctgtgcagtgtatattccctgctggaatataggcaaggacaatgttcatcttatttattgctgcctcctcagctcctagcacagtgccttgcatgcagcaagtgcttcataaatatgtgcgaagtgaatatttaatatttccagcacaatacaaggctgactctttctcttgaccctttttctctctcaataatttgccttactgaaggtctgtgttctgggcaaattgtcatgtttaaacatgcaaataatctcggggggctactcctatccctgtgcttagtcttgcataaagaggagactggatctaaaaacttatctactacttctactgactccctcaaatcagactttcagaaacttcagtgtatgagcttggtcagtagatgttccctgagcaggaaatctgtgccagactagctggatgtcaccaaggcttaggttctgagctgaatataggaaaaatcaactttttttcttctatatgctcacactcaacacttctttgaccaactgtgtgaggttttttttttttttttactcataccaaccaattctcctatattagctggatatcctataattcaattccattgtgacattaactagagttaacatagacaccaaaggttaaagactcagtcccataagactgcctccatttcagacaccaatcacaagtagtaggttcccaaattacccacatcttctgtccaacttgcctacaaatcagaggttcccatgaccccctccttggggttggtaatttgctaaagtggcttatggaactcaggaaaagtttacttattattgtagattttttacaaaggatattttaattgataataataattataaatattcatggggtggataatgatgttttagtacatgtaatgtacagtgatcagatcagatcatcatctcatttatcatttctttgtgttggaaacattccatatccttcttctagcgatttgaaatgatataaagtattattgttaatgacagtcatcccacagtggtatagaacactagatcataattttgcatcctttaacaaaggatattttaaagcatacaaaggaacatccagatgaagagataccagatctggaagggtcccaatcacaggagctctgtccccacagaattggggtacttcacctcctggcatgtggatgtgtttaccaactgagaagttctctgaactccatagttccgggatttttatggaggcttcatcatgtaggcatgactgattattaactcaatctccagccccttccccttcagggagtatgggggatgggactaaaagttccagacttctaatcatgacttggtctttctggtgaccagcccctcctgcaggagcccaccaagagtacctcattagaacaaaagacactcctgttatctaggaaattctaagcgattaggcactctatgtcaggaaccagggtcaaagacaaagctctgtgcagagctcctaaatatacgtctgtatgttttatatatttattatttgtgtatatttattatttatatatttatttatttattgccaggccagtagaagacattgacctgttctcccttccctggctcctctaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacgtgaggagagaggggtgcagaggggctaccaggaagtgcagttaggagggcaggccagggaggatcccacagtggcccaggggtttgagatttgagcagcaaataagagaaaatgtgtggatctgaaatgtagaaagacggaggattgaacctcaaggggaacaaggtggctgacgtgagtggaacaggagtaaagaaggggaggtgaggcttgaaccgcgaggtgccatgtggggagcttatgcagaggctggggcatctcaggatgcatacccaagatgttcttgccttgttatcccagattttgatgttccagatctgatgtgggcccaggcatgggaatatttggaatcccaggggattctgacacatgctttttctcacccttaaactcttgcattgacaatggcttgaagtttgtgaaagtaaacttgaagatctccacagtacagaacagtgtgtctcaagggtggtttctgaaccacctttctcagaattgcctggaggaggtgcttgttaaagatgcaagccccttagtaccactccagatctgttgaaagaaagtatctggggatacagcctaggaaatctgcattttaacataattccttggatttttatttaagattgtgtttgaaaaatgtcaagatagaggcaagcaagaggatcacctaggagagtaaattagtaaaagatggcagtattagcaatctcattagtttgactacattcattccaaatttaagagtgagtcctaagttaggcttgtttccttgaactatgtgaggagaaaaagctttaactagcaaaagaacgtattaaacaagatttggagaaaaattccttttccaccttaaaaaaacccaatgtacaactctggattactcttagcttccttatttcaaatactttccagtttatgtacttgaaataaatacaacaacttctagaacagcttgcagttcagatctggcttttactaattgtaatcaaacataattctggaggaggaaagaaagaaaggggcaatgaaggaatgggagagaagaaagagtaatgcaggaatacattctaacggttccccttcaaggggcagcatggcagagggggctggggtggaaagtgggttgcaaaatctacgaagagttgcgatagggaagaaaccaggttgaggaagcagccagaatgtcaccctccttcctaaacatgtttttttctcctatgcagggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggttgatgttgctgcgtctatgtttgagggtgagaggggagcgtgcttgctttgaaatgaggatgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttcaaacactgtttgaactcagtgtcgggagtagttaaaggtatcgtgagaagttgcacacagctttggggactcttggaaaagaaagaggaagaaatgaggaagaggaagggtgtctacaaagggccagagaacaggatctcagatcagctgctgtaaccaggtttccccttgtgggaagtgttgtttcttgctgggcagttgggaagggaatggagaacagagaagagagtggaaatcacatgctcacttgaactttcctggggaacgtctcctcacagcgtgcacaagagcctccctttagaaatggagtgttcattttatcatgggaaaagaatctgagtgggacatgattcagaacaggaccggcccaaggaagtgcaggggctgtggagtgggatggagacaagctctgaaaggacacatgggagatctagatgtagaaggtacacaagtagtaggataactcacaggatggatccactggaggttaagacatgtggtaagacagtgtaataggaagctgctcagttggagaaagtaaggaagcaaacattgttaccgtgggggcaatggagaggacagtgaggagccctttatcctgataagggtggctttggggtaaaggaaggaaagaggatgccttgagaggccccactgtattagagaggacctggaagccaggatgctaattctggggagatgggttccccaggcttactctaggagtagaggtccatgggacgagggtttgatttgagaaagatcattttcttgggagtgggtggtgtgagctagacccttggagctgggataaaggaccttttaacccactgagaggtggctgcaataaatggaattgccctgggggtgagcaacagaaactgggtcaagtaagtttctattttttgcagcacctgggctgtcccccatgcagaccctgaaggtttctgtgtctgcagtgactctgggcctgggcctcatcatcttctctcttggtgtgatcagctggcggagagctggccactctagtgagtgactcgctgaactcccatccccactcttggtcccactctctgcttactttctgtttgtgattaactctctccttcctactgcatttgctatgaatactgctagatattttcatccacaaagactggtataatcaagtatcttcctctcttaggttacactcctcttcctgggtccaattattcagaaggtaacatctctgttggtctgtttccctacttgccctttggtaggggtgcgggttagaggggtcagtgttgggttcaactaatcttgattattatatgggtgagcttccatgaggatctaggcaagggcatgatttaagctgccattgctaggattaagagcaggaaggagcatcctcctcttctaccaagtgggatgtctgtggagaggaggctgaaggtgcttcctttgtattagttgttggtgccctggagttttcagtatcactgtattaaggcatgggatggttacagtgacaaacgatgggggcaagttgggttgaagcctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtttttccatgtcttcttcctggggccctggggaaggaatatgggcaaagcagggactgaggttaattctcttctgcttgagtaggggagaaatcaatgccttcttccattttcccacttagacatgacagaatttggggccgttttctgatttataattcataaggagaaattcaactgtggtgggttggagtcacagagtatgggcaaggaagggaattaacagcttactcacctcatacaggatcttatgaggattaaatgagttcatacttgtaaatggctaagaacaccgccaggcacatagccagcctgcaatagtgacgttagctatattcgattattcaactttctggccaggcattgtaccaggtgctttgatcctcatcacaaccgtaaggcagacccctcatacccctcaggattcaggggacagagcttaactccagattgagttctagacagttatttcttccataccctgaatgcagaagggaacatagcttgagtgattattatgtcttaggcactggtctcagacctttatatttgtagctcattctcttctcacaataaccacacaagggacagattgtttccctctatgttacagacaaaagatgtgaggctcagagacatttaagtgacttgtccaaggtcaaagaacagatttctgtaggatgtttgtctacctgagctggaagtagcagattactttattctgaagaccctcatgctggtgagcacacatctcttcagagccaccgttccattcccttctaccccaagaccaaggagagccctttgggggaatggactccaccctaaggaagagaggatgctggctggtggtttgttgtcccacgaagggcgacacctgctggacacagaaacctagggtgtggaattgtttttggaattagagctagatactagaatatgggtaagaaaaagaaaccaagaaatgagttgatttggaacacctccataatttcttcagaagcatccttggaattagagcatctcttctggaaggggttaacagaagaagtcagtggaaggaacttaatctctacattttaccatttttatgtttcattttcatttttttctattcactgtttttgtttttatttttgtttgtttgacaaagcaaattccttttgaaattctagtttagtctaggaatggggggctttgggccttgtctatatctgggcagttttatttattatttttattttatttatttattttttttcgagacagagttttgctcttgttgcccaggctggagtgcaatggcgtgatctcggcttattgcaacttctgcctcccatgttcaagcgattctcctgcctcagcctcccaagtagctgagattacaggcgtgcaccaccatgcctggctaattttgtattttcttagtagggatggggtttcaccatgttggtcaggctggtctcgatctcctgacctcaagtgatccacctgcctcagcctcccaaagtgctgggattacaggcgtgagccaccgcactaggcctatctggacagttttaaaggagaagctgcagatctgaagggtctagttctagtcacagcagtgggaatcaaagtggcaggatcccagagaaaggaagtagagagttagctaatgggacggcttccagttccttttctagagattcccagtgcaggcttttctctgccctaactttgtaggttttttgttttataggaaaggctgtccccttccaggtaaggaatagggaaaagtatatgtaggtctgctaggatccagaaagtcagaatactataggtagaaaggggagttcttacacaggggaatgagtggtacttgaaaggaaggtggaagaagggtgatggtgcaccaattgtaggaggatgaggagaagagaatggatgctgcatgaggagaatggaatgtaaacataatggattgccaaaaaaggagtgcgtgtgtgtgtgtgtgtg

SEQ ID NO: 12047 - DNA, 7179 bp, Human
cacacctgtatcctaacatttgaggagctgacacaggaggaacacttgcagccaggactttgagaccagctaggataatatagtgagacactcgtctctacatttctttttaattagctgggcatggtggcacttgcctgcagtcctagctactctgaagactgaggtaggagggtcccttgagcccaggaatttgaggctgcagtgagccatgatcatgtgactgcacttcatcctggatgacagagggagactctgtctctaaaaataaatcaatgaatacaataaatgggtgctgtttaaagccaatgtttgtgacaatttgttacccagtcttataaaattcatacacagactcaaaagactcctggaatgaactgatgaattgatacgcacactagttacataaaataaaatcttttttaactttttcagtgttttacattttataattttctgtgatgcaatttaatacactcataattcattcattcagccaagaaaaaataatttagtccctacaatgaaccaggtatgccctcatatgctcaagtgcctgacattctagaagcttcacaagaatgaggtggagccactggagtgttttaggtggagaaatgacacactctgactcatagtagcaggaccactatagagagaacactcatgtagcaggtcatggaacagtgctagagccacagttcaggagtgagagggtggtggggattaaggggagaagagggcctgagggatgagagggacggagggaagggctggaggagcaggaggtgaggaaaaggagcagaggaaagaattccaaagcagcagaactcttaggtttaaacacattgttttatagattttaatacatccatctacagagcctcgctgggtgttctttgcagttggcctttaatatcttatgtgggtctgcctagaaactaattgttttttatgttaatcaggtttaaaaaatactaagtattcctaaaaaatatacactccactcacatgtggatacttcctaaaaacaggcagtgcgtgagcactagtgaggggcattgtgactgcactgaacacttacaactgtgaggtgaataaagtttgtgctggctcctggttgcaacatatagtaacatagtgtggtactttgtcttgaggagatgtcctggactcacacggaaacttagggctacggaatgaaggtaaatttaaaataaaacaagcgggagtcacagatacactgtctgggaaagtgaaacttaagagctttgtgagtcctgttgtaatgcttttagatgcatttatataccaacgggccaaagtcacattttttaccgattagattcctgatcattcaggggttaccaaggttatgctacccactatagttaataaacaaaaagcaaactggtctctattctatctcatgcactcaggcacaacttttccagatttaagggggaaaaaaaaccctgtctttacacctacaatcccagggcgagctcactctctggcaacaagctccctggggtgatttttcttctagaagagtacaggaggacaggcaaggagtgggaggcagggagtccagttcagggacagggattccgggatgaaaagtgaagggagagggccagggaccttgccgagggtttctccctggtttctcagacagctcctgggccaagactcagggagacactgagacagaacgcttggcacaagagtagcggggtcagggcgaagtcccagggcctcaagcgtggctctcagggtctcaggccccacaggcggtgtatgggttggggaggccccgcgttggggattctctcctccttctcctaacctgtgtcgggtccttcttcctggatactcaccgggcggccccagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggtgagtgcggggtcaggagggaaacggcccctgcgcggaggagggaggggccggcccggcgggggcgcaggactcggcagccgcgccgggaggagggtcgggcgggtctcaacccctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagtgagtaactccggcccagggagcagatcacgacccccacctccatgccccacggacggcccgggtactcccgagtctccgggtctgggatccaccccgaggccgcgggacccgcccagaccctctacctgggagaaccccaaggcgcctttaccaaaatccccgcgggtgggtccgggcgagggcgaggctcggtgggcggggctgaccgagggggtggggccaggttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcgggtaccaggggcagtggggcgcctccctgatctcctgtagacctcccagcctggcctagcacaaggagaggaggaaaatgggaccaacactagaatatcgccctccctctggtcctgagggagaggaatcctcctgggtttccagatcctgtaccagagagtgattctgagggcccgtcctgctctctgggacaattaagggatgaagtctctgagggagtggaggggaagacaatccctggaagactgatcaggggttccctttgaccccacagcagccttggcaccaggacttttcccctcaggccttgttctctgcctcacactcaatgtgtgtgggagtctgactccagctcctctgagtcccttggcctccactcaggtcagaaccggaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctgctggagtgtcccatgagagatgcaaagtgcttgagttttctgactcttcctttcagacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggagtaaggagggagatggaggcatcatgtctgttagggaaagcaggagcctctctgaagacctttaacagggtcggtggtgaggcctgggggtcagagaccctcaccttcacctcctttcccagagcagtcttccctgcccaccatccccatcatgggtatcgttgctggtctggttgtccttgcagctgtagtcactggagctgcggtcgctgctgtgctgtggaggaagaagagctcaggtaaggaaggggtgacaagtggggtctgagttttcttgtcccactgggggtttcaagccccaggtagaagtgtgccctgcctggttactgggaagcaccatccacactcatgggcctacccagcctgggccctgtgtgccagcaccttctcttttgtaaagcacctgtgacaatgaaggacagatttatcaccttgatgattgtagtgatggggacctgatcctagtaatcacaggtcaggggaaggtccctggctaaggacagaccttaggagggcagttggtcgaggacccacatctgctttccttgtttttcctgatcccgccctgagtctgcagtcacacatttctggaaacttctcgagggtccaagactaggaggttcctctaggacctcatggccctgccacctttctggcctctcacaggacgttttcttcccacagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgaggggaacagtggacatagctgtgctatgaggtttctttgacttgaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttactttttcaaattatttccaagagagattgatgggttaattaaaggagaagattcctgaaatttgagagacaaaataaatggaagacatgagaactttccacagtacacgtgtttcttgtgctgatttgttgcaggagaggagagtagatggggctgcgcccagtgggtgctcaggccaccatgaactttatgtggtcactgctcagctgggtcatctttgctgctccattgtccttggcccttcagtagaaccttgtcccaccaggacctgtgatcacatagacttggatatcacctagggtggtccctacacttagaagttcctgtgttatcagaagaaaaattttcagacccctacacctcttcccctccttccaggtctctttcaattgtattttccatctttttttttttttttttttttttttttttttttgagatggagtctcactcaggctggagtgcagtggtgcaatctcgactcattgcaacctccacctcccgggttcaagcaatcctcctgtcttagcctccctagtaactgggagtacaggcacatgccacgatacccagctaattttttgtatttttagtaaagacgggatttcaccatgttagccaggatggtcttgatctcctgaccttgtgatctgcccgcctctgcctcccaaagtgctgggattacaggtgtaagccaccatgcctggcttccccaaccttcttaaaggaagcagattctgaaacttcccgagaggagaggtcccagagtttttcattgtagtttactttctgttggaactcctcttctgctctctctcctactcttcttcctgccctgagttgtagtaatcctattgctggctccaaaccaaactcatggatttgtaaagcagagtctaatttagattcatatgtggttggataattggagccataagccttgggttatctttcctcaagagacaaatatggttgtgtgctgcagtgtgcaggaggattggtgtgggaggagggagggagggaggacacaaaagcagccctggtgagaaaagcactggtgcatttatatccacatgagataatattgttccacagcggctacaaaatgacatttggcctgagtctacattaataaagatattgcctttagaataggggggcgcactacagtaatcatccattcaagtggcatttgttgtctgctaggtatttgactgtttttgcatttagaaaacatcgttaaagtaaaaacagaaaaatttctggccttgtcgtgtatacattctagatgcaagcttgtccaacctgcagctctcgggatgcatgtggcccaggacagctttagaatgtgacgatttttttgcttatctgtagtggcagatatcatgaaaattatccatgcattttttttcttttttctatttttttctgctcatcagctgtcattagtgtattttttgtgtggctcaagacaattcttcttcctatgtgacccagggaagccaaaagattggacacctctgcaggcagatgatatagtataagcagagtaggaacagaaaatgcttgagttagaaggtggcaagtgctgtgtggcaggtgatccagagggtgggctgtgggtacagggaggtggctgttgtgctgggtggtcagcatgggccttgttgcaaatgtgaccttggagtaaagatttgagggatgtgaggagttgtctacacggatgtctcagaaagttcttttcaggcagggaaaccttcagtgcagatgcactagggcaggaaattgtctgtgttcctggaaggaggaagaggccagaagtgttgaacagagagaaactgaaatgaagtcagaggtgtgcccagagcaggttgccctggagggtgtgggaaggatgttgacctttgctctgaatgacatggggagttagaggacagttttggaaagtgggacatggtaggacttatcctttgaaagcttctctctggctgct

SEQ ID NO: 12048 - DNA, 6201 bp, Human
ttgctagggagagatattggttcaggtagatgtatcacattctaaatttttcctccagtctagagaggatggctaaagattacactcagtgttgatttctgtctgtggctcaaatttctttaaaaacaaattttcagggtgcctcatgtgaatggacagcactcttcacactcatatacacctaacgtggaaaatctctttgtacctcttcagggtgattccagttagaaagctaatatgatcccctttttaacctcttttcctaaattagtttaaagattagtcccatataataggctttatgtggctaagcattaagtgactatccatcaaatggatatattccagcatttagtaactcatatgagtaaccagtatgaatgaagatagaattgacattccttttcaagtgtctccaggcttaggaaataattttccttgtctgcgttccagactcagttgtgagaaggctgtttatactgctctttgaaaaatcaactaaggtgcaccagctgaaaaatccttgcttttgcatgccaatatgaaaatatttttagaatggtgactatgctagtttacactgctttaatttaggctgaaaagtagaggatctagatatgtctactactcagaaaagaaagggagaaagcacacagcacaaataaggcatcagtatttacttcaaagatcaacattaggtggaattaataagtaatttatttgttaataatggcgtaattagtgtacccatcaaatttcaattaccaaatagcaggcaacagtctcctctccctcctttccggagcttctgatatcgttaatacgctaattttcagcaattcagaaattatagactgtcctgcaaatataactctagcctcagatactgcctgagaaagcaggatctaaaagagaaaacatgaaattcttagctggaaaagacccatcagcgatcagacccggcaaggtgtttattctacccttagcttgtttttgtttggggatagttctgaaataggaagttattgttttcaaagctcggttctgtggaggtgttgcttctatccattcccatccttgggccaccttctctctcacaatcgcacctagtaaatgcgggcatatttagctctcacatcgacaacccccgtcaaattagatgctattacgaaggttccaatttttcttaggaaaacacgaaacagattgtctctgaaagaaggaaaaaatgaaaagtgtccatccagttataatggaatggcctcgatttacatccttgggtcgatttctcttagctgcccgcccaccctttgcagcttctgccaagcttctcaaagcaagggctctcaggctgacacgcaaggagcagggtgtggggaagggggatctgcggttgagaaaatgtgtctggtggcctctcagtggcgtacataaaaaccaggatgcccctcggtcccaacgcccttcctttcgcctgttagcctagaacccctgaaggacacgaagcctgactgggttgcgcccgaggtcagcgctgagtcgcggccgccagacagcccgaggcctaggccagcagtagggcaggcagagggctcccgagaggacctacagcctgacagggcctgaattcccagcgggaaccaaagttggggggctggggtccaaagctcctgctccctcccccagcccaggggccggacagcagcatccatcacgcacccgcgcgtttcctgatccgggtccgcgcgcgcggtgcgcccattggtgggagcgctgcacgtggggcacggggcggggcgcgcgctgggctggggaggagcggctcgaactttggtggcggcgtctgcgggagggggaggagtgggcacttgacagcggggggaggggaagggcgcagaggaaagggggatgggaagcgaggcaggagggggaggggcctcggcaagcccagaaaaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccggtacgtggcgccgcttgggaggcgcgggaggtgggccggggctgggcctgggttcgagggtcggggtcaggagggagaggctcaggggaagggggcctcgggaggggagcccccatctgacccgggctgcggtgagatgtgggtatgtgcgcgccagccagccgcctgatcccaacatgagaacccttttgtacccagggtccctttatcaggagatttacgagacgccaaactgttagggcagtaattatagcccccataaatttaattgccctggcagaggcttcaggccatgtgtctttgaagcttttcttcagccccaatgcccagcaccattctttatggctctcgggtgtttcccgttgtcaatagcctgtgaaacattttctttgccgttttatgtatcttgcgtgaacttggtgtcaggttattatataatgatgatgtccaattgctcttccccaccccaccttctctctcctcctcctttccctctcttccgctccctcctccttggccttctatttcggggttctgggttttcagttaaccccagttataacggaggggagcctaagcgctctcgaaccgcctacacccggcagcaggtcttggagctggagaaggagttccacttcaatcgctacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtaaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgactggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccatttaaaaaacattaaaaatctaagattcatgtgttttctaagcttttcattaagaaaacaaaagtcctctggattgagatacttgaccttgcatgtaaaaaccttgtagatagcttgagctggattcacttggattctgacggctcacataatttgtgtgtgagagtgtgtgtatgtatgttcaacttgagctgaactcttgtcaagcttggcctactgtggaaaagttccaaagagtaggaaggctcttgagctctgagagggctcctcttcttcccaaacttggccaggctttcaggcttcaagtctctgtaaggcatagaaacgtgtccttccctgcaatgaaagttgaaaccatgcagtgctgtgggcccaggagtttctgcagctgttctacacactgaactctgagcacacttggaaagaagtggtctctttggtatttggtatttgttgcaccttcacacttaatctgcctgtttcccaggagataaaaaatagtttgtgcaaagggttgagattagtttttgtttcctggctgttcttaaggtcctcttcactaactacagactgggaatttttgtttgtttgcttgtttgtttctcttttttgaagaaagagctttcaaataaactgaattttacaagtacactctccaatgtctcttctgaggaaaaagcataatatacccctaaagttcaccccatgcaaagtagacctgggagagtttactgctggaaaatagccaaactgggtcactttcctcaaatgctttgtgatttttctgctcgattccagagatctagattcaaaaggctgaaaatcaaaacccacttctcgatctctacaaccctagtatttgtttactgatttagatttgatgcttactgcagggagttccctacaataagaccacaaaaacctgtgcacactagccccagaatattagaactgtcacctggccttgaaaaagtgcaacttttaagtaatgtagtaattttagcatagatgggagtaagtgctcacctgcctctgcaatatcagagaatttttaaacacatttctctcattagtggcaaaaccctttagccagtgtcagagctggtacccctttcacccctgctgccctgtgtgtgatacaaacaagggtgatccgttctatacctacaaatcagatttgagaggaaagtgatagataccagtctctgaagagccaagaaaattcgggagcaatcaaatacacacttaccttcccaaatcaggataaacctggcataaagtgcattttataaggtgtgaacgggtgccagggatttctggaggcaatgcaactgctgctgaaacttattaaccctccccctactacacacacttgtaaaacaaaattaaatcacgctgaaaataacaattttcccaggaatcattaatcacctcaaacaataaatacttctttgtaattcaacagcaattctgaaaggcattctctgggaaaagtctgtggaggagagagggatcttcttgcaaataatgtggtctcaggcaaggacacagcatcttggctgtctgctaaaaaaaaaaaaatgcctagactctcagtggaaattgagtgtcaagctgcaaaatctcaaatggcagactatcatcatttaaggtaaattcttatatttctcctttgtgggaaaagaggggtatgggaatattcattagcttcatgctgcaggcagttgtatgaggatgaaaggggtgactttctttcacttgcacttataagtccatccagaaagggaagagagaggattgagatcatttttctgatattccaggacaagatggcatttttgtcccaactgtattgattattaaggtattggtgagttttacaaaacccagattatagaaaatgatccaaatgattgccatttcttaagtgttgttttgcctgcttcaaattggcctttaagggagcttgttataagagattagaaaatcccactttgtgcttc

SEQ ID NO: 12049 - DNA, 5481 bp, Human
tgacagagtaagaccctatctcaaaaaacaaaaacaaaacaaaaccctccccctcaaaaaaacagagttgggctaggcccacaattattagagaagagaaaggcagtgtgatgctggtggtatagagcagaaagcaggagaggcagctacggtaaggccaagcaaaacaagagggaatgggagacaaagatggaggggcaagacacagactgcaggggacaactttggggtcccttgcagaggaaggagtattcgccctgccctttttggggtgtggaaacctgagaagttttgagggtcctccttaaacctgtcccacctgcttccctttcctctcctgagctccgttgtttacagagatcactccctgaactcttgccctcctggacttgccctagcttcggccccaggcctccggccaggcagacaccctgacaggttacaaatgagcgtgggtgttggattgccccaagctcttgccctcaagttgtccggaggaggagagtcaatgggctctacctaagggcttctcttctagtcccatctgggtttggagtctgagagagtgaagaagacacatcctgtgtccctccgcaacagccacacagaacaaaaaggggcgagactccactcctcactctggagtcttagaattcagagcctcagggcctccaccccgattctcccactctctgaccaaactccctttatcaatcctagaaaaattactgaaatctggaggaatctttaagatttaactggtattaaatttatgcatttgaggtttggaaattttttttttttggaaggagatggagggtggtgaaggagagacaggtaggagggaaccaggagaatgcaggtctccactagttttaaacacttcaagaagagaataaaaaattcccctcctcttcaccccgctgtaaacatcacctggctgtgctcattgtggctctctagagagatatagggagttatttaagtctgagtgagtgagccagctacagctatggatggctagagagaggataaatacatctagagagatgagaggtagggaacgaatataaatatggagaaagatggacgaacagagagatggattgagacagagagaatataaagagaggctgagggagagaaatggatgtgtgaatgaggagagagcatttatgcaaagagagagagagggaagatggggcatttctcatccttttctccacatttctgtagtcctgccttgctccctgaaatgccaatttcccacccctggcttcatgaattcttcctctagattctagatcctgccccacacccttaggtgtttttgcaccaccttcccccacctccccaccacacagtcatccatttggcccaagataacatacctcacccggctgtcctagcccaccaccctaagacaaattggaagaaaggaacatggtttgggagttctgggcaaagtatggaagctggattccccacctccaggtccacagacttagggggaaggtttctctgaggggtgggaagagtgaggggcagctggcttgaatttgtccaaatctaataacccaggagcctattgaaggccttgggggttgggagggaaggaaagtcttgaatattctcctaactttttccccctctccctctggtcccttctttccaaaagtctttgaagaaagatgtttttgacgcttccatgtcgctctcagatggatgggctgcgggtgattgaagtgtctttgtcatgctaatgcttggggggtgatggatgggcgctggggctgccaaactctggcccgcttagcccattggcctgggagagatcacatgtgccccctcacccccactccctacccccttcctagggaagcgcttgcccaggcgagcgggtcaggccatggattcgagccccagcgctgtgacatactgccgaaaggttgtagggcaagagggtgtctcccccaaacgggccgaccctcctgcggccttgacgcatggactataataggatgaactccttcttagagtacccactctgtaaccggggacccagcgcctacagcgcccacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctctgcgccctcggggtatgctcctgccgcctgcagccccagctacgggccttctcagtactaccctctgggtcattcagaaggagacggaggctattttcatccctcgagctacggggcccagctagggggcttgtccgatggctacggagcaggtggagccggtccggggccatatcctccgcagcatcccccttatgggaacgagcagaccgcaagctttgcaccggcctatgctgatctcctctccgaggacaaggaaacaccctgcccttcagaacctaacacccccacggcccggaccttcgactggatgaaggttaagagaaacccacccaagacaggtagggctcagatgtggccaccccttctccggggcccaaagcatctctgcttcccctgcagtgacatgtcctgggtctgggctgggttcttctctttcagcggctctggtagacacaggtaagagcacaacctacgtctcaggtcaggtgaggtctccccacccagtatgtaaccggtcaccccaggagtaagtttccatacacaccccacttcctgatctgtgcacccagcacagacccaggacctggtgtgcatgggggatggaagtatggggaaggctgctccagacttggtgatcaccatgggggtacctggtggtccctgggaactttgacaactgtacttgggcagaatggcaaatggaggtccagagccagccccgggaggagggaagcggaaggagaaagaggtgagagaattgacctggcctttctccctgccccgcccctagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagagggaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtccagccctatcccaggctctccccaaccccaggcctgggcttcactggcctggggatcctctctagggctgaaatgccagtttagagctgcctgggggtgggaggggggatggggaaacatttttctcagacctgggtggctgggggccctacaggaccagaggcctgggaggcatggaacctgtcaaatgtagagggaagggcttctgcctttgatctggggatcagctcagtgtcaacatgtggtgggggtgggggccagcctcatcctcctggattcatcctcctttcccttccaacttgggtttattcggttcagtgccttcgagctttgaggagtctcctcacgcactcttatcctaactcccccttctaggcctgacacagaaccttaaattttcttgtgtgggaggtgtttgggtgcagccatattattatcaatgcttaatccagtcaccacagaccttacaatagcaccagctgccttgtgacagaccaaaaagccccccgcccccatctaaccccattagccctctcctggcatatttatattgcactaatgcagccttcagaggttgttttctgagacctgcctcctcacaccagcgacctcatcactatgtcaccaaagtgttttggaacttggtattccagagacttctggaacgccgtgcaaggcctgcccccagcaagccacaaccaggaaggtgcaggcacgcccccactagctcctcccctatttattgcctcctggaaaacccaggaccctcttccccatctccacccctacccctgggggcagcccagggagagccaggcacaatgagggctcccaacagctgcaaggatttatctgaacctttgagaaagaggaggagccatctaagtttctggaaacctgagccccaagtgagcccgggttctctctgtacctgcaactacctcatttcaataaagtctgtgttttcccttcttcctgcctgcttctgtttctccattcaggggtagaagaggcctcatactccgtgcaccgtggagaagaggtgaagaaagagtggccattggctggttgggctggaatgaactgagctttaagatctcagctggataaagagaaggacttactgggtgtggcctaagcaggattgggtcccaggcattcaggcttgacagttgtcagtcccttggttattgggagaatccagaaaagcatggaagaagtctgtggaatgaatgcaattcccagagatttttctttttcttttctttttttctttctttctttctttctttctttcttttcttttttttttttttttttttttttttttttgagacagggtctggctctgtcgctcaggctggagtgcagttttttggtttgtgttttgttttttggttttgtgttttggtttttgtttgtttgtttgtttgagacagggtctcgctctgttgctcaggctggagtacagtggcataatctccgttcactgcaacctctgcctctcaggttcaagcgattctccacctcagtctccagagtagctgggaccacaggcgcacaccaccactcccggctgatttttgtatttttgtagagacagggttttgccatttcgcccaggatggtctccaactcccgggctcaagtgatctgcccgcctccgctttccaaagtgctgggattacaggcgtgagcccccgcgccgggtcagcccagagggtcttgagaggaagacgggaaagaagagaaacatctgtttggagaggacaaaaagagggtgttaaaaagaggaggaagtgtgggggaaggcgacgtgaactctaccccttcccttccccctcacctgcctccctcccgcccagagccaggcctggcttagactccagaggggtcgctgacaaactccaaattggcacacagcttaacacccccactcccaccccagcccagcgcccttccacccagccactcctcggggacgtcaggagtggctgcctgagtccggccgcagccggccagcctccgcaaggcctttccgcctgggctcaaggtgaaa

SEQ ID NO: 12050 - DNA, 6284 bp, Human
ctatgcccacccccatccacacctctaaatggcaaaaattgttttctttggagcctagttgcacactactgtcgctggccactttgcccaggtcagagcagctctctctgttctgagccctccagagcatgcctcctcggtccctgcagcccccacctccaactcccctttctccatcctcctctcccccaccctcatgcttctactcagacttctctgtccttctttttaagtactcacgcagatgttacactgacagaaagtttctagttccagctccgggctcagttgccatttctctgctaaccagccttctcctcctggctgggcagcagagagagaggagggggaggggaggccaaagccatgggagttctccaggcaaactttccacccaacttagcgctttccctctgtccccatttcccatctgtttcccagctctcccagaatcacccttctcttttgcacccccacccccacccccaggcctttttaagggatgtgaaattttggctgttcgctctgctttcccaaagagccaaattctttgatgcaatcggagggagctgtcagggggctaagattgatcgcctcatctcctctccatccgtctgacccacttatttaaaaatcttcccccagatcgacttttcattttctgctttgaggcctagtttcccaccaattgcttggggctcagagtcttgtgccctctccccatagtaaattacaacactctaaacttcagactatcttggtctcctcaaaataaaataaattttaaaaacattttcccccagcagccagaaatggaatatcatctcagtggtcattatttccacccctaccatcttcagggaattcttccttgtcagggattcttttttttttttttttcttttttcttttttaactagcacaatggcaaaaatgggagggaaagtctctttgtcctaggggaaaatctccccaccacactcatgcacacacataacgctgatctgaactttgagagtgctctaagttaaaccaatggctacctcagttcttgttcatgtccctggatatggatacagatacaagcttgaggcttgagtgggtacatgcacatcttagactctgcctgtttttgggggatgtcacagagaagcatggaagcctgaaagtgaggaaagcaggggtacataaggggcagaggcagtgctgcaaacactgggcagagaagagaacccagaccatacagcgatggaggccagaggcccaaaaatgccccttatgctccatctcactcctatgtgtctgcctgggagttcctgtccatttcccaagatttaactgttgtttttggagggtaacagggatagtggtgtgatgattgtaaatctctttcttattttcaccttaatactgacctttttcaaagagtggaagcctctttcgactccctcttcctccaacgcggagatcctcactcatcttttcctggggaaggggagaagggaaggggatgctgctggccacgtaaagaaggccttaatttactctattaaaatacttggaaaagaggaaggtttctcccttagagtctcttcttttccaggcttctgaaaccttctaaccttcgaaggggatgaggaaaaggttcctctagcttttctggagaaacggaggcattggggagagagcatgtgaggcactggtgtaggaatgggggctcatggtgtcctggtcgtggtcctctggtgtttttgaatcaattaaaccaaataatgctctctgttttccaccaggcccagacgagcgattggcggaggccggtcccgtgaccacgaattccctgtaatttcgctggagtcctgggtttaatagagagagtccccatacgcttgtatttatcagcaatatacaattataaaggcccaaaattaaaaaaaagagagaccgaaatctccccctcccaaaatcgctccattacataaatcggggggggtgcaggagggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcaggtcggtaagcgtggtgggggtggggtgaggggcagctagaagagggggagaaaaagcagtggaaggaggtttaaaaaaaatggtggcgagcctgttggggttccttaccccctccattcctgggatggggaagtagaatatcccactggggttcaggcctggccgctaacagcgtctttttttttttctgtctctctctctctttctctccctaaggctgattttggaagctggttggggaaacgcctttttttctgctagaagaaaatgatttgattgaggttttcacccgtatctgtgtaggggaatgagtatgttgttgctgggatagaccctagaagcagaaaagattcggtcctttctgccccaactctaggagaagaggaagaattcagagctagggaggaagaggggtgaagaacaatctttctgaccctcgctccggttgagttggaaagttccgaattgaggggtccactgggagggcttgggagggggatctgaggttccggcgccgaagggagccgctctccgccccctgcgtggcccgtgggcggctctgaatgctttgccctgacccgggccggggctgtagactagagagggagagaagaaaacccaaaagcagtaaagcgagcggctttggggtgggggcgggggtggggtggcgaggaaggggagaggtgatactggttttggaggatggggtagtccgaactgaggttgggctgagtacacggcccgctatgacgccgagcctgttttccctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaacgagtgtttgtgttgggacctaaactctttccccgcggccccaaggccggtcctcacccctccaggacctgtgcgaagttgattaggttcagcggcccatatggcagcaaagcctccagggccggcgaagtccgggtggtacaaaggtgacccgattgatggccgcttcgcccacggctccggcaaaagtcgggagtttgcaggaagctgggtcacctccccgcccctcagcagagggtctttggtcctgagcgggtggttctggggcctctgcttggaaatagagatgggcaggtcgagggagagagtgtacagcgaacagaggagggtgaaaggagaggaagcctgtggacagtcttcagggtcgtggcgggggcagaagtttactggaattgggaacaatccaagggcttcctaggcttttgcttcttatgaccgaagccggtgtaggacctttttccgaactcaagaagcctagggacgcgaggcctggggcttgagccgggcctctttgggagctgtaggtggctctccaaggagtggagtggggtcggggattttctcgggaagcagggtcccgcacccagggatggtaactggcttcccagtgggcaagaaaagaggccagctgagaaatgtggcgctgccgggacacccatggactcgggctgctggggtttgggagaccatccaagcagcagccgggcgagaagcccagggtggcccggcagcgtcgcgaggcgctggacctgcggggagagaaggaggagcgaggagagcgggagggagacagggaagcaaagacgatgctcaaaatggcgctggggccgggcggcgggcggggggggggcgagggaagaagctgtggccgccatgacagccgctgcaggaggcgccggcccagccgggatctgcccccgcccctgcgtcctcccagctggattttccagaggccagggaagaaggggagcctggggggtcccaccttcgttttagttagtttgatttttttatttttaaagtggagcccaacggacgctgaggacgcgagatggaaggagagtccgggtggatgtgggaagggaaggagagcggcgggtctgcgggcctgggtgtgcctcatccagtctgacttttgattcttcgctgtgggatttgaagccaggccagagctttctctgaatgcagacccaccagtcttgaccaacaacttcattttacgtatcaacaccatgtcctgtctatcccccaccacaccctgcctggttccttgtaaacctggtaagcgggaagcaaggatcgatctcccccatctgcctcctggtttgttctgggaaggtggaggtttaaaggtccccggaaagccatccatcctccttaggtttctttaatatttctcccgctcagaaacagacactacggggctatctccccggcagatgctgcccttctcaaaaagcagtttatttcctgggcctccagactttcccctggaccaacaggaccgggatttagagtaccagtcacccagaggcagcaattgtcaggataagccaggagccaacataggttgtgacacagaggactagacaggccctttgcatattttaaaatgggtccctcagtgtgggaagtacacacctcttagttagctggaacttaatcccttaaactgtcttaatatagaattcatctcgtgcattaatcttacatcatgttaaattgcacttatttctctcataaataaatatagaacaattagatgtgttataataatgtcatgtatcttattttccctcataaaatatataggtatgaaataaattcaatatattaaagtagtaatacacagcttattggcttatgtgtttattttccccataaataagggaatatacaatatattaaaactacgctatacatctcattgggctgtgtgtttatttctccataaaata

SEQ ID NO: 12051 - DNA, 6706 bp, Human
cactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctggtgctgaggctcacagccgcttctccccgtgcagacttgggggatggagaggtgctgtgtccctctcattctctagcctttcctcgtgtatacacagcactaagggagccactgaggcccctaaagctctctggcggagacggagccatagtctgggggcctctgcagcgcttttctgtcctcaccttcgcagcgacccctggtctttggcccgtccacatggccaggttttttcgccagccttggccctccgctcctggcctgtggctctggagactgaaaaatggggccactgggtatctctcaccctgcagctgaaggctccaggtgccccttcccacctcaagtagcagatcagcctcaagtaggagatcagcctcaagtaggggaatgtaaagccaccagccaggcacaggccgaaggccacaactttcccttgctccttggagaccccagggcaggaggccaggtgatggggcttttagtgtcatcctctcaacccagaatggctcattctctctctgcttgcaccggcacccagaaggcaagctgcggtcactgttttcctttattcctccgccctctcgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaaattctcaaactgcctagctgcgagtgaggggcctgtagtggggcctccgaatgcaatagccgaggaggaggggaagggatcccgctttacaaactctcagacacatgttactactcaaactaagcagcagacgcggtggccgctgcagtcttttcggcaactaggccgcttagccccagctgtgctcggtttctggggtccctgtcctgctctgtcactccccacgcctgggctaaggaccaccaaggaggtccggaaggggatttcgaacttccaagtggcccaggagaagtgaacgcttctccttctttttcaagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctatctttgatcttctcatccaaagttaaaataataacgacaatgatgatgtagggagaaagaaccaaatagagaggctaaccccacccacaagaaagtgggtaaaaagcccaacccctgctctaaaaggctcaaccctgtggctgagccttggccgggtttctttctctcccggcgactgcagggagcctgcagggagccagcagggaggcagccgcccgccgccatggcggtctcacgcccgcgctcccgtcggtcgccgggaggtggcgcgctctgctcagaggccaaagccaaccttctctctgtttctcccccttctccttttttccccctctctcggaggctcgcattgaatcggccctaacgattctcggatcgtcattatttgtaaccatagagcatgaattacctcttgaggtcatcagcgagaatttacgactggtcaacaaaagcacgtgattccctaacgcccccccaccccccttccaacccccccccccatatttggccgcatacatagcaaaacgaagtacagtgcatcgctataattcattaatacatcataaatcgtgaagcacagggttataacgaccacgatccacaaatcaagccctccaaaatcacccaaatgagctcgtactttgtaaactccttctcggggcgttatccaaatggcccggactatcagttgctaaattatggcagtggcagctctctgagcggctcttacagggatcccgctgccatgcacaccggctcttacggctacaattacaatgggatggacctcagcgtcaaccgctcctcggcctcctccagccactttggggcggtgggcgagagctcgcgcgccttccccgcgcccgcccaggagccccgcttcaggcaagcggcttcgagctgctccctgtcctcgcccgagtccctgccctgcaccaacggcgacagccacggcgccaagccctctgcttcgtccccctccgaccaggcgacctcagccagctccagcgccaatttcaccgaaatagacgaggccagcgcgtcctcggagcctgaggaagcggcaagccagctaagcagccccagcctagctcgggcgcagccagagcccatggccacctccacagccgcgcccgaggggcagactccgcagatattcccctggatgaggaagcttcacatcagccatggtaattctctctctcttttttgtcttctcggctttccttctctgcgttttggggtgggatgggggggacaaggagagcttggctttaccctaaatatagattcatttttctaagggggagaagtatctaagaggggcctcatagcttcgtagacagagccaaaaagggtctctctgttaagaggggggtatttttaataatttgtttccagcttcggcttaggtttttattagcgcagctgaaccagctttaggataaaggatggggttcatataatgtggggaagggtcctgcttacccctgaaattttgagactgtcgctagcaaagaaggggtgaacagtaaaaggagctttccggggcaaaagtgcaaccgctctcctccctcccggggcgagcggccgcctgagcccagccaagggtgaggcactaggagcgagcaagagacaaagccgggcgcactggctgcctgcagaagtgggggatgcagtagaaaggggtgcagaaatcgagcttgaatgtgggcatctggagtagagaggattggagctgtggtgagctgggtgccgggacgcctgggtcctgctcccccgccccctcccacccagtgccccctcccttaaccggaataatgttgccttgcggctttcctctatctgctccagatatgaccgggccggacgggaaaagggcccggaccgcgtatacccgctaccagaccctggagctggaaaaggagttccacttcaaccgctacctgacccggcgacggcgcatcgagatcgcccacgcactctgcctgtccgagcgccagatcaagatctggttccagaaccggcgcatgaagtggaagaaggacaacaaattgaaaagtatgagcctggctacagctggcagcgccttccagccctgagcccgcccagaggagcccagcggcccaagagcccgtgccacccccagccctggcccctccaatcctccccgctctgccgccgcccgctggggaccggttcccacaagcctgcctcgccttgtgttacgatatttcgtttgatcttaggtcttcctgtggctccctctctcctggactggttatcttgttattattgttaataataataattattattattttccttccatgctcccaactcccttctgcttgtcccaaatccgccagtgtttctgaatgtttgtgtctgtggttgcagtctttcccccaggaaaaaaaaaaaaagaaattcgcatgtttaatgtgaactctcccctccccatctgtgttctaacttatttataaaaagatgatcgctgtattttgagtttcagctggaaacttctgtaaggggcagcagttgaggtggggtagtgccgcagtggggtcaagctgagctggcttcggagatggagtcccttttcattctcctcctcctccctcctcactccctaggcccaagtctcctaggggcttggtcctagggtgggaaggggctagggaggaccaaagggatggtattgagaagagagaaagaagatagtgagatttaagttcctgctgcctgggtaggccccacaaggcctggtctgggagtatacggaaacaaaaatgatcctcagtgcaaaatgtcttgtgtatttctctgtgaatccatgggtctggctagagggcccaaagcttgtaaatatggggatagtctgggtcagacccatctctcccttacccatcttgcttccaagaccatttgtagtgagcgagtggatgctgtgctacgtgtgaaatctgtctttgcggggcctgtctcagtgattcgcttttggtatttgtttgtagctttcctggaagtcaaataaatgtttcccccactccattgcccttccacttgtcttttctccgaggggtctgcctctcccatcccgggcacaccctgcaccattctcaatagatctggggtgcagggaagaaaaagtaggctgctccccaacaactcttctcagccatgtaagtcactggcttggtcaacagtgcttgggccagggaacagaccttcatgcctgggggactccaaggcccagaaaccccatgtggggctggggcagaggaaaggctgagctagacttcatcctggtcttccactagctggccaaggaagcctctggaaaactcttctgggaaagtaatttgggcctaagtcctcagcaggaggctcctggccttttgggagtggtagaggcctgcccagccccctgtctcctactccaagtcccaattcagctctgccaccaactaaagcaaaaaaaaaaaaaaaaaaaaattcagctggatttcaaaggatttctctcaccctcagccttccctacccttatcaagggctccttctctccaagggcccaactgatcttccctcttgattaggagttagggtcctttcagaaagacccctggttccctttcagcctggcccagggctagggcccagtctacctccatccaagtcagcctccaccctgagcacaagagtcaagtctggacacttacccggtcaatcccttccagcttggcccaacttcttactggacttggagggagggggagctggtgaggaggaagccgagggtcgtggaggctctacttggccctcctttcccttcaccccttgactttgtctccctttgtcgatagcaaactatcccaaaagtcgctatgacatttagatgtcaaatggataggggttttatctcgaagttagatcgtaaaaatcgccgagaagtcagacagatacccctcactggctcgagaaagtcacgtgaggtccataaagttagttttatggttttggggagttgacaccgcgcagtatatttcacattctccagaatgttaagtgacactttaactgctcgctgtggtggggaagggggcagaggtaggtgagcactctcccagcctggagcagccggaccagcccagaaggcagcggcggcccaggccagcattcccgcagtaagtcgctttcagctttcgcttttaccccttgcaattctggggcctgggactgggggaagaaaacttgtttccacctggggctgtggggtgatgtaggggaaatttagcctgttttatgcacccagttctaagggactgggtgcctgaaatgagtgctctcagtttcttaaggcctcatcggtcgggggtgcctgatttttaccaacaggagtgtctgactttgtggggaaaagggtttgtgtgggggatccatgctccctcagtgccagcggaaatttagggaccaggaaggaggggtgtatattgctgaaagaaggggccattggtgggggccacttcactgctggatatcttcagacaactatccccccatcctccggaaagaaactttatgacattcatttgtcggaggtgtgtgggggtgcaccgctgggcacttttatctggatacatctgagctgagaaaaagcaccgggtaggcggctgctgtgggctaccttgccctggggtgatctctggctttccgatctttgaagcccataaaaagaggtccctccggttatctttggcttcatcaggcttctctgggatggggagcacagcgctgcttttgcctccaccttcagcctgttggtctcaagctaatctttctccttggctcgaagtaggatcctgaagtcagactagggagcagacagagagggcaattcccccaattcaaaacctaattcctgaaccaggagtgggggaagggaagagcttcttctcttgcctagaggtgttaggtgtttaagtagaactctggcaagccctcctcaaataaaatcagctcaagaatacaaatccctcaactgtcgggagga

SEQ ID NO: 12052 - DNA, 34230 bp, Human
tcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggcggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagttgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcccggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatatacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttcttttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtctccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccgcctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggaggctgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctgagttttgcgtctgcccgcgggagcccccattcctcaggccgtggcccctgcactctccaggcaaggcgggtgtgctgcgtgccaccgctgttggtaaatccggcccctcttacgtccctccagctgtccccgcgtttataaatcttgcacagcctgttcttcaatatctgcctaatgccaagaaatactcgtggaaataaacgatgactgttcttggcagatctgacggtcaggcttctgcctccccccagcccttccctctccttctccttccacggtttcaggtcgtaggaaagccacattccaagagaggacgggcatagccaagggtgcagtcaggctggacccagaggtggcaggcctggttctccatccagccttcgccgctgccgtcagtgcttctggtcccagcagcagaaggcccagctgaagaagtgggggttggttggtctcgcctgccaagggatccaaaggcagcatcgctggggatccccaggcatcagcttgtctttttttttttctttttttaagagagagtgtctctctatgttgcccaggctggcctcaacctcctgggctccagcaatcctttcgcatcagcctcctgagtagctgggacctcgggtgaacagcactgcgcctcctaatcacagtcagcttttcacctcaggcttgtcttcctggggtgcctacaactgctgttgtggttctgggcagtacagctgacatgggagcatcaagaggcagggagagaagcctctgtcctcccactgagggacaggaaaaccctccagaatctgcccaccaccccgtccccaccagccccacatctcatggctgaaaccatggcctgtgttcacaagatgaccatgtcatggccacggctggcttacgctggtcaagatggcccttggccaaggtggcatctgcctcccccagagggcatagggttgggaaggggtgagtggaatggaggttctattaccaggacgggcactacggcgtctgcccacctgcctgctgctgtcggctcctctgtgcctcagtgtcttcactgtaggggatggggggagctgggtggctcaaggtcacatatgcaaagcgcatggcttggaacctgcctcccagcaggccttcagcaacagcagctaatttgttgattttagtcattttaatattttttaagactccatgtctcttttaatagaaatggtgagtctgtttgccaagtgccttctgagtcaatggcactgctagagctatttcatagtaaaactctccatgcacccagagccaccaagccttgatgggggaaccaggtggggtgcgagatggaggccaggtgccctgggcagatctagcttgctacaaagaggcaagacggtgcctttggcaacactgcctcacctggaagaacagccagtgaacggcttgaattttataaacatt

SEQ ID NO: 12053 - DNA, 87352 bp, Human
taccttccaactgtgggacatgatgaggtttctcttcaaatagcctgatcaatcctttattctttaattcacagtgcccccctcttccctttttctcctctttcctttctgcctttgttacatgcctagacaggccacagtaccaggcgttatcagtaccagctcgtattccttatccgaagagaagactagctctctagctcattacagacagcccttccccctttcccctctctcttacgtgcccaccttatctaaagaaagttaaaatgtttagccaactgtggttattttagattgtgaggcccaactccggccaatggagaaagggtacaggggcagggtttgtgtcagggataaaggttctcgtgcccctttgttctggtgtgctctcatggtgactggccaaggagaagcacccctctgcgcagaagtaaaattgctttgctgaaaatcctttgtttgaatgttcaatttccttaggattttgagcattatttccaacacaacagtactattaatataaatgtttctcaatcaaatttttaaataattagacttggcctacctcacctttgtccaggagccctctgtctggctctatctgggctctctggataggtgacaaaaatgaactgaacaaggtggcaacgtgaggaatgtgaaaacttcaaacacattccaaatactttcagttaattaacaagatttgcagctattaaattatgtacgttatgtgagtatagtcagaacactgagttacccatgatggaggacatgaaaccactttaatccttcacacagggccaagacggtaagtaaagttaaatatatgctgaacagactatcaaaatgttcctaaacttaataagaaactgcattctacctattctaggccagataaattttttatatccctctaacggatacaataggcagctacggaactactcccaatttggcaagatccagaatttcctttagaggctctggggccaaagcccgaggcctactgccctttgcaaggctccagattttaaccagcagatcagtaaggtaccaagccgactcatagcaatgataataagtatgcaggccgggtgcagtggctcatgcctgtaatcccaacagttaaggaggctaaggcaagcagatcgcttgagcccacgagtttgacagcagcctaggcaacatagcaagaccccgttgctacagaaaatacaaaaattagccgggcgtggtggcgctagcctgtagtcccagctacttggccagggatgaggtgcgaggatcatctgatccggggaggttgaggctgcagtgagccatgaccgtgccactgcactccagcctgggcgacagaatgagaccgcttctcaaaaaaagaaaaaaaaatcgtttgtgcaatgttttcattaccggaaacattttaagtaaaatacaataaaacttttaaatctggttgtcagacccttccttcccttttgttattatcgtttcacgtagccatttatgataggagaagcggctttggggtcggcggctcagggcccaaaagtataattattaaagccacctctccggaagttgctgtttgtcgttatcaatttaggtacgaagtgtccagtcagataaatactgacaaaagcaaacaagatgaagaacatgagccccgacctcggcgccccttcccagtgggccgtcacctacccggaggtgcccacaacccgagtgagacctcggtctacactactgcaacggatacaagcagcacgcacagcgccgccctcagcgctggttcgttttccacgtggaggcgcaaaaccagcaagcaccactgtcgcaccatccgagccagtgggcgcaatcatgtccggcgcgaccaatcggcgcctggcttgttggcaggtgtcaggcagcgcgcactgattggccggtgcggagcctgtctccttcactggatcccgcattttcagcgcgttgcatcacctccgtgcgcccggttgcagcgtggacgccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgaggtagtgtttgaaatgagtaaaatctttttaaaatgatatacatagtataaattgatatagctgtgactttatgtataggcaatacgtatttttatatgtcttaatttattaccttcaatggctgcgagatacttattttattgatgtaccgtaatttacttcagtcaccatgaatatttagattgttttcagttatttgcctggagaaacaattattcggtgaatgtcattgtatacacattttgtacatttgcatgagtatacctgtggagtctatgttaataggatataactaaattgaggaaacgtttgagacggtcccactttcaggttacatttgacttaatagattatgaagacctgagaataaaaggagaaacagaaatggatttagaggagaatgaaaagggggaacagaaataggcttataggtaggatccacatgacttgatgattaattggttgtgtgtatcttctgagtagtgtcaggggtgactcaaaaatgtcatgcctaagtaatgggaagaatattggaaccactaatacagtagtttaaaagggaagcaattctggaaggaattatgaaattttaaacaaaacatggttttagtgtgcgtttctaaaatatattgaggcaaaataatatgaagtaatgtgaataatatgtagttaatatcagggagggtggtctcgaaattgctgaacgggaagttgaggttaaggtgacctgaaggagttgtggagcagcgaagagtcaagggcctggattataataagagggaagcaaaggggatggcatccctctgcacaacaaggttgttgtgcaaggttaacctgctctgtccctgccctgtggttgctggatgctgttgtgcatggacagctctccagtggattcgatgggccatagcaatcctgtgatttatgcatggaggctgcttctcctcagcagctgccatagcccggtcgctggtacatgattcttcctgaatagtcaatgctgttatactgagtgtttatgcttgacgtaataatgcagtgattcttaatctttggggaaagtagagactccctaaaaaacacagtaaaagctgaatgagctggccaggcatagtggctcatgcctgtaatcccagccctttgggagcccagggcaagaggatcgctttagcctaggagttgaagaccagccagggcaacatggcaaaaccctgtctctacaaaccaccccctccccaccaaaaaaaaaaaaaaaaaaagctgagtgtggtggtgcacacctgtagtcctagctacttggcgggctaaactgggaggaacacctgaacccagggaggtcaaggctgcagtgagccatgattgtgccactgcactccagcctaggtgacagagtgagccactgtctcaaaaaaaaaaaaaaaaaaggaatgatcctcttctcagaaagcttaaatcttattttctcaaaaataaaaattcagatagatattcctgaataattgttagaacagtgcaagagtggtgatgttcagactttgatgtgaatgctcatcccctagggatcttgttaaaatgcaggttctgactcgtaggtgcgaggtgaggctggtaagtctgcatctctaataagctcccatagatgtgggccatagtaggaccagccttgaagagattagaatgtgttggtatctaaaggtctgttagtcttcagataacaatcccataagtttcagttggcctctgataaggtacacaatgaacctaaataaatcagtaaatgcacaaacacttattttggtccttgaaaggctagaggttataataagagttgaagatctaaaatgccttaaaccttctgtttaataccttttaatggcatactgtgatcagaaatagctatttcagttagttaaacagcccaactgttcttgtcctgttttttcttaaattaaactcagaggcactcacacatctgaaaaattaatgagggtaaaagaaaatgaaagatactacttgtcacagacttttttttaaatgataacttgaatcaataacttgattagactatgatgcttttgatgctttcaaaactgtttgaggtatgtaggtgtcttttcctgtagagttgattaccctggtctgttgtggttcttgagtacttaagattttttatcttctctgttgttcccttattagcaattttatccccttctgatctgatactgacttggaaagctcgtcacccaccttgttagaattgttaagtaaatataaatagactttgagaaggaaaggtctcaagggtggctcactagatacttaagtcatagattgatcaagtatctctgcatgaggttattagcaaaacatttaaaaagacactttaagacttctctcattagggactaaaccagaaaggtatagggctcatccttcataaaaatcatgaataagcaataaaaagggtaaaatggaaaactggaatctatatttgaatgtgagattctcatctttttagctttaagattttttaagttttaccagttttcctcaaagagaagatgaagttacttcaagagaactgatttctgtcatgtgagtgtaggtaagaaaattcttaactactttgagatatttttcttcagattattaatgagttttttgcaccactagatagaatttccaagattttcctgcttacttttggaaacattgtctctaccattactgaatattaaataatagccatgtacccctccctcacaccatatacgaaaataaaattatttgtggcctaaatgtaagcgaaaaatctataaccttgtttaggtaatggtttattgatgacaccaaaagctcaagcagcaaaaccaaaaattgacaaattgggcatcattaaaatgaaaaatctttgtgcttcaaaaaatgccatcaagaaaataaaaagacggcccacagaacaggagaaattttttataaatcatatatctgataaaggatttgtatccaggatgtatacataacccttaaaacccaaccacaaaaagagcccaattagaaaataggcaaaggataaatatctatccaacgtggatacgcaaatggccaataagcatgtggaaagatgctcagcatcattagtccttagggaaatgcaaatcaaaaccacaagatactacttaacatctcctagaatgactgtaattcaaagatggacaataagatgtgttgggtaagatctgaagaaattagaatcctcattcactgctgagggaatgtaaaatagtacagtcactttggaaaaattttggcattttctcaaaaagttaaatacagaattatcatgtgacccagaaattctacttctagctacaaacccaagagaaatgaaaacatagatccacacaaaattttgtatgtgaatgttcatagcagcgttattcgtaataaccaaaaagtggaaacaatacaggtatccaagaaatgatgaatggataaacaaaatgtggcatattcatgaaatggaatactattcagctatcaaaagtaatgaagtatgaatacatattacatcatggatgagccttgaaaacatgctagagaaaggaaaccagatgcaataggccacatatagatgattcctataaattttcccatttatatgaaatgtccagaataggtaaatctgcagggacagaaagaagataaatcgttgccactggctatggagaagaaagaatggggagtgactgctaatggttttggggtgttttggtggggaggggaggttgaaaacgttttgaaattaggtattactagttatactaccttgtaaatatactaaaaagccactgaattgtacactttttacattacactatgtaaattgtacatcaataaagctgtaattttttaaaagtatggatagtgtcatgtacacccatgttaataatatggtactctgttattcctagatttctcttttgacagtaataaatttgatttcttttgcagcaacaaaatgcttcaacaagttccagaaaacataaattttcctgctgaagaagagaaaatcttggagttttggactgaatttaattgttttcaggaatgcttaaagcaatcaaaacataaaccaaagtatgtgaattttttaggttaagttcccttaagaatagtcatttcttagactgaattccattaaagcagatactttttttttttttttttttttgagatggagtctcgcactgtcatccaggctggagggcagtggtgcaatctctgctcactgctacctctgcctcccggatgcaagtgattctcctgcctcagcctcccgagtagctgggattacaggtgcccgccatcacaccagctaattcttgtgttttagtagagacggggtttcaccatgttgcccaggctggtctcggactcctgacctcaagtgatccacccacctcggcctctcaaagtgctgggattacaagtgtgagccatcacgcgcggcctaaagcagatactctttattaatctttctattcccagaatcccccagctccctatgtagtgggtactcagtagtagatatacattgaatgaatgagttctcaattattggggtaaattttgtttctttaaaaggtcatctgagtaaaatttatgtgtcatcctccgtgtcaccctctttccacctttattttcatcaccaccctcgtttaggcacttatacctaagtaccccatagaaggctactatagtactacctgcctttagtcctcattcacctaaaagactagtcctttaatcagtgttttcattatatgtctcctctggtcaaaaactatgagataggggtttattgccctattttactgatgagataactcaagatcaggataaataatttgccttatgtcatggaactaataaatgaaaaatggataatcaaatggaggtctctgtagctctaccacaattgtagcctttctgaaggcaggaccaccagtaaatatcaaatcaattatgtctgtcggtttcctgatcttgctgcttttctccttgaagactccactatgacaagagctatctatagaaaaatgccttaaattttggctgtttttaaatggcttgatatatttttattacctgttagatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggtatgtttgagtatccagctttataattttctgattttttttataagcattagattttgtcatataatatgttcaagtatgatgaacgttgactgtcagaccttctagttcatttctataatatttgtagtttgatttgttttgttttctagagttgcatagttgcagttgttttcatagggcagcgtggtaacagtcttatcacaaattttcaggaatatgaaattgataagacactgggaatcagaggaccagaggatgtggccaaaatggggattacagagtataacaatcagtgccgagcaattgtgatgagatattctgctgagtggaaggtatgttgggtttttttcagtagaatgaacagcaaatgtagttactaaatgggcattgaaatggtttatggtcccttgtgctttttttattaatttattttttgtagaaaaagtgttagcttccaccttcaaccctattacttaaacggttagcttaaactgaaccatctctcttctgacttctgtgtgcttaattggtctaactttcttgcatgatcaccaatagggaaaaattctaataagtataacatgatatataggccttttctttttttctcaaatacttttttcaatttttttaacttttcattttgaaataatttgacttattaaacaattgaaaaagtagtatgatgggttcccctatatccttcatccatctttcccagctgctaacatcttcggtaaccataatattaatagaattttcaaaagcagttgccccattaatttttatttctgaccaatcacatattgcatttggttgtcatgtctttttagtcttcttaagtatggaacatttatttagtcctttgtatttcatggccttctcacttttgaagattgcagaacagctattttctataatgtctctcaatgtgtgaggtttcctgatttaatttaggttatgcatttttggtgacaatgccacagaagtgatgctatgcccttctcaatgcattatatcaggtggcatgtgttgcggctatgtcacattgatggtgataactttgttcacttggttaaagtgctgtcagctttctgctttgtaaagttgtagtttttcctttgtaattaataagtatcttgtggggagattctttccaaatattcttttttttgtcatacattcacttattaattttaacatccatggatggtttttgccagtaataattatgcctgtgatatttgccaagtggtggttttggtagacttttataagtgaatatttatacttgtaaataacattttgtgcatgtaggatgaatgccgagaaaactggttcttaaccttacataatatgttgttggcagtatagatttacttgtaccattgattattctgttttcccaaaattttcatttgtgatgacaacagaaataaacacacattgatgtacaattataaatatcattgtctaatactgttctaatattaatattttaaagtctactgttagcagacttggccgatggattgactttgacaatgactataaaactctgtatccacaattcatggaatcagtctggtaggtttatttaaaattgtaaatatggtaaatattctattctgttgtattgataattggaaaaatgcactagcatgaatcagtttatttttgagtccatcgttatttctctgaaaatctttgggaacaggtttgtttttgaatgtagaacttttatttttatttttttgagactgagtctcgctcagttgcccaggctggagggcagtggcacagtcttggcccactgcaacctccgcctctcaggttcaagcgattctcttgcttcagcctcccaagtagctgggattacaggcgcccgccaccatgcttggctaatttttgtctttttagtagagatggggtttcaccttgttggccagggtggtctcgaacttctgacctaggtgatccatccaccttgatctctcaaagtgctacgattacagacgtgagccactgcgcccagcctgccagttgcttttcttaacattatgtgttaaatatcattcgatatcagtagatattagcattttaatgtctgcctgatgtcttactatattgatctgttataatttaccagccagtctcccaatgaaagacattgttttttcacttatttggcagacagaaactctaaaaagaaaatggcataaatgtttgcattttcagaaatagaattttgttctgtaattgtgaaactccatctcttaccaggtgggtcttcaaacaactctatgataaaggccttgtttatagaggtgtgaaagtcatgcccttctctacggcatgtaacactccactttccaacttcgagtcacaccagaattataaggtacgtgaaatgtagagacattattcagcattgagttttgtaggtggaagctgagtagttatgatcacagtaggtattcccaagtagacccagtgtggaatgttgcccacgacatccaccactttgaccacttcttactgagtgctggaaatattgccagttagtatactaaggctctgttaagatgagggattttttttccacattggatttatgatgtgtcttaatgtgataggttttgcttgttttgaccatatttttgtgcctctctgttgggttaacaagtccagctttgacatacttcctgtagtcatcgtttcttaagggttgagtaattttatgccttatctgggacctcatgatatcatttatttgttaacggtatttggaaaaaaattaatttgagatgccaaatggtattatttttcctctgatgagatagaatcagttgttgttgttgctatgattgaggtgtttagacatgtttgatgtttacagagtgtattgttataccatatctagacagatattatatactagtaagtcttctgaaatgtgaaccatctcttctcgtgtgtatactgagttgttttcagttttgagagtttatctgaccctctgtttttaaaggatgttgacttgtttggaattcttgtttcatggcctaggtttgaaaattacattagtaaaatttgcctttcaaagcacgttttatttatagaatgctttcacatatcctgtttgattgatctttgtaaatccttgtaaggcaggtatgatgatttctattatctccttaccacctctctgtgctcatgtttgtatttttttagtaaaatattttaagcacttaacaatgtagagaatgatatggtaaacacaaggtttccaaggcttacctttgtcaaatcttaatatattgctatatttggtttttgtttgtttgtttgtttgagtcagagtcttgctctgtcgcccaggctagagtgcagtggcgcgatcttggctccctgcaacctccacctacccgattcaagcagttctttgcctcagcctctggagtagctgggtttacaggtgcccaccaccacgcatttttagtagagacagggtttcaccattttggccaggctggtcttgaactcctgaccttgcgatccacccaccttggcctcccaaagtgttggaattacagttgtgagccattgcgcccggcctgtttggttgttttttaaaacacttgaatgtggacagtttcagggacatgcaaaagtaaacagaatggtataattaatttctgtaggcccattaaggcccccagcaccaatgactggctaatcttgcctcattcatacacatattctttcccactttccttccaattctgaaacaaattccagatatcatattatttcatcaagaaataatccagtatagatctttcataaataatctttatcttctttaaacattgccatgttagcattcgttgtcacaccttaaaaagtcatcagcagttacctttttgttgttgttgttgtttttgagataggatctcgctatgtcacccaggctagagtgcagtggcacgatctcggctaaccacagccttgacctcccgggctcaagtgatctcccctttcagccccctgagtagctgggactacaggaacataccaccatacctggctaatttatgtgtttctataggagtggtttcaccatgttgcctgggctggtcttgaactcttgggctcaagcagtccacccgccttggcctcccaaagtgctgggattacaggtgtcagccactgcacctagccacctttaatagtttttattttaatattctcaaattatgtaattcctgaacatcatcagttcatatttctaatggtttaatcatttcccaaggggttatattttatttttatttatttatttttttaaatcaggatctaccaagacttaaacacatggtgactgttgtcttttaggtcttgtacacgtttcagttggttatataacaagtagtggaattatcgagtcagagtatactttgttttaatttttatttttttgagacggagtctcactctgatgcccaggctgaagtacagtggtgtgatcttggctcattgcaccctcctcccaggttcaagcaattctcctgcctcagcctcccgagtagctgggattacgggtgcccgccagcatgcccagctaagttttgtatttttagtagagacagggtttcgccatgttggccaggctggtcttgaactccttacctcagttgatccacctgcctcagcctcccaaagtgcgggtatttttacaggcgtgagccaccacgcccaggtgagtcacagagtatacttaatttttagttctaatactgaggttgggaaactttcctctgcaaattaaatattttaggcttttcaggcaaagtgttctcaattttgtcaccattcttaactcacccactgtatgaaacaagtgatgagccagatttggcccaggggccatggtttgctgacctctattctacgcggtctgtatattgattgttaaccaagggtttttaaaatttttttgacttgaccaagcacagtggctcacacctgaaatcctcgcacttttggaggccgacctgggcaacatgacaaaaccccatctctactaaaattacaaaaattagctgggcgtggtggcgtgaacctttagttccaactactccacaggctgaagtaagagaatgacatgagcccaggaagttgaggttgcagtgagccgaaagtgtgctactgcactccagcctgggtgacagagttagactctgtctcaaaaaaaaaaaatatatatatatatatatatatgtgtgtgtatgtatatatgtaagtatacatatatatgtattggcttaaaacttttatttatttatttttagagaagggatttcagtctgtcacctaggctggaatgcaatggtgcaaacacagctcactgcagccttgacctcctgggttcaagtgatcctccagcctcaccctcctgagcagctgagaccacagatgtgcatcaccatgcccagaaaatttttttatctttgtagagatgggatctcaccatattgccccagctggtctcaaactccagagcttgtgcgatcctcctgccttggcctcccaaagtgccaggattataggcatgagccaccgtgctaaaaaattttaattttttacaaaaattagctgggcatggtggtgcacacctgtagtcccagctattcaggaaaccgaggcaggagaatgcttgaacctgggaggtgggggttgcagtgagctgagatcacgtcactgcactccagcttgggtgacagagtgagattccatctcaaaaaaaaaagaaaagaaaaaaattaattttgatgtagtttcaaactcacagaaaagcggagagttctttatatccttcaactagattccctaaatgttaaccttttaccacatttgctttatccttctctctttttatgggagtggggcacagtaccctttgagagtaagttgcaggaattatggcccttttcctctaaaaactatatatttcctaaaatcagtaacattgtttgaaataactggagttagaaaattaacattgatgctgtattacctcatgtgtagatcttattgggttctgcttgtcccagcagtgtcctttatagttaacaagaaaaaaagaaggaaagaaaaacaaaaaagacctacattgtgtgcttcatgcagtggtatgtctccagccttctttaatcttaaagagctctttagtctctttatgcctcataatactgacatatttgaggaggtacaggccaatagtagtgtctcttatttcaagtttgtctgatgttttacatgtgactaatggctctcgtgtcactttatttaaattgcagttggtttttgttggggattgattttttttttcctaccttagagctatttatttttaaatccttgatatttttgtgttgaaacatttccgtaaagttggagacaatcttgttcttatttaatgagctgaatttatatgggtctgttacaatttcaagtatgtgttgcttcagtaggatctttttggtattttgggcaaaaagataaccatattccagaacagttatctttttgatctaactcttgatggacttacaaaatagataatcataatactgaaacctccatcatatgttcctacttagacattactttaaaaagttaccagaggccaggcatggtgactcacgcctgtaatcccagcactttgggaggctgaggtgggaggatcacctgcggtcaggagtttgagaccagcctaaccaacatggaataaccccatctctactaaaaatacaaaaattagccacgtgtggtgacacgcacctataatcccagctactcgggaggctgaggcacaagaatcacttgaacccaggaggcaggggctgcagtgagccaagattgtaccacagcactccagcctagtgacacagtgagactccatctaaaaaaaaaaaaaaaaaagtcaccaggtgtcaaaagacattatttttgagactactaaggtgatgattaaaacattttttaaagtatttaaaaatttttttacttggaatttcttgctattttctgtttgtaagtctggtaagtggtttcttcggtttaccctgaagatttattttattcctctttaggagtagttcctttttcttaggtgtctgttattgtggatttctaaaacaatactttacctcaatttatttcaggatgttcaagatccttcagtatttgtaactttcccctttggaagaagatgaaactgtatctttagttgcttggacaaccactccctggactctacctagtaaccttgctgtgtgtgttaatccagaaatgcaatatgtgaaaattaaaggtaagtgggaggctggttacttatgattaatatggataagataattttatattttggaaaatatgaaagcttacctttctttttgcatgaagaatagaattatttgaaaacaatctgacttaattagaaaaataactttaaacatttgttttcatttctaattgaaaactaacaaaacaattaaaatagtacagagatataaaaagtagaacataaaattttcttataatttccagtttatagtacatttttccacaccatgcccctgtgacagatgaagaatctaagattcagcgatgtggcatcacgtcgttactagcaattgataccagaacttgagaactttttgcctttcaaatgtcccctggtagagagttaccagtctcaacgagggcctttccgagatttaaaaagaagattggtactttgtgaacaaatataccttcaggtttggtagttttgtggcggtaaaagaaaaagagaaaaactcattgccatgaaaaaagctatggcacagctgctgtggaaggcagtgacatttcttcaaaaagctgaatgagatgacactatggcccagcaatttcacttctgagtgttttccccaaagaattgaaagcagtcttgaacagttacttgtacacccgtgttcataggagcattattcacagtagtcaaaagatagaagcaacccaagtgtctatcattggataaatgaataaaccaaatagggtatttacgtacagtggaatattattcagcctaaaaaagaaaggaaattctgatacaggctatgccttgaatgaacctggaggacattatgctaattaaaatgagccagtcaccaaaagacagatactacatgattctatttatatgaggtatcgagaagtgaacttcagagagcaaagactagtagaatggtggttgacagaggctgggagggaagggggagttattgtttaatgagtacagagtttcagtataggaaaatgaaaaggtttagggtattgataatggtaatgattacacaacattgtagatgtatttaattctgtgtaagaatggttaccatgatttttaaaaatagttgtattaaaacagtcaacttgattgaacaatagcttgtgttggcaagggaaaaatattgagaaaggaatggggaaagattgggtgccagaaaaaaggtacggagggagttttttatttgttctttcctgggagcaaataggactaagagttgacctactggaaagctgttggccacaaagaggcctggctcaggtgtctgcagctgcttctctggagcaaggacagtcccatctgcacaatttccctatgtcactggtgggtcactagccattctgtggtgagcttgacaatctcagcagccacctgactgagatctcaaaacacatcacccatctacctgtgtataactcttgtgcttggcagactttgtatctgagctttatcagaaactgtggtccccacttacaatgaagttcctgtgaggtcagagctagggagtggcagccttattcatagcagtttttcaataaattggaaaggcttttacaatgacccatagatactcatttttcttatagtgaactaaatatatgacataggctctagtaaatctcagatgtgtaatatcatagcttatgatgagagtttaaattggcctagattttcagtatcaaagttttaactgttcatacatttgctccagcttttcttttcctaggatgccccaggtatcctccagaaacacttacaataagggtacacagatgcatcaaggacattcatcatgccagtgttcatagtagtgaaaatttgaaagcaatttaagtgtctgtcaacttgttagaaataattcgtacctctataaaatagcgtcccatagagctctttaaaaggatgagaaaagtctgtatgtgctaatacatggaagtatgttgacagtatattaagtgaaaagctacaaaatcagatagaatattacctcaattagaaaaataaaaagaacttacacatttacctatatgtttgtttgtatatacatagaaaaatatccggatccatagacacccaaatgagaatgtctgagagggggtgatatgtggcacttaatttgtgagctactttgtcaatgttatttttaaacattgacatgtttaccttatgaaggaaaaaataaagatttacttaaaatggatatctgagcgataaataataactaccaactgcctaagtgcatttgatgtttttgtcattttcatgtttgggaagcagtataccatagtgttctttgcagtatttctctgtgagtactgggtacagtagaggcacatggtacaggagctcctcaggacaaaagtatgcttgatgcatgtctttggaatcagccaagttcagaatataacccaagtccatgtttttcctttttctcgtagatgttgccagaggacgattactcattttaatggaagccagattgtcagccctctataaattggagagtgactatgagatccttgaaaggtgaatattcaaatagttgctctgtgtttgtgtgcatgtgtctgtatgtgtgtctttagttttaaaaagaaataaactttgttatccaaaagcttgcattattcaaatttagttttaagtactaatactatactaagtactttgcagtcacacattacagcatgaatggctagggctaagaagccagtaaaccagaggggagtggtagcttgatgtggctgcagcctcatatttgattttaatctaattgtgagtttgcctttctccttttctagatttcctggtgcctatcttaaaggcaagaagtacaggcccctgtttgactatttcctgaaggtaagcttagggaccgctactgtgggcgctctccacaatctgattatttgatagctggggtgttgtgagaagtggaattgacattacttttatgagtgtacctgaatccagaaagtctgctttagtaccaacaaaattaaattgtttgtgtagctttcttgtcttagaggatttttttttttttttttaaaaacagggtttcctctgtcccccaggctggagtgcagtggcacaatcacagctcactgcaacctcgacctcttgggctcaagtgattcccctgccccatcccgagtagctgggactactggcacacagcaccacaccgggctaagtttttagttttttgtagagacagaatctcgctatgctgcccaggctggtcttgaactcctggaattgcaagcatgagccactgcacctggctgggattttttgttgttgttgtttttgagatggagtgcaaatatcgtgcaatagcgcgatcttggctgactgcaacctctgccccccaggttcaagcaattctcctgcctcagcctcccgagcagctgggattacaggcatgctgtaatttttgtactttttagtagagatggggtttcaccatcttggccaggctggttttgaactcctgaccttgtgagccaccgtgcctggccaagctgggattttttatttgaatatttttctcaaattgtatgaggaatcattttacatttgattggatttttaggtgtatatttttattgcatgtagtctacatatcacccagggtatttattgaggtttttgtttgtttgtttgttttgacaaagttaagatagtaatcacagtaaaacatcatgtggaaaggtaaacacaattttatttcaaggaggttaatgaggcaggtgttttaaatctaggcaccacgacagagctcatacatttagcaccttagtttcttcagagtcataaagttgttttatgtggttttattttctgacagtggagaatccacagctacagttgcaaaccctgctgtccccactcccacactctctcaccgaaagaatagtgtcaaagaggaatttctccgtccttatttaaaggtcttgaaatgagataatgagcagacctggccttatgtggaaataataatcaactggacatatcacttacgtcccatcccagaaaaaaatgttcgctgaaccctcagttgtttctgttccgtgtggggagagtctggttgattaaggagacctctgtggtttgggccctatccatggtgtgtctgttacctgccttttcacttttgtgcctcttgagtgttttcccacatttctcgttgcctacttgatagccttcttcctcctcccacgttgctgcccagtggatttccatatgttctgccctcatcccattcctccctacaggcgttagttatttaccagcaattaggacgtgccctccccagtcggtatgtggcagagctgcttcctgaccacatcctcccacattactttagacatatcctttattcagtcaaactggctcttccctttcctgcttccctgcctttctttaattaagttttcctactgtcttaaaagtctttatttttttcttatgttgatatctgctgagttaactcacccttcaggtctgaactcagatgtcctctgaaagttttctgaaatgcatctttggtttctcccttggaaaaatgtcattacttcattccattctcctatcatatagcttaacatactttgttttatgttgtattttttttattatctgaaatctcttccactggatcagtgactctcacctttctgaatcacaaaacctattgagaacccaaaaactcaaccccctgaaagaatgcacatggatacactagacaggaactttaggttaagtagaggtctgtctggaatatgcacttggtaggtattaagttgaataacacctactcattaaataagcttcttaaactacctgaaaccttcggtgactttaggcaagtactataaatcgtttgacccaggacggaatcatctgatgttcactgaaatatacctgttgtgaaatatcgagggaagctgagtcagcggacactgcctatggagcagcactgctgctcctggtggttggtatctactgacctgggtggaagcagcccagccatggcctgggtaggcccaaagtagaccctgagagacaagatgcagtgactttgtctatactgcttctaagtatagaacatgtaactaagtatacatgtaattctaaggacccatgtattctgtctttctgtttaaactatcgaagttttagcacctatcatactataacttctaaaatgtttcaaggtgatttaggttacaacaattaaaattttatggttatttttcaagtttagttttaagttccaaagaaaccgagtgctgtgatgtaattgaaaataacattgtatttgcaaccagaagacctgttccatgtcctggcttcatcattgctggttgtgtgatttggataagactaagtttaatctttgttctgagcttgctcatctgtgaaatgcaaatacagccagaatatttttaagacatgggactactaatagcttgttcacagaattataggagttaaatgtgaaaatcacttgtgaaagtactttttaccaatgcaaaaaggaaggacatcaaagggccagtttggcagaaacaagggtttgtggaaagaaatgtaaaaagatgaaagtagagtaggtctgttagcattatatgtattaacatgatgatattgctgttgcaaagaaaatgaaattgaacacatttcccctgagtattaaggtggtggagtacctgtaagtagaacttactactcgtggctcccacctgttcctttcaagatttgcctttatgactgaataacttgagctgagttgaaaggagaaagagaagcaaaacatatgcagtgattgaaaatgtaccaggaagtgaacaatttagggagcatgctttctgagactgtatcctaaactgcatagggacaaaaagttgggggagggagaactaatgaaaaacacgtttgtaaccaaggaaattagaaatttttatctgccattctccagataattatttcgtttataagtggtaactttttatttatgggaaaaatgtattgaattagcatgtttcttcccagcctgcattattctttcttttctatttctgaaaataattttaccggttaaaagcattttcaggttcttaggaaaaactgttacaaagttaacgttgtaacacagtaatgtttcatccctgaagcctgctgtcctttctttccagtgtaaagagaatggcgctttcactgtgcttgttgacaactatgtgaaggaagaagaaggcacaggggttgtccaccaagctccttacttcggtgctgtgagtagcataagtctggcaaatgtatttgagtatgtcggtagccacttttcatagatgcggagtcctgtgtctcatcatgttgggttaccaggttggcctcttttctggctcactgcctgcaagatggcttgtaaaatttgcatctgcaattccctttcatcctaagctgatttctggaaagagtgggccaaatccagtaaactctttttggtgtgcagttccgtgagttttgacaggcatctagagacgtgcaggtgcctcagccaccaagatacagaccattcccatcacctctgctgtgttcttaattaaatgttcagaagggggaatctgacctctcccctcaaaacagtactctacagttaattttatattttgactagaataatttttctaaaaacacattcctttttatgtaatttgtgtatgaataaaaacagaataacataaaggcacatgctttacagtaaaccacctctcaccttaaatcatggcactgccactaacgggcagttcctgggtaagttgcctggcctatctggacttcttttgcctcctctgtagcatggtgtagcatggtgtagcacctacatacacattcctctaggcttgatcgttttgtcagtgagagggattggaaatgtgactttgttctaaaaggcagtggcagtagtctgccctcatctgccattttgctttcatgcttaatctctgggattttttacttttatagatgtagagggtacgggtgcaatttttttacattgatatgttgtatagtagtaaaatctgggcttttagtgtaaccatcacttgaatttttattatggaaatcttgaaacatacacagaagaaaatatgataatagattctttttttcacatcatccagctgcattaactctcaatgttttggcaatctctcgttttcttcctctgtacagtagcacacttttttattttggctggaggatttaaaagcaaatcctcatcctcatgtctttcgtgtctaagtaattctagctgcatctctgactgataaggacttttattttcagtataaatatccaataaagtcagcaattccttaataatcacctaatacctggtccattttgatggaaggaagcattcttgataatactacttaagagttttaggaactagtcaaatattgttcataatcattttagggtcaattaactggtatggttaccccactcttagtagataataaaaaggtaacttcttggttttgaattgtagtgtaggggtttttttttttttttttgagatgggagtctcgctctgtcacccaggctggagtgcagtggcaggatctcggctcactgcaatctccgtctcctgggttcaagcgattctcctgcctcagcctcctgaggttttcttttttaaatgtgggtgtttgtcattaactctagagttatatctcatatatctattctcaatgctgtgcatgttaatgttatagaagattcattctttaaactatagcttttaacaccatttggtaaatttttttttttttttttttttttgttttgttttgtttgagacagagtctccctctgttgcccaggctgtagtgcaatggtgcaatcttggctcacggcaacctctgcctcccaggttcaagcgattctcctgcctcagcctgccaagtagctgggattataggcacctgccaccatgcctggcttattttttgtaaatttagtagagacagggtttcaccatgttggccaggctggtctcaaacttctgacctcaggtgatctgaccgccttggcctcccaaagtgctggggttacaggcgtgagccactgcacccggccttggtaaacattttctgagaggccttccgttgcacttgtcttcaccaggcaagggtagtgtttgatcttcgcagagtctgtgcacttgtgcgtcatcctgttgaacatcactggttctggatgcattcaggaatgctgctcttagcttaatgcactgggtaaagttacttgctccacactcagtggttcaaattgctgcacttaggggcttttcctgtctacccacatgacaccacaccagtcagcctcagcacagggagaggtgaacacagatccaggtggaagcatgtcagctttccagcttgtcttggagtcaacccagagtgtggtttcaccaacataaggcaatctctttaattttatatttaggcatcataacacagtgatgaagactatagactctggagccaggctgtttggttttgaatcctagcattgctgcttcatagctgagttacttcttggtacctcgactttcctatctgtaaaataggaaatttttggtttttcagatgtgtgtgctgctgttataaatcaaatttgatttagttttaaaacattcctgtgtggctgctctgcttatggagtagccattctttattgctttactttcttaattcctttcacttaaaaaattgatgtatgtcatctatcttctcatttagtggatactctgctacatatggaggtctgggaaataatatttgagaagactagactgggtgacctaacccctgtccaactgtgagggtctgattctccgaatggtcttgagttaccttcagtttacaggacaaagttgatgaaatgtatatgttacaatatagaacaattatcttgggaatctattacctcatgctcacacccatacatagactgttttattcttccctctcttttgccttttctcaggaggactatcgggtctgtatggactttaacattattcggaaagactcactccctgtttgccctgtggatgcttcaggctgcttcacaacggaggtgacagatttcgcaggacagtatgtgaaggtctgtaatccatatagcatagaagggtgactgttacttctgattagtctctaccatcatttataattgtattgtaattcttctaggaagttgtttttatttggttttgtcatcgcatgaaatccgtaaagacagatgttatcagttacgttcagagggtctcatatctttagaggatgcatgctgaaatttcatggggaaagatcagaaaaactccagttcatgcctcatgaagcacctttgtgaccttggggttgtcatttcagatcgaaaaactttatgaccttaaatgttgtggaatgtacttgaaaattacttaaagttagtgactaaaaataataaataatatttgttatttgtgccttttattcataacaaggtatcagattctagtaatatattgttcctaagtattatagtatgttttaatggctaaattttaattttttttaataggatgctgacaaaagtatcatcaggactttgaaggaacaaggccgacttctggttgccaccaccttcactcacagctaccctttttgctggaggtcagaagaaacaaagactgtgttgtagctagagcttccagtctgtgcttacacttactatatgtgcccattccatcttatttgtggtgttcatctcacttgtatcctttagagttggtttgggaagccaccttcttacttcatttttaggagagttgggttttttgtttgtttttttgttgttgttttgagatagggtctcactctgacgcccaggctggaatgcagtggtgcaatcacagctcactgcaccctccacctccccggcttaagcaatcctcccacctcagcttctggagtagctggaactatgtaggtggtgccatcacacccggctgatttttgcatttcttatagaaatgaggtttcgccatgttgtccaggctggtctcaaactactgggctcaaataatcctcccaccttgtcctcccaaagtgctgagattacaggcatgagccacagcgcctggtctaggagagttttatgaatggctaaaaatgttgctttcctaaggaactgtgagagaaaaatagacctgtacaaatctgttttgtattgtggccacattttttttaggatgagaagcatctctaaaattttgtaatagagtttattgaaaaatttaatatgattttaacctttaatataagaccatgctgtaaaagtatgggtgaaaatgaaatgttcagttgcatcgtgtttggtttccacattgcctcttctgtgttgaagttgaagttgacattgtttcttagataattgtcactagcagaactatttttttctactcttgttcttgtattagtttttgcctttcttactattgtggaaagatatgaccaattttgaagtcttagatgtttttatctataataaaaatgaatattagcagaaggccaagtaagtgatgatgctgtcaataagacatgaaaagtcagtcttaccgtagtgcctactagtctcagcctgagcagctatgtgtgtgtttctgcttccccagatcagacactcctctaatttacaaagcagtgcccagctggtttgtgcgagtggagaacatggtggaccagctcctaaggaacaatgacctgtgctactggtgagcagtaagatgtgtttcttcatagtgtcttttgtcatgtggttagtaagtatggtttacacttcccccaagttataattttaataacccatcttttattgggtattgtaatagctatcttttcttctgtgtgtttaggagcacaaaataattcaaataatgttacagaacagaagtaacatccttcttgtgataaagtatgtaagggagtatttttctttttaaactcattggaaatgataaaccaccatttattcgatttagggaatgaaatgaccttggaaaaatatggctgtactgccagagtttgctagccttcaataatagtcattttcagagtaaacattattttcagatatacctgcaaaagccatttgtacttactcttgttggtcctgcagtggatgatgtaccctgtgcttggctgtatggataagctccaagcacagaagcctttgctttccatagctgatatgtgtcctgcaggtgatagcccaagaagtatcatttcagcctctgggtacaaaatgaaacaaggcttgaacctgtgtatttcagatgaatgtttttcactacaagtttgaaaagtaatcaccactcttaacttctcacaaggacccaactagactctagaaaactgtatctgagtttaggagaatggggagaatctcagggcagcaaaggaaatagttataaactgtagctttctaatatttcttagcagagtggtcctgatttctcaaaagacagcttttcatttttagagctagtaagctaattagttcccctaatgtgtaagatactagatatagaatattagtaagatagcctcgagggggtgcaggcatataaactgatctttgaagtacagggcagtaactgcagtgcccaagagaagaaggggaggtctggtagcctaccctgactcagccttgtgcttgaaaaggatttctgcaaagctgaacctcaaggaataaagagtactgggagtgggagggatgcaagaggatggatgcagaagggagggaagctgcgtgtcagagggcaggcaggctgcgtgtcagagggcaggcatgggcaaagccagttaagtgagaaggattctagggaacttgcctcattgccagagcctgaaattcaagaccaaggatgaccagagaggtgactatagagagggctgctagagcagctaccaatcccctggcctgttggcctttgcttaatgagttcagaaaaactgctatggtgaggataatgtgaagactagagttgtatgggatgaggctggctaaagctaaggtgactggttagaggtatgtggcagctgtactccagttgaagaggaggacatgggaggcctgtgtgctgtggggtaatctattggatgtaggtcattgatggcagcacaaactgttgtgtgtgctatgctgtccatttagaagacattctctttgcagtgagcgccacgtttccagagtgtttggtccacaaagcgttatacaaaggctcctgtgggtattatttacatgttgaatttttccatatttttatgtgattggttatgtgatctgtttattgcagggtcccagagttggtacgagaaaaacgatttggaaattggctgaaagatgcacgtgactggacaatttccagaaacagatactggggcacccccatcccactgtgggtcagcgatgactttgaggaggtgaggcatggcagtatttccttgtgttgatttttgctaaagcattttgttcatgaaatctgaatgtggtttaaaagaatagggtgtttttttctttgcccctttcttatttcatcttttttcctctttattcctttctagaatcatgacataagataatctgtttctggggtttttaactttttttccttgaattaaatacaatttataaaactttcctctgtaaaaataaaaggatacagttttctcagggaaatacacactttaaatgttttttttgtgtgtttccccgatgtcttttcttccccctacattaaggtatactattagcttatggttaaactgactttatagatgatgaaaaaagaaaacttgaaaagaaatttaccaaagcattacagacctttaacttctaaaatcaaatgaataagaggatgtgtgtagatatatagatgtatgtggatatactatgtcctcacttaatgtcatacagaggttcttgataactgactttaggccgggtgtgatggctcccacatgtaatcgcagcacttagggaggccaaggcaggaggatcgcttgagaccagatatttgagaccagcctaggcaacataatgaggttccatctctacaaaaatgtttgttaaattagacaggcatggtggtgcacgccacttagttccagctactgggacctctcaatgacatcaggcgaggacttactatacagatagatctgtgtgtttggccttctgtccaaagctgacagcattgttgcagtgatgagcggcagcaccctggggaccttggtgaatctcccatagggacctgaaaggcaacagtgaagtagctgaatcagaagacttttcaggactgaacaggaagggcagagaaagaggccaccagtgttcactaggatcagaagctccctgggtgagaacgcacagcagttcctactggtgtggcccttgtcagatgatccctccattctgagtgccccagctagccccatctctcagctctttacctggatataatcctagcatcctgtggctttgtctgattgctttaatcgggtccaagcataatatagtcatgcaccacataatgtcattcagtcaatgacagaccgcatatacgacagtggtcccacaagattatgataccatatggttactgtgccttttctgtgttttgtaatgtttagaaactcaaatacttcctgttttagtctgtttagtgtagctacaaaggaatacctgaggctggataatttataaagaaaagtagtttatttggcttatgattctgcatgactggaaagttgaagactagacatctgcatgtggggaggacctcaggctacatccacttatgatggaaggctggacaggagccagagtatgcagaaatcacatggcaagagaagaaacgggcggtggggtgggggcaggctcttttcaacagtcagctctcacaggagctaatagagagagaactaactcactgcagaaggagagcattggtctcttcacgagggatccaccctgtgacccagatgcctcccatcgggctccatctgtcaatactgccacactggggattaaatttcaacttgagatttgctggggacaaaccatatgaaaactagagcatttaccattgtgttacagttgcctgcagaattcagtacagccacatgctgtacaggtttgtagcttagaagtaataggctccaccatatagcctagctgtgttttaggccatcccatctaggtctgtgatgtttgcctaaggaaatcaccctaacaatgcatttctcagaatgtattcccaccattaagcactgtatgactataatttagctctagctttttcttgggaagattctagattaatgagccagattcaggtgccaggaggaaactaaaatgccttagagaaataatctaagatgtttcacttatgccagttactttgacaatttgcacataataaacccttaatatccattgagagtatggctatgaatgtttaagattctctctaggtagggactccctctgatactggggtggaaacagaggagcagtggcaaccctggcctcttcagagactaagagtaggctgtgtctttcatgagagagaagccacattagcaaatactatccttcggcccagattggtgtgttaatgtgcctttaaatcatcagtctcaggctgggtggctcacgcctgtaatcgcagcactttgggaggctgagggtggctgatagctcgagtccaagagtttgagaccagcctgggcagcatggcgaaaccctgtctttactaaaaatacaaaaaattagctgggtgaggtggtgcctgcctgtagccccaggtacttgggaggcttaggtgagaggatcacctgagcccaggaagctgaggctgcagtgagctgtgattgtgccactgcactccagcctgggcaatggtagtgagaccctatctcaaaaaaaaaggaaaaagaaaatcatcagtctctcaaagtaaacatgcatgctatataaattaactcagtatgctctgtttggctctaaggagctcctgctattgaactttgtttttgacaggtggtatgcattgggtcagtggcggaacttgaagaactgtcaggagcaaagatctcagatctccacagagagaggtcagtttctaaatgttcgattcacttcagttttacgattctcctattaagacctggtctctagcagattacagagccacacatggaagtgactagcttgctgaattactttgctgatgactcatgtcatattgcagtattgtggcctctgtccttgtgaaatgtgaggtgaatggtgcataacctttcagatggaggattcatggtgctctctgaaagcctttgagaattgctgatatttctgtttgcaaatgtgtataatatcttgtcagggttttgtgtttcctattagcaattaaactgcaagttctgttatgcttacagttaatagaaatgactacttttctgtttgttagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggtatgcctccttgttctttcatcacgtgttttattgattttattttatttagggagtattttactaagtcactgccatttatctactgggtgatggagagattgtggcaaataagacaggctacattcctgccctctcccctccaccaccaagcacggacattaaagtgccttttgagtaggactctcccactacaatagggctgtagttttacaatttcaatgatctcactggcattttggaatatatgtgttacactggatgttaaaatgataaaaaaagttatgtgttcttagcttacgtcagatcatttactcaaatgtttgagtatttgcataaaagacagtagtttgggtgctagaaatttgagggatagttggtaatgtgctcagatattgaggctagccttataaatcaacattctaaaaaaatccagatttttaaaaaatatacatatgagagaggatttgggcattgatttttatctggtgccttatgtaaaacagttccttaattggaagaaggtgaattactttctttccatggattggctttgctggcccaggctttatttacttttttttttttttttgagacagaatcttgcactctgctgcccaggctggagtgcaggggtgtgatctcggctcactgcacccttcgcctcctgggttcaagcaattcttctgcctcaccctcctaagtagctgggtctacaggcatgcaccaccatgcccagctaatttttgtagttttagtagagactgggtttcaccatgttggccaggctggtctcgaactcctgacctcaagtgacccacccgtctcagcctcccaaagtgctgggattacaggcgtgagccattgcgcccagcccaggttttaattatacattcacagtaatgtttctgcaggggtgtgttaaaggaattgttggtgtcattttctctctttgacagctttgggtaatcattgaattcaagtcttcatgttctggaatgtgctgtcttcagattccagtcctttttgtctataggaacagctacccagcacaaattctgtttttagaaaggggtagatgccttaccaatgagcttgttcctttgaggagtagcaaagtctgttagctggtaacagtcctcatgtggatcccgtgtccttggtgcctgcctccttctccattcctgaggcctgggctacctctcctgggcaccagggctcctcccaactctcctttagaagtgggagggatatctggatcagtgtttatgttaactatggggtctggtctcctcagctcatgtcccttgatgttctcagagtgcaggactaggtaagagaggcaggaaagcatcacccccaggacagtggtcagggatatgagttcatttgggaaacaagctaggtagcacataaatgaggtacataacattttacagaataaaagcattttctagtctgccttatcacttttgggtgagagtgcattttgcatcttttgtcatcaaattgtcttttccatatgatcttgtgccaaattcaaaacccatccttcatcttcagctaggtgcttctgggtggtcctgagaggccacccagtgctgccatgtggctctccacacagacttcctgggagctctggtaacagagaaatggtcagtaaatcattccagacgtttatttcaatgcttctttcaaatcttagacagtaatttgattggtctccagtaaccaggattaagaatcattgctttaagtgattctcaagaagtgtgacttatcaaaaatagaaattcaatgaataaatacagtttctttcttatgcttggacttcatttctatttttattgaactgtttggggttttttttcaggttttataccctgctggtgctggccacggccctctttggacaaccgcctttcaagaacgtaattgtgaatgggcttgtcctggcaaggtaggtcaactttgttgtagtgacgggtggaactttgtctccactgtttcttaagaaggagtgcgtgagagcggtcaactttgttgtagtgacaggtggagctttgtctccactgtttctcaagaaggagtgtgtgacagctaagcctgatggaggaggaggaaggggaggactttcagattgtgctactgctagtaacataatgctactagtgatattactagtaataaaatagcatttactaaacttagcactttatgaaatacttttgcttatagatcttatttaatctgtacatcagtcctttcatgtagattttgttgtcctttttttaacacacgaggaagctgtgggttctagagaccacaggtgcccaggatcaaagctagtgacagccacactgggcttgaccgaggtactctgccaccagatcccattcttcccctcatctgaaacttcctcccaatgggcattatttcccacattttgctattataaggaagtctcatttttcctttactttattacctctagtcattaagaataaaaataaacataaatgaaaattttaaaatgaaatattttaaaatagaatttgtgctgagtacccacacagaaatcctactttatatgctgtgtgaggaggaagaggatgtcacctaacattttgtgcatccttattttttgccaggccccactgtgtgcattttcacattttaactcatttaatccccagaaccatttgagatgggtcctataatccctttgtgacctttgaggaatctgagggacaggaaaaagtgacttgccaaaggacacacagcaaatgagtggtaaatgcaaattttgaacccaggcagtctgcctctgtagtatgtgtactactttttttttttttttaattgaaaattttattgagggctgggtgctatggctcatgcttgtaatcccagccatttgggaggccatggtgggcggatctcctgaggtcaggagttggagaccagcctggccaacttgataaaacccccgtctctactaaaaatacaaaattagtgggtgcagtggcacacacctgtaaccccagctacctgggaggctgaggcacaagaatcgcttgaacctgggaggcagaggttggagtgagccaagatcatgccactgcactccagcctgggtaatagagtgaggctccatctcaaaaaaaaaaagggggaaattgtattgagatcattgtagatttgcatgcaattgtgaaaaataatagagatcccttaaattctttgcccagtttcccccagtggtcacattttgcaaaactacagtatatatcacaaccaggatattgatatagcccactaatcgtattcagatttctctagttttacatatacttatttgcttatacgcatttacctgtatacggctatcgtgtgtaggatcctgtatccagcagcacagtcaggttactgaatgaattcaacatcaaaggctcccttcctgcattgccttcccctcctgccttcccactgtcatccccaatccctggcaaccactggttttttctccatctctgtaattttgtcgtttccagaatgttatataaatagaattatacagtaactaacttgggggaattggctttttttttcttttttttgagacagagtctcactctatcacccaggctggagtgtagtggcgtgatctcggctcactgcagcctccacctcctgggctcaagcgattctcccatctcagcctcccgagtagctgggaccacaggcatgaaccaccacacccagctaatattttgtatttttggtagagacagggtttcaccatgttgacaggctggtctcgagctcctgagctcaggcgatccacctgcctcggcctcccaaagtgctagtattacaggcatgagccaccgcacccagctggctttttttaaatccacataattccattgagattttagatgactgcacctaccaatagttccttcctttccatggataaatagcattctgtattatgggtatgccatggtttgtttgatcatccacctcttgaaggacatctgggttgcttctaacatttggcaattgtgaataaagctgttgtgaacaattgataataggtttttatgataatgtaagttttcatttctttgggatatattctgacacatctttcttcttcagtctaccctgaagcttcctcatggacttagtatgatattcaaaaagaagtttgcaaatattaacaaaatatcttaccattgtaccttaacactgtttgtttcttttttgagacagagtcttgctctgctgcccaggctagagtgtagtggcgcgatcttggctcacttcaatctctgcctctcaggttcaggcaattctcctgcctcagcctccccagtagtggggattacaagtgtgcgcccccacgcccagctaatttttgtatttttagtagaaacaggtttcaccattttggccaggctggtcttgaactcctgacctcaggtgatctgcctgcctcagcctcccaaagtgctgggattacaggagtgagccaccgcgcccggcctattagcactaacttctatctaagttactccttcccatttcattttgtatattcctgtttgcaaatgatttgtatccttaaaacaagatcatctgtgatattgacttacttaattggcatctcccttttgttttacaagtgatggccaaaaaatgagcaaacggaaaaagaattatccagatccagtttccatcatccagaagtatggtgctgatgccctcaggtacaaaccagtgctttgccttgtgtgtatctattgtttttttatgtaagcatctcctatactattaatcagtattcttagatttggtttatagttaggtttttagcaacatatctctgttatttggatgttatgttggtatggttgttgattttaaacccccaaaatagttttctaaataataaaggcatttttaaacctagaggtctgtttgaggaagaggacctgtgttgggtgttgttgagctgtccaagtcctccccaggctagatgctgattgcctctgccttacttcctttctaggttccctgtcttgttggtattagaattctctttcatcatttgttttaattttgtacttacagagccatgtgagatatatctatgctagaggtgataaaaaaactcatattgaaaagcttttggagaaatttgagccactgcttgaggtagctgtaatcatgaaaccacacagtgttcaagttgaaagggacctagagatcttgttcagcatccctgtgtcctaggcatgagaccagtgcccaggcctgtgactcagcaccttcacacagtacctctgttgaccaggagccattagtggggctctcccccaattctccactgtctcttagactcacccttggcactgctgcccatttgggctgtgtaattctttgtggtggtagttctttgtaggatgtttagcagcatccctaacctctgcccaccagatgtcaagactctgctctgtgaaggctcttccttgtgagtccctctctctgcaagcagcagatgcaggtcgtgtccgtgggaaggacacagtggctcttgacgaggaccaggccagcctttctcttagtgctggtgtaccccattggtcctgcagtgagagtggcataagatgcatttctgtgctatacagtgccatattttggtgtcagattatatacgtcttttataatttgctaagtctcttatagaaagtgagagtgagttttgtgagttttaaattgaccactcaaagagtattcataattacccccttttgtagaaaataggactgattttcatcttgctctctcaatatgtcgagtagtaataattggtttactgtctaagtaccttttctgtctaatttttctccctcttccagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggtatgggctgtagggggctgcacatgtacctgccgtgtctccacagcgctcccttcaccaagctgtgaggtggagctctgtgtgagactttagggctgctgttctctgctgcctgatgctggggtaacttagagccatggggaggccatacatgcaggtgcggaaggtatctagggtccgggctatgccaagaccatgggccctagcctgcaaaagagttatgtcatatagttgtttagtcgccagttgttgtttttgtttttgaggtggagtctcagtcttgtcacccagactggattgcaatagcacgatctcggctcactgtaacctctgcctcctgggttgaggcactgcctcagcctccccagtagctgggattacaggcacccaccaccatgcctggctaattgttttatatttttagtggagacttggtttcatcatgttggtcaggctgatcttgaactccagacctcaggtgatccgcccttcttggcctcccaaaagtgctgggattacaggcatgagccacggcacccagcttcgtcagccagttcttggtaccaggaacaccatgttgagtgagacacccctccccttatggaaccaatggagtgggaattgggagatacagtaaagagtcagcaacttttagagagagcacccagtgaaggcggagtcacaggcaagctagggctggccacttgagatgggtggtcagagaaggcccctcagtggggtggcatttgggctaatctgagagtgacagcagttctcgatggagttttcagtgggttgttagggtcacatataatagttgtgatgtatgtggaagtgtacttcaatggcagttacctccacgcccaggagttactttctcacctgagaagcccttgctctagagccaccttccatgccccacaactgaccattgtcagcgtccatcaccttcattgaacatgttcctgtatgggctttcaagacctgatttggggtcagagttccgatactgcacatctgatctccagcaccttacaagtaaaattgcttgtaagtaaataactgttgaatgaaaatgagatattattcctgcttgagcagttgaaaaagctggttggaaaaatgaactcttgttatcccactccagcaggcaggtcaattacttctgctccccttgggctctggttgttctgctaatgaggacacatcatgttcacctgaggctctcagagtagcctttccccaggaattgagaagggcagtcatcttccccaggctcccagcattcctcctctctgcagcctgccacctgtcctgcatgtggttctctgccaagtagggcaaacagtccttgggcaggtgcactctgcaggtctccactggtgtgggactcaggaatacaggcggggtcaaagctccccacagccagggcccatctgaatataccagcaagacacagactccatgatcagggccttaaacacagaggaagagtcacattatcactgccccgctagcctggttgtggtgctgccagagaaacaaagcaggacatgagttctgtttgtagagcaaggacttaagatcaaggaggattttgcaaagcaaaaagagtgggatagaactttctgggtaaaatgaacagccttagcatggaaattatttcccagtactcattttcagtttgtggacaatcattcaatcctagacagttctactgtccttccttcctgaggtttaaagtaactaaaccctacacttttctgacaagattttagaatatctttcaattcataattactctttggtgcagagaagtaatgttttcctaaactctcttcagtttactcaaaaacataataaattaattgaggacttaatgtgccacgttggtgcttatcttgaaaatattgctgaaaatcagaaattcacattgccagtagggtctgggattttttctttttgtttttgtttaagtgatttaagaagtttatttcctcatagtaactttcttcccaagtgtgccagtgtttcattaattgttccttcctaggaggaagaaatagaatttctctacaatgagaacacggttagagaaagccccaacattacagaccggtggatcctgtccttcatgcagtctctcattggcttctttgagactgaaatggcaggtgagtctctcttggtctgtcctcccaggaataaggactattctctttgtaactgcccttttgatatttaatagtggaaatattgagagatacagaaaattaaataattgtttccttttacctctcatatagttttgttaaggcttgttaattgtcgtgatatctttgtttcaagaccctggggacttctggcctggtgtggtggctcacgcctgtaatccccagcattttgggagaccaaggcaggcaggtcaccttaggtcaggagttcgagaccagcctggccaacatggcgaaaccctgtctctactaaaaatatatttaaaaaaaaaaaaaaagttagctggccatggaggcgggcgcctgtaatcccagctattcaggagactgaggcaggagaattgcttgaacctgggaggcggaggctgcagtgagttgagattgcaccactgcctgggcaataagagcgaaactccatcttaaaaaaaaaaaaaaagccctggggaattctgtctttagggggtgtcctcgtggtctcaatgctccacagaagagctttagagctggatagccatgggttcagagcccaactctaccacttgttcccaatccagagagttgcctgaagtctgaccgtcaatttccttttttttttttatgggtacatagtagatgtatatatttatggggtacaggagatatttttatataggcatacagtgtgtaatagtcatatcagggtaaatgggatatccatcacctcaagcatttatcatatctttgtgttgcaaacatctcggttataccctttttcttgtttttaaatgtacaagaaattattgttgactgaaatcaccccattgtgccatcagatgccactcttattcagcctatcttgaccttcagtttctttatctgcagaatgcccagtagtgtttgtaaggcttaagtagagacgatttacataaagtagctggcagatgataggtactcaataaataatacttgttattaatgcatttataacttatttttagttctattttcattactaaatagtccccttcttttccagaaaaattagaaaagtcagaagagcaataatgaaatggacattttgctgttatttctattaactaacaacagtgagttcgttgggtaattttacagagattcaaaaagtacattatgttggcttccttaaggtttgagataatcacaactgtaggtccaggtgagaaatctgggacacctcagacagtcagttaaagtgggtggacagaggccctgggtcacagtgagggcaaaagagggcaaggcaaatccaccctcacagggctctgcggttcctgctgctgttgggcaggagcagcggccgccacagacctgggattcaccattagcctagatacgggcacatgctgctccctggagtaggcgctgctgccccatttagcacagaaggactgctacaggatttgtccaccttgttaaacatgtagaaggatcacgacagtccagctgttgctcagatagacacagatgaagatggaagtgagtgtgaggctgagtgctgccctggcgagggcagcactgggagcccagcacactccccagacatgctcacacctgtgtctgcttttccctcctgagtgatacaagtgggtgggaaacgtggggattgttgcccggacccccttcaatatttgggcaccagctgccatgacctcctgtgaagctgggtctggagatgcgcattctggctggagcctggtctgcctggaaactggagatcggcagccacgttttgtgggccgtgtttaagtcccggttctgccggcctgtcagcttcatgtcctccactccctcaggagcactgtgggtatgagaggacctgcctcacagggtggtggtggcctgggtagtggctgctgctgctgcccctgtgtgttgtatgtttatccattgtatgtggagttctatttgggttcatttactccctcagagttgaaaccagaacatagaaaacctgagcttcctggaaggtaaaaagtgccgtgaaccctagaaatcatttagacaggtctcagttactgaaatcacatgtctaagaaagtgtgaccagctaacgactctggcctggggctcagcccactgacatctgagttctggtctttgtgaaaagcagcagagagcagctctgccggttgcaacttctcgtctcttagcttagaccagaagcctcattaacagtccctggactcttttcattattataaattgtatttgtttctaagtatcggtcttattctttttgttttttgtgtttgtttttatgtaacaaagagtattaattaaatgggaggtgaatgagaatccttaaaataagccttgcctcagacaattggctaaacaccctttctttcctacttgatctctgagtttctcagggaactcttcaaatcctcctaattcctcaagaccttcactacctctgatgctgtttttactcgactgttttaatgtttagaaggccagttctattttattcatagcctgtgccagagtttcttaactgcagcactatgggcagtttgggccaggtcatcctctgtggtggggctgtgctgtgctttataactgagcagcatctctgggtctacccattagattccagtagcaccgtgctaccctccaagttgtgacaagcaaaatgtttctccaaacgttgacaaatgtttcccatgggataaaattgcttttgtttgagaatcactggcctatgctgtgcctcttagcatctgaattgtgctttttgtcttttagttgaagtacagtgtaatacaatggaaagaagttgggcattgttgatgctgtcaaattgcacagctccgtgtaaatggcacttcctacagttgtgtagtgggcagtcttggactttgatccacacatactggagtttttggcttttctcactgaccaatgggaattcgcatgtggctcacatggtgatttttttgtgtgcacccctaaacactctgactgccatgtagcacatcctcaacaaacagtcattatgtgattgattcattttggttcttttctccttagtaagtggaggcacttggatggaaggagctgccccttctttgttgtatccaaccctctccccaccccagatgcctggtaacccacttgctgcctgattgacttgtcttacttttagcttataggctttatactgtggtgcctcgcctggtcaagtttgtagatattctgaccaattggtatgttagaatgaaccgcagaagattaaaggtaagtgcagactgctgttgggaaaagcaaaaagtgtatgaagtttgaaagtagaagaaatatgagaatagccagaagggagaggaacattttcagttgctctccgtttttgaagctttgtttttcttttccttttacattgcattttaactatatttgtcatttgagggatagggatctataagttctaaaagtcattttgcattattttcacaacacaattatgtacatgtcatattggagggagaatgtcaaggcacaaacaggactacactgagcagacctcttaaaattcaaaataaaatcatgcaaatattttataaaaatactggtagatatggcattaatattgagaggggtacttccttctaccacaagggagtcagatattatttactgtggacagaactcctctgtagctgttgggggtttaggatgagcagagcataggtcctggtctcaggacttaagccaggtacataaataacaatgatgcttaatagagagagcgaggtctctttactgcaggcccaatgaaggctcccactacccattagtcatgtctttttttttttttttttttttttttttttttttgagaaggagtttcactcttgtcacccaggctggagtgcagtggcatgatcttggctcactacaacctttgcctcccaggttcaagcagttctccctcaacctccccagtagctgggattacaagtgtgcaccaccacgcctggccaatttttgtatttttggcagagacagggtttcaccacgttggccaggctggtctcaaactcctgacctcaggtgatccactggcctcagcctctcaaagcagtggtgttacaggtgtgaaccaccgtgcctggccagtcatgtcttaaaaggcattaataataaaagcctgcaacacaactgtaatttcatttttgtgcagatgtatctcacacacacgtatctagaaggacatatgctaagatgcttacagtagttgtctctggataaattaattatgattgtaggaaaaacaaagataatgaaaaaatttcaatgaattggtattttttttaatacacattatatacttttttaacataaatcttatttaaaggtactttaaagtttttggttagcaactgtttttgtctgttgtgggtagatccattctaccttcagccttcgggtcctacagttaggctctacttccctgtcagctcgcctcaggtggggatagtcagtgggacagcaggtgcacatcctggccaggcctcctgcactgccctgaagggccaccctggtggcactgaccgtggatggcctgtggtcgtggccctttctcctttctctgtctcatgtcttgtctgtatgctgcatgttctttgaagattgcctctttttaataaacttatttttttaatgataaacacttatttaacagtttaatgtttatgtttcctttttactcattagggtgaaaatgggatggaggattgtgtcatggccctagaaaccttgtttagtgttctgctttctctttgcagacttatggtaagatgattggcttctttctagtaccctttggcctatgggctgccttcagcacctacttgctgcagcatcctccatttatatccattctgtattattctgccaaaaatagatatagaagttttataacaccttatagctctagttccttatcagaaatcttgttagcttatacatgttaagtaaggactaagaaatactagattctttcttacagtctctggcagtacaatatatgtcagggcccttggctctagaatgaggatctacagttcaaagtaagacatacctcatcttaatgtggattgccataattgtgagtaatgggggaggttcttcagctaatacctgtctgagtaaatatatatatatcacaaaaaatactttaacttagcattgagaggaaaacgtgcaagtaattgtttgatatatgttcttatcagttcagatattagttaaataatataaaagtggaacggctccaactttaattctttttatcctgtttcctttactccatatgttataaggctcctatttattccttaaccgaaggaaaatctgctttgtacaaggtgctgtgcctggtgctctccatgcctgatctcatcacctccatcctgtgaagcagggggtattttccccagtttacagatgaggtttctgaggtgtgggacagtcagtcttctgtgcatattgacttggctgatacatcattaggtgctcctgtttctattttagacatccttcagaattctagaggtgctttgggtttttctatctacagtcctgcagctatgcttcagggatatgaggccatttctcattcacagggcatgttttgtaacctcatgctcattttggtgcctattactgtgtcattctctaacatgtttagttgtttctcagtataaatgagatcagttgttgatgactgcatataactgacatgatgtcctgtgtcttcatacaggctccctacacaccttttctcactgaattgatgtaccagaatctaaaggtgctgattgaccctgtttctgttcaggacaaggacacactcagcattcactacctcatgctgccccgtgttcggtaggactcaaatagaaataagcctcacctgtgccaaggaggggagagttgctcaagcatgtggggaagaggagggatttccctgctccagctccatctgtgccttgcctcccgccccagctgacatgaactcctcaggctgcaggatggggcccactttggtacacggtagcaaggatgcttggtgtggaacccctttgtagagctgtggcaggtggggtgtgggcatgccccatgggggctccttggggagatgccgggtgctgagtggtaggcactgcgctgcccttccccagtgcttcaccaggagggcctagccacacttctctagcctgaccctcttcctcgcttatgcatgcctagtgccttcaattttctcctcttaaatctaaactctttcatattcctacctctaccactcagagaagaattgattgacaagaaaacagagagtgcagtatctcagatgcagtctgtgattgaacttggaagagtgatcagagaccgaaaaactattcccataaaggtttgaaattttacttctattttacatggcacagacctaaattaattaagtgtttggaatgcttttttaatatagagagcttccaccaatggcctttttccttttctgcagtgagggtgtgaatgacttagtactagtccagcctgactagagcttgagattcaaataaacatttaatattccatttttctgcagttttagaggactggctgctgagtgaactttcccctcccttttcctcctagtatcctttgaaagaaattgtggttatccatcaagatccagaagctcttaaagatatcaagtctttggagaagtatatcattgaggtaaggtagatgatttgtctgtttttggtacagatagacttagaacattattttgatgaataatcctcaaagtacatattgactctataatttatttttattagtatagtcataacaaatgtaataatccatattttacactgtgcttggaatcaacataaatttgttgtaattcttttaaaaatatttcaagatcaatgaatttctttacctatcatctatcatcttcattcacttccctgaagttctgttcttttctgtcctgtcctttccttttccttttcccttactttacttttctttcttttctttcgacagagtctctcactctgtcatccaggctagagtgcagtagtgccttaccacaacctccacctcctgggttcaagcgattctcctgtctcagcctcccgagtagctgggattacaggcacccgccaccatgcccagctaacttttgtatttttagtagagaatggggtttcatcatgttggccaggttggtctcaaactcctgacctcaagtgatctgcccgccttggcctcccaaagtgctgggattacaggcatgagccactgtgcctggccttctgaagtactttttgataactaccaaagaaactttgttcctccaaattatgcaagtgacaagtaccctcgcatgtaaaaagtcgaagcaatagcatagggagcctctctccaccccatttctccctggagtctcacttcctggctgcttcataatttatttaattactgtcccgttgtttgacatttaggtttctgattacaaacaaaagctttgtgtgtacatatatgcatatatcagtgtatggatattggatagattccagaagtggagttttggggtcaaagtttatagtgtcagttgtcttcctaaacatttttattccatgatattttaaaacatctttattccatgatgttttaaaaacgcatatgttttacctcatcttctttgtgatgatagaaaacaaatattttttaaaatttcattgtttattcttttcacaggtgatatttaaaatcattattatagaaaatgttaatttctatatttggttttcagttgcttgaaagttgcagagaaatattagaaaccaaaagttagattttaaattctgacattagtacctgtggctatgcataaaatagaaattttttttttttttttttttttttttgtgacagggtctcgctctgtcacccaggctggagtgcagtgatgtgatcttggctcactacagcctccatctcctgggctcgggcaatcctcccacctcagcctcccaagtggcggagattaggcatagtagtacaggcttttgtagagatggggtttcgccatgttgcccgggctggtctctaactcctgagctcaagtgatcctcccacctcgatctcccgaagtgctaagattacaagtttgcgccaccacacccagctgaaaaattttgaaattaactacttcacttaaaatgagattaattaatgtagctaaatataatggcaaaactaaacattccgtattatttgcttcaagctgttctcattttcccatccgctactgtgccatcaccatccctgccgcatcagtaatcctcagtagcatgactgaagcatgaagtgttctgtttaactgatcttctgcttagttaatagttaaccttgtggtactctgcaattgcttgcacaaaggttacctctgagggatgaggtttatatttctgggtctggagtcctttttctgttatgctcaactgtcttgatagatcttcataacaagcattttcttcttaccatacaaatcactggtttttaagcatatttatagaatggtacaactatcaccatagttttagaacattttcctcgtcccagaaagaaagccagtattcattaacattcacaaaccattttcccctcaatatctgaccatttcctggcatccacgaacctatttgctatctctggatttgccttctctggacatttcatataagtggaatcatacaatttgtaatctttatgtctggcgtgtttcacctagcataatgtttcacattaatttatgttgtagcacatatgagtgcttcagtccttcatattgccaaatactctattgcatgtgtatgctgcattttgtttatccattcacagttgatggacacttgaagtgttcttgctttctggcagttaggaataatgctgctgtggacctacatttttgtgtgaacatatgttttcatttctcatttttgtttcctcttgtgcattaactgtaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactggtaggtgtctacacagacaagggcaccatttatgtcctgagtctgagggatactttttaggctactgtttgacttttaatatcacatcctttcctttcctgtcctgtcgtgtcccgtcgtgtcctgtcctttcctttcctttccttactctcttctcttttctctcttctctcttctcttttcttgacagaatctcgctctgtcatccatcctggagcacagtggcgcgatcttggctcactgcaacctctgcctcccaggttcaagtgattctcctgcctcagcctcccaagtagctgggattacaggcacgtagtaccatgcctggctaatttttgtatttttggtagaaacagggtttcaccatgttggccaggctggtctctaactcctgacctcaggtgatccacccgccttcggtcccccaaattgctgggattacaggtgtgtgccactgcaccggtccatccttttcttaagtaaaactttttttcctgttgataaaaatgtttattataaataattcttacagtttagaaagaaaatagctgggcacagaggctcacatctgtaatcccagcggctcacatctgtaatcccagcattttgggaggcccagttggatagatcacttgagatcactacaggcacatactaccacacttagccagatgtggtggtatgtgcctgccatcccagttactctggaggctgaggtgggaggatccctggagcctagggtgattttgtccttactttcatggtgcttgctgacattgaagatttgggaaaataattatggttttgataagtgttataaagggaaggtgtagggtaacataaaaacatgtgggggtacctaaccaaatgatgggattaggaaagggaaatcagccccatcttgctacccctatacagagcatttcagggtgcccagaaatttgcagctctgccatgattagaatcatacatggtctgagtgtggctgtctgacatcctgtaactatcctggggcacaagctgtttattgttacggcttcctctgaagttgaaaatcataagctaggagatgtcttgagaagagagatttgaggattcataaatcagatgggggaactgtccctaagattctccaaatatttagatagaattaataaaacataagacatcagcagctaaacctcaagttattactaattactaatcaactcaaaatattaaaataacaaagtgttacgagccttcaagccacaaatctaaattgttcgccagatagccaaagcatcaaaaattcctgagatggctgggggtggtgactcatgcctgtaatcccagcactttgggaggccgaggcgggcagatcacgaaatcaggagattgagactgtcctggctaacacggtgaaaccccgtctctgctaaaaacacacacacacacacaaaattagccaggtgtggtggcaggcgcctgtagttccagctactcaggagactgaggccggggaatggcgtgaacccaggaggcagagcttgcagtgagccgagatcctgccactgcactgcagcctgggtgacaaagcaagactctgtctcaaaaaaaaaaaaaaaattcctgggctaaaccttatttgaaattgaaagcctagtttctgagcgtactgttctgcactgatggaaaacaagatcatcttcagaacacagagacaaagtaaacataaaaatgacacccgggtgctcagagcccaagaaggtcatcatcagtgacaacagtgggcctccctatcagcgggggtgttaacatcagcagctgttcacatttctgcctcccctgaacaggcatgatgctcagtactacacactgcccgtctcattttagcctcaccacaccttgctcagcaggtagcagaacaccatgtcatacaaccagcaaatagtggacctaagttcactttctctttaaagactgtattttcttcatgacatcctgctgctctgtgtttatggtgagcatttgttgcctcttggtgccttcccttagctttgtcatgtctttggacctgagagtttatataaaacagtagatactggtgatgacttaactgtcttcaaggtagcatagtgtaatctaaagaaagtttgtcatgtcttggctacaaccatgacatgagtcagagggaaatgatctcttgaagcctctgtggctttgttattgtgaaattttaatcaagaaggggcataatacacgggtagtggggcagcttgaagaggaggggaagctgattaacagtgtagctgcttctccatagggaccattgttgtggaaggccatgaattgcacgatgaagacatccgcctcatgtacacctttgatcaggccacaggtgggactgcgcaatttgaagcacactcagatgctcaggtatttttctgtttcctagaacatttctttaccaagagatgagagcataagaggagaaagtatttgcctgtgcctttcctgataatgttgacagcttgtctcagggtaaaataaaccagttacttggtttagattggctttattaaactaatatattattatgcccttaacatatgcatttgtttagtgaatacataagtaagcattttgtgatttctacatgtcagtcattgtcccaagtgtggggttgcacaaaaatgaacccttcaaggaatgagtcagtcaaggacacctgaaattaagccagttcttagtattctacctgataagttatctggtagaaataagtacacagagggctcctatccaaaaataggtgtagggtgaaaagtggtcagggaacactcttttcaagagaatatacaaactgttttagattccaggatcaatattttttgccatattggagaagagactatctctttgcagtcctgaccagacatccccagtcagcatagttgtaagatctcgcatgtgggtttggggatattgcaggggtccctctgtgcttagcataccatgtgcaggggaaggtagagcagcacctccatgaaaggaaggtcgacctcctcagtcctttacccaggcgcttaagttagatgtgtacagaactctacgtgggaagacagtggcaaggagtcggaggtatcgtagctgggaaagaaggcagggaggaggtttctaaacactgacagtgggcagttcttcctcattacagcagatgttaggggcctgaaaagttgtccaccttacaaaagtgtcatgtgatgcttctgagtttcttgacatggcttacatgttgtagtggccctgcactgactggaattttgagtttatcatgcatttcactacctctgatgcctttatgaagtgagtcatttcttaacttctctgtttactcaaaggtaaatgagatgatgcctaatgtacaagtcttttgtagagtatattttactctgcaacatgctgtgtaacagaagcgatagtgtcattattgctacatcataatcagcaaccttcagaatagatgagatagaaacattaaccttagcaaaaatatggcagtttaagtcacagaaagttttgtggtccattgtagaatttgtcttgagtcgttctgacaaacctgaagatcacaggggtcatggtataggaaagtcacttggagttgactgcgctgaggccgttgatccacttgttgtggcctgaaaagctgtgctgctccaagggcttcatgattattgatcttacttattagaagagttgatattacttcttagatggccaaaaagcagagtcatgtgagggactctgataagaggtggtcccagggcatctcctgtgagcagcaccctacaaaaaaacaagaaacaaaaacctgcacacctttctccagagacagaggactagctgattatgaagaagtacctgaatgataaactagattaattttattgcttttgctcatttgtgtgaaaaaatagtgctgcattatagactctccagatttaaataacattttgctgagttgggaagaagtgtttctccttatttgattgtcatggtgtgcactgttcattcccacaggctttggtcctcttagatgtcactcctgaccagtcaatggtagatgaaggaatggctcgggaagtcatcaatcgcatacagaaacttcgcaaaaaggttagtttgtcagttaagaataagctactgttttggctttttgtttgttttggttgtttggagaagataggagaggcaggtaatataaaccatagtgatcaatgcataacaatcactaatccatagtccatttggaatgtattctgcagaaaagtcactcctcttcctctccccacgtgttcactcccaagtcgtagctttcagccagcctgtgccttttcccatccttttttttagctccgttgggcttctacagaatatcccctgtgactggagcagaaggtaatcagagctgatagtgtctttgcagaagggcagaggtgcagtcagcatagacaggcttctagcttaggggagattcccggatttggacagagttgggtagtttttccttattagagagctgaggaatatgcagggagctcatcctggagcgcagaggggctgcaaagcccctgctagtgagagaatcaggaatttcttgccctgtagagggcagtgacagctaacatacatctttcttcccagacggttcaaggtctgaggaggctgttccagcagatgagtgggtgcttgtgacctctgaatcagttcagagctttgtaagtgggttctaagtaatttcttggtttcaacattcatgaggtactgattgttctaggaaaagaaacatgccctatcccccaaagagtggtgaaaaagacacaaagttaatcatgtactgagtgcagttagtcttacggatcacccagcagggagggaagggtgactgcccttctgtgatgattcagcatgggatctgtagcccttgttcaacagtaccttccttcagttctgattaatagaatgtacttcccttttaaatttttctgtgtgtgttttcagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacaggtgagtcctgagttccactgaactactactaaagggtttcagattaggtttgactttgtgtactcacgtgttgatattctgtcccacagtagagatcggcacagcactctgtcttgaagtattgctctggacagtagtgggtagagtcagagagtggaagctcagaaaagatggagcagggagggaagatggaactgttttcacaacagttctcttgaggaaggtagccaggagggtacatgagctttgcccggaaataaaatggcctgttttttctaaaactagaaaaggcagtgtgtggattctggtaattatcattaaaagtaaatagcaattggcttgaaaaacatttaactcttctggtagtgggttctccataaaagtacagtacaaaaaaagaaagattacaatagcatttctgttgttacatctaggaattttagatatacttatgaaagtatgatattaaggtagggaagatattggcttataacttagaagtagatcatttagactgggcacagtggctcacacctgtaatcccagcactttgggaggccaaggcgagcagatcgcttgaggtcaagagtgcgagaccagcctgggctggtgaaaccccatctctactaaaaatacgaaaattagctgggcatggtggtacacgcctgtaatcccagctactcgggaggctgaggcagaagaatcgcttgaacacaggaggtggaggttgcagtgagccgagattgcatcactgcactcgatcctgggcgacagagcaagaccctgtctcaaaaaaaaaaagttgatcatttaaaatatacctcagtcacttgcttaatcatttgctccggtctcattctatgagacaagtaggacaagacaaggaggggctgatgatggctgtttattttttcagtgaggcgagttgcagtgtagtttcattttgtattttgcatattgtgtaattatttgactttttttaagtgagcatatatttttaagaaaccaggataagaagagaagaaaaatgggatataaattgtagcttttgatactttgagtaatgagattgaatatgttatcaattgtgtacagctcttgttgttactgagaagtcactgtgttacacgatggtgtggcacattgcagtcaggtgccacagttactcagtcatacgttctcatgtgctcagttgaagggatctgaactggaaattacactcaccagaggatcttcccttcctggtcctgcttgtgcatatgtcaatcttaacatttgtgcaaatggcagtgaacaaggtaagagtaaattccatgatttgtgtgacttttttttagttatacttatggatgtgaaaaaacaaccaaaaaaacttatggatgtttttaagagaattggaataattatttaatcatgtttaatagataactttttcttcttgtcatcaaaatgaattcactaggcgagatgcagtggatcattcctgaaatctaccacttttggaagccaaggtgagaggattgcttgaggccaagagttcaagactaaccttgccaacataataagatcctgcctcaattaaaaaaaaaaaaagggccaggcatggtagctcacacctgtaatcccagcactttggaaggcggaggctggtggattacttgaggtcaggagttcaagacctgataaacatggtgaaaccctgtctctactaaaaataccaaaattagccaggcatggtggcaggtacctataatcccagctactcaggaggctgaggcatgagaatttcttgaacccgggaggtggaggttgcagtgagctgagattgcaccattgcactccagcctgggtgacaaagcaagactgtctcaccaaaaaaaaaaagaaaagaaaaatgaatccactaaagtaaatgattggacttatgcttgtggaagcatgaagcagatacagttttccctattcctcctgctaaatacatctaaacaccctggatattacatgtaaaaacaagcataagaagactctcaaagatgtaaggaagaaagcagaccacctaaggaccttgtaaccaagtgacctaaaagtagtaagttcagggttttcttttctgcctcgtatacccaaagttggaactgaagaagctggcaacctggaaatgtcaagtacagaccaaagaaagcctcaacaaaaattctgctcccttgacaaaggatcaagagatgggcagcctagcaagacagaaaattttgaaacagtaactgctctactctagccagacaccatagaaaaaactatggccccaccaccacccacattagcaaaggccaagtggggagcctggacttcacccttgccaagctgaagacccctcccctgtcacaggggtatcagagaagacaaagtaggaagctgggactttcatcctagtggggggcagtaatgagcccctctgcccggtggcatcagtggaggccacatggaaagcctagatttccatcccttctgggcagtaacaaggcatccctcccatttacaaatgcatggcagcagtgaggccacacaccacgagcaactcctctgtagtgtcagttaaggtatgcgtgaaacccaaacaggataaacccaaaagaatccacatctacatatatcataatcaaacttttgaaaaccaaagacaaaaaaagtcttgtgtgcagtgaaaaagatataacacctaacttacaggggaagaacaaatgatattggatttttcatcaggaactacagaggccagaaaatgaaaaggcagcatttttcaagtgctgaaagataagtattgtctaccaagaattccatatcaatcagaaatacccttcaggatgatgggaaaataaagacattctcaagtgaaagaaaactaaaagaatccgttcccagcagaccagtcctaaaagagtagctaaaggatgttcttaccacagaaaggaaataatgaaagagggaatccagaaacatcaggaaggaaaaaagaaaaatggaaaatcaaaatggagggtaattcaatagactttcattactctcatgggtccagcaagcactatatcattgttcgatgtggttctctgtgtatatacactaaggcctcaacatcatcagtgagttcttgggtcctgcaactttaagtgaagtgatgtactgtgtgccatgggaacttaactcctgtggtaaagttggtttattatatagtacatcattctgcttgaagtcacagtttccaagaacctaccagcaacattaaggatttactgaacaagaaataatagttaagacaattacaaaggagcgaggtttctacatttgtcacaaaccggtaaaatattgacaccagtggaccttaggaagttatgtttatgttaggtactacttggagttaccactaagaaaagactataccacaggatacatataaaaccctagaaaaataaaaaatggaactctaaaatatgttttaagtaactgtattagtccatttttcattgctataaaggaatacctgaggctggctagtttataaagaaggtttatttggctcacagctctgcaggctgtatgagaagcacggcacaagcatctgcttctgttgagggcctcaagaagcttttactctgctttacagaagatgaagtgggagcaagtgtatcacatgatgaagagagggagcaagatagaagccaggctcttttaaataaccagctatcgcatgaacgaacagagtgagaactcactcattactgcaacaagggtaccaagccattcatgagggatcggcaccagtgacccaaacacctcccactaagccccactttcccacattgaggatcacatttcaacatgagagttggaggagacaaatatccaaactatatcagtaacccacaagaagctaggagagaaaatcagaacaaatatgccaggcacagtggctcacgcctgtaatcccaacactggaaggccaaggcaggcggatcacctgaggtcaagagttcaagaccagcctggccaacataatgaaaccccacctctactaaaaatacaaaaattagccaggcttggtggcgggcgcctatagtcccagctactcaggaggctgagacaggagaatcgcttgaacccgggaggcggaggttgcagtgagccaagatcacgctcctatactctatactgggtgacagagcgagactctgtctcaaaaaaacaagcagaacaaatgaaagattggcatattgttaaaaacacattagccaagtatatgctgtctataacaaacttctaatataatgatacaggtgagttgaaagtaaaagggtagaaaaatatatactatgcaaacattaatcaaaagaagcaggaatggtcatgtttgtattagatgaaacagacttcagagcaaagaaaattaccaggggcattaaataatgatagaagtgtcagtacacaaagaaaacagtgatcctaaatttatatgcgtctaacaaaagagttacaaaatacatgaaataaaaagatacagacattaaaggagaaatagacaaatctacaactatagttggagacttcaaagtacctttttcagtaatcaatagaccagttagaacacctcagccaaaaatagcagaatataaattatttttgagctctcacagaactttgctgagatacattataacctgggccataaaacaaacctcaaccaattaatacagttgaaaccagagtgtgctctctgaccacagtagaatcaaactattaattagtaatataataatgaaaatctccacactcttaaaaataaacaacatgcttttaaattatccatgattagggaagaagtctcaagagggaaagaaacatagaactgagtgtaaaggaaaatacgacatcaaaatatgtggaatgtggctaaagcagtcctgagacggaaatctgttgcactaaaaactgaaagaaagatggtttcaagtcataacctaaggtctaaactcaagaaactagataggaaaaaaaggcagaataaatgcaaagtaagaagaaggaaaaacataaaaataagagatcagtgcaattgaaaacaaaaacgatagagaaaattaatgatacagaaatctggttcttacccaaaaattcagcaaaattaataaacctctagtgagactaataaagaaaaagaagacacagttgcatatcaggaataaaaagaattattgatacagattgccaaaatcaaaaacgcaaatactatgaataaatctccatatgtaagtttgacaacttggatgcttgtcgcccaggctggacagtgcagtgatgccaactcagctcactgcaacctccacctcctgggttcaagtgattctcatgcctcagcctcccgagtagctgggattccaggtgtgccacaccacgcctgatgaatttttgtatttttttgtagagacggggtttcaccctgttggccagtctggtctcaaactcctggcctcaagtggtctggccttctttggcctcccaaaatgctgggattacaggtttgagccactgttcctggcctgaagtgaaccctgtttctaaaaaacacaaactactacaactcacacaatatcaaacagataattttaatggccctataattattaaggagatgaatttgtaatttaaaatctctgaactaatctccaggcccagtttcactggagaattcttaccagaattaacaccagttgtacacagactcttccagaaaatagaagaggaaggaacatttcactcattttatgtggttattaacctgctaccaaaaccagataaagacagtattaacaaaaaagataggctgggcacggtggcttatgcctgtaatctcagcactttgggaggccaaggcgggtgggtcacctgaggtcaggagttggagaccagcctggccaacatggtgaaacaccatctctactaaaaatacaaaaattagccaagcctggtggcgggcgcctgtaatctcagcctactcgggaggctgaggcaggagaattgctgtaacctgggaggcagaggttgcagtgagctgagatcgtgccattgcactccagcccaggccgacaacagcgagactctgtctcaaaaaagaaaaaaaaaagatagaaaacagatattccacatgaatataaatgtaaaattcttcccaataaattattaaatagaattcagctatgtatacaaagaattatgcaccatcaccaagtgggatttattccagggatgcaaggctgattcaatatttaaaaatcaatctagtccaggcgaggtgggtcacgcctgtaatcccagcactttgggaggctgaggcgggtggatcacaaggtcaggagttcaagaccagcctgaccaacatggtgaaaccctgtctctactaaaaatacaaaaattagccgggcatggtggcgcgtgcctgtaatcccagctactcaggagagtaggattattgaggcaggagaattgcttgaacctgggaggcagaggttgcagtgagccaagatcgcaccactgtgctccagcctgggcgacagagggagactccatctcaaaaaaaaaaaaaaaaaaaaaatcaatgtaattatcgtattgtcagactaaaagattacatgagtatagcagttgattcataaaaagcatttgatcaaattcaacacccattcatgatgaaaatcctcacaaaaataggaagagatgagacctttgtggactggataatgagcattttgcaaaaatcctacagctaccattatacctaatggggaaagcctgaattctttctacctaaaatcaggaacaaggcaatcacaactcatattcgacattgtactggaagttctagccagtggaccacggcatgacgaggaaataaaagtcatgcagataaagaaaggaataaagctgactctatagaaaatcataaggaacatacatacaaacacctgaaaaaataagccaggcttggtggctcacgcctgtaatcccactttgggagctaaggcaggcagatcacctgaggtcaggagttcaagaccagcccggccaacatggtgaaaccctgtcgaaaaaatataaagaattaggtgtgatggcggtcacctgtactcccagctactcaggaggctgaggcaggagaatcacttgaacctgggaagcggaggttgcagtgagccgagatcgcgccattgtactgtagtttgggcaacaagaacgaactccatctcaaaaaaaaaaaaaaagctcatattgcctggttttaagatgtggcctgggatcaccatattgatcttcccatgccagctgctcccatgatggttgtgtgtttatttagacctgtgatgatgtctcagacagtacatggttccctgaactgctttgcaacttcagtgatgttgtatggcattgagctggtccatcactgccaacatcctggctgtctcaggttaccctgtagaaggaatcggatggtcagtggtgtgcatcagtaatgtaaacaagaacagtgttcttgtacagagggccagcagcatgagcagtgataagacaggtagggcctattttcccatctaccaactccaggactggccattcctgggtcagttgaccagacacctggaaagaagagctctcaactccaagattattttcttagtaatagctttaaatgcagccacagcttggtcgtctgccttaatatgatttgatatgttttgcaatttactgtcctgctgaaagcattcatattatgagggaaaaaaccatacaaatcatcgctaaatctgttatttttaaatgtttggcctttttctataccctttggattcaagcattaattgggtttccaaagtaattgaatagaaatcatattgcttataaaaaagaaaaaaacttttgagtcacaggatgtaagataaacatacaaaaatgaattttatttcataatagcaatctatactagcaatgaacaagtgggcaatgaaattaaaaatgtggtatcatttacagtcacttaaaaaaagatgctaggccaggcgtggtggttcacgcatgtattcccagcattttgggaggcttaggcaggaggattactttagcctgggagttcgagaccagcctcggcaacaaagtgagaccccgtctctacaagaaataaaaaactaggcaagtgtggtggtgttcgcctttagtcccagctacttgggaggctgaggttggaggattgcttgagcctgggagatggaggctgcagtgagccatgatcatgccactatactccagcctgggccacacagtgagaccttgtctccaaaaaaatattcagatgtaaacctaataaaacatgttgggacttgtatactgaaaacttcaaaatagtgatgaaaaaaatcagacaaaatctaagtaagtggagagacgtgtatggattagaagattcaatatagtaaaaatgtatcttctatcctgctgtggtttgagtgtgtcctccaaaactcaggttaaaatgtcattgccattgtgacagcatcatgaattagttaattacttcacaagagttatgataattcttacccagtccaatggtgtgatcttaacatcagaaacctgtacttgtcagagtcctttccattgcatctcctcaaagatgaaacactttagattcactgttgcttacaatagttttcaggaaagtgccagagtaaaacaattaactatcgttggatgacaagactttaaatggccatggttaaatatctaatgagagttcattatactaatgttgcaattgacaaggaagtttagttatttctgtggtatacagcattttaaggtaactagaattatgactgataacattagaccaggctatcagatttctaagaatttcacacaatttctggaacacattatttgtacaagttaaagaaggttaaacaacatttcttatttgacagcgcttcccatgcagatctaacgtagtcaaataagtctaacttgtttactgtttctcttcataatgaaagaaaattctcttgagatatttcagggggcctctgaaagctcccaaagttagcttgaggtcagaaagacttaagtttagagtttgattttgggaagctagtaaaaaatatcaaaggcttaaaacacttgattaataggattgcaggtcactgaagctacagtcactcatttaaccagagtgataattaaaaatatcaaaggcaaatatagaaagtcacaaagttataaaaagacctgagcagttttaatagagaggactctgtttctctgttttcttttctgtagagacagtgtctcactacactgcccagtctggtcttgaactcctggactcaagcaatcctcctacctcagcctcccaaagtgctggtattattaaggcttattaatttgataatttataaataaattcattcagaacttacccaggttgaccacacataaaattccttttccaagattcctcttccacaaacctactacaactttctcatacccttctgttttggattaaattcttcctcttactgtgaaacaagtcattctactataaggcaaaagttagtctttttctcttaacgaacacacatccttcatacttcatagcttcaccttaccaaaaccatgtcttttcctcacatacagaatcatttctcttattctagttataactgtcacatcagcattctatagattggcaaatctatgaatcaaatttgtagaaacatatgcttccttgtagtataatttatgttccactattaatgcttcagtattttatttggaaaatatctacatatccaatgaatattcatcatttaaattaacaaaacccctaggctgtaaattaccagtggggagctatttttgagtagacataacacaaacaaagctagctatcattaagttatttctctgttagctacttttacagcatgtgcatgttcggcagtcttcacaaaaacaagaatcctaaaaagtttaatagatgagattttttgtttttttgctgcactcgaaaaacgtgaagtaatggatactggcacccacttgcacattgttcataggttgaactcatagttgtataattataaatatgtagtggaggtaacataaacttatttgataataaatcctggtaggatttaaaagttgtatatctgcattatatattcttacccaagtcacatgaacttgaaaagcatgtgtgttggtttctatattgctgagagaatacttaatttatgtgaaatgcttatttttctttaaatcaattaaatagaaatcttttatgaattaatttttgaccataccatctggaggtagaaaaacatctcatggctgggtgcggtggctcacgcctgtaatcctagcccttttggaggccgatgcaggcagatcacctgaggtcaggagttcaagaccagcctgactaacatggagaaactccatctctactaaaaaaaaaaaaaaaacaaatacaaaattagctgggcatggtggcacatgtctgtaatcccagctactcgagaggctgaagtaggagaatcacttgaacccgggaagtggaggttgctgtgagccaagatcatgccattgcactccagcctgggcaacaagagcaaaactccgtctcaaaaaaaaaaaaaaaagaaaaaaataacacatatacgtaacatacctacatgcacaggcatgtataagcatacagataagcagatttcttagctttcatttgaaaactgtagccatgtgctaggtactataatataaaacacactagtttatgaaacaatagctggatcaaaagtatattcccagcagatggaataaattaaggttacttacttaggtggccaaagtgctctactagtatttttggaaaagtcttaagatttttcatttaaacattaaacaaagagttttaaagccttgacacaaaacactgtccttaaaagggaaaagtgatatattgaactaaatgaaaatttaggttttgctttgaacatcctataaaaggatgaaagacaagctacagactgggagaaaatctttataaaacaacatatttgacaaaagacatatctagaatacgtaaagatcttttaaatctcaacagtaaagaaaaatccagttagaaaatggggtagagatatgaacagacatttaccaaagggaatatacaaatgacagaaatgtccatgacaacatttaacgtcattagccgttaggaaaattcaagttgaaatcacattgaggtcttaatacacagctatcacaatgactaaaattgcaagtagtgacagcaccaaatgctgtatctcatacattgctggtgagaatatagaatggtatgatcactctggaaaatagttcggcagtatcagaaaactaaatatgtgctttctataatgactcgcagttgcactccctaggtgtttatcccagagaactgaaaactatgttcaccaccacatgaatgtatatagtacttatattcataatagcaccaaactatagatgacccagatattcttcagcagataaatggctaagcaaactggggtacatatcatagaacattacacagtaataaaaaggaacaactatcagcacagtaacttattttaatccttagaaattgatgccaactgaggccaggcacagttgctcatgcctgtaatcccagcactttgggaagccgaggcaggcagatcacctgaggtcaggagtttgagaccagcctggccaacatggtgaaaccccgtctctactgaaaaaatacaaaaattagccaggcgtggttgtgggtgcttgtaatcccagctacttgggaggttgaaacaggagaatctcttgaatccaggaggcagaggttgcggtgagccgaaatcgcactactgcattctagcctgagcgacaaagctaaactccatctcaaaaaaaaaaagaaaagaaaagaaattgttgccaaataaaaaaagtcccaaaaggttccatactgtatgattgcattcacataacatgttttaaatgataagattatagaaatggagactgtttgccagggattaaggagggaatgggcctgggagggaattgggtatggatattaaaaggcaacacgaggattctcatggtggcagaactactctgtatcttaatgatggtgatgggtacaggattttacacgagtgataaaattgcatagaactaaacatacccacgtgtacacatgccccagtgagtaaaagtaaaactgaggcaatctgaataggatcagtggattgcatcagtgtcaatatgctggttgtggtatacactgtagttttgtaaaatgtcaccattaggggaaactgggtaaggggcctgtggtatctcactacgtgcatttggctctacaattaactcaaaatgttcaaatatattaataaagtaaatatccgtacatgaatctaaggtgcagaataaatcaacatcaggggtcagatagtatttttaaccatcgtgacctgtgggaatatacatatggcacaaaatgaaaaatgacaatcataaataagaatcatgaatacaaaggtttaaatctagaaaaagacaagaacagattgcctggtagagttctatgcctggaccatagctaccaaggattgccaaaacacatgccaaggatggagatgtgtgtgtgtgtgtgtgtgtgtgtgtgtgtagtgtatatattgcatatacactatatatgtatatatatgtatatatatccatccttggtatgcttttatatgtatataataagctatatatacacatatatatagtgtatagttgggggaaaaggaaaaatattagggcttgaacccctttgtatcccttttcctccaaatgtaacattttctttttagttttatttgtctgattgaggtgttatttttgtggctttttaggtggagtattgctcctggaaaatccaaaaggtgacaataggttggaccttttaaagctgaagagtgttgtcactagcatttttggtgtgaaaaatacagagctggctgtcttccatgatgaaacaggtatgtggaaagtgagaggagcctacgtcctttgactcaagatggattggtgaaggtcttaatttgctgtcagttgtactatacaacttttgcatttttcctaactctcttgagtcagggcccaactcttcagcagtgcctgcctgcagtgtctattcatgcctcctcattgtgtcatgtgactgaaaaccctgggcttaatggatctaatctttccctctcacctgttagctagctggtggacttcaggcttcagagtcctctgttgtgaggttgtttttgtttttgagacagggtctcactctgtcacccatgctggagtacagtgatgcagtcatggctcactgcaccctcggcctcctgggctcaagtaatcctcctgccttgacctcccaagtaactgggactacaggcatgccaccaccatgcttggctaattttatttaatttttttggagagaccaagtcagtatattgcccagtctggtcttgaacccagggccttaagcagtccccctgccttggcctcccaaagtgccgagattccaggtgtgagctaccacacccaaccgtgagttttaactttattaaacacaatgcctggatctcactaagtctggattctcaataaagcaaacctgaaaaatttttaaagaattatagatgcattctcccgctgttacgtattgaattgtgacctctgaaaaaaaaaagattatgtcctaaccccttgtatctctaaatgtgacctgtggaaataggattatcgcagatgtaactagttaggatgaggtcatactggagtagcgtgggcccctaatccagtatgactgttgtcattataagaaggtggccatcgggctggtctccagctcctaaccgccagtgatccgccagccttggcctcctgaggtgccgggattgcagacggagtctcgttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcatctctgcctggctgccaatcgtctgggatgtgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccctgctgcctcgtccaggatgtgaggagcgtctctgcccggccgccccgtctgagaagtgaggagaccctctgcctggcaaccgccccgtctgagaagtgaggagcccctccgcccggcagccgccccgtctgagaagtgaggagcccctccgcctggccagccgccccgtccgggaggtgaggggcgcctctgcccggctgcccctactgggaagtgaggagcctctctgcctggccagccgccccgtccgggagggaggtgggggggtcagccccccgcccggccagccgccctgtccgggaggtgaggggcgcctctgcccggccgcccctactgggaagtgaggagcacctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaagaaggtggccatgtgaagacatagaaacacacggagaaaatgccatgtggtgacaaaggcagagattggagttacacacagctgcaagccaagaaacaaccaagattgccgggagcctccagaagctaggaagaggcaaaaaagaattcgcctacaggtttcagagggagcacatctgccaacactttaattttggacttctgacctccagaactttgagacagtacatttcttttatttttattccctagccccctgcagtttatgggactttactatggcagcctcagaaaactaatactcattttatgaatctgaatgctcattttcagaaacttttaaataacttaaaagaagaaatgcaaatggccaactaaggaacaactggtgcatcttaatggtaatcaggaacttgcaagatagtaccacagtgaggtactattaactgccaccagattggcaaaaactagaagaatctggcagactcaaatgttgtcagggatattgcataatgggaactctcattcactgctggattatgaattgttggaaccactggaaaactgtttgctattgtatccattaaaggttggataggagaagcaaaagcaatgtgggagaaaccaagtaaaattctacaagaaggtagcaagttagaggtctgagaaaaatctctaaccaggttccaccaaggtggtggataagtcagtggaaagctggatctctgcctaaagtcacggtaggatgagaagtagaaacgagcaaaaacaggctagagtgcacatctatctgacctcatcccacactgacaggtgccttgcagaagaaactgctggtacacttttccagagagttgcacacattcctggcctggaagttggaagagcagaggcaggagcgtgggctgctcactgtcccacttaacccaacaagttggcagattcacagcaacctgagaaagccaagggcacgggccccatgttagcctgtttagcataatgactgttactaaacttctaccttctaaatcctgtgtagatttgtctgtgatcaagccattacccagaaccaggtcagacagagaacctgggaaatagttttagcttagctgcattgacacaggatgaaaccaccatagttcaccccattgtgatcttgacatctatacatggctctttaaatcatatgtaacttccaaataaagaccctagtagattaaaaaaaaaaaaaaaaatcacacttttaactctttcttgtactgcttcaaagatgctaacttcattacccaaaacgagatagaaagttaccttatccttctttgggtgatgttgatttctcttctagctgagccatacatccctcttttgctgttctttaacttcactgaggtataaggttaacccgttaaaatatttcatgttatatggtaaggaaataagagagtggaaaaataagaattggctaatatatattaatacataatgccacacttcatttgctgaaaaatgagttctctggtcaagcgatgctatgtggaatgctgtgttggtaaataagacattctctacctccatggatggtgggtttgccagaagcattataggtgacagtggcaaatccttgtccaaaaggagtgtgtgttccagtaagaccaaagcactgccttttcccataatggaaacagtgcagtacaaccaagctgccatcaggagtctggcttgtctttcctggcaataacactgtatcgaaagctcaagtaatggttcccgctgttggtaggtgggatacgcagtagcagctgtagcaaaatcagccttagggagtggaagtaatgttgtggagcccgtggttattcttcctcccagtctgggtggcccctttgttcatcaatccattgggcaagggcaggagtggctggcggcagaatagaacatgtccactgattattattatttattttttattttttattttttgagacagggtctcactcgatcactcaggctggagtgcagtggctcaatcatagttcagtgtaacctcaaacttctgggctcaagcaatcctcccacctcagcctccaaagtaactaggagtacagacacatgccaccatgcctggctaattcttttcttttttgtagagaggaggtcttgctgtattgcccaggctcagtctcctggcctcaagcagtcctcccctttctgcctcccagagtgataggattacaggtgtgagccactgtgcccagcctcacccatttttagatcctcattcatagtctgcccatttgtagagatctgtccacatacctcttgccctaacttccttgtcaccagttttctaattctgttctttgagtccctggctgttctcgtttagtccagctattggccagtgtccatgaatcagtgtagatctactcctagctatttctgctgagcaaaatgaccagccggctgcactgaaagaagctgtgcccattgggaggatttccacccatcactattcttcagggctacccagagtcagaacagggccgttaagactgtaattgtctactttggatgatacagcgtattgtgcagtaaagccctacacagcaagccctaaaatgttttctttctctgccagccagtcctggaagacttcctacaaggccacacctgtggttgagagaagagaccatgtgggcctaggctgagcatgagcatctagccactggtgcagcagtttccttgttccctgagccagtgccccagcctagtctcatacctaccatttccactcaatatttggaggctgccctgtgggcctgtcctatatcacaaccattaccagtcatctgcctgcgcatgcatccccaagcaacgtttaatgttctctaaatgaaattacactgcatatgttctgtgtatcatgctttttttcacatctgctcctgagtcaaataacatcttctgactgtaattagcactttttaatgtaagtttttcatggtgaagcttgagattctgatataggaggaaattttaagaggagctgtattatacagagaaaatactaaaatagagaaaacaattagccctatatttcagattatgaatattatgatgtttgttttgcaacattgagatttcctaccattacatgtcattaaaggctggttttatagaaaaggcaatgtctcttgataaacagaaattaagtggaaagcattatcgtaaaaagatacatgatagttaaataggaaaaattgaatgacttcagttttgaatttgttcgttaaccctgaaagaattgttgttgttatttttagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaaggtatgtgcctccccacagcaggcagactgtggggtgctgggcattgaagttgtctttaatattcaaatatgtgtgtatttctagtcggcttcaaagtattgctttaaagtgtgggctctcacgcaactttggggagcaaccacaggcttttcttttggtgtgttatagagaccctcatccatctggcatggttaggaaatgaaaaaattggttaggtaaaaattacaactaaattgtttgagtgccaaaacattttaatctcaaattttactttcttttctgaggaaaaatgttctgaaaacttctatacctccatgccttaatcaacagactagattgatagtgatttttttcctgatattttaggatcctcattgtgcacatttgtactgaagtcttcgggctcctcacttcactgtgtactgagtatctgctccccaagctgctgggcttttatataagttttttttttttctttttccccttccccttcacctctatgaaatgttgagagctgtttctgcatggactgcatcttcagcggtcacactcacgctcctggacgcactgctggcctcagcactgcctgttagagctgtccgcagtggccacctcttttggagctagagggtgaactctcgagatttaatccagtttgttctgtcttccacagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcagggtaaggagattgtggaccgtaagttttttatttttgttgaaagtagattttgatgccattaaccatttgtagcatatacatgtaagatagtactattgttatcctgttttgttattctttccccagaaatttaccataatataattttcttttctttttttttttttttttttttttttgagactgagtctcactttgtctcccaggctggagtgcagtggcacgatcttggcttactgcaacctccgcctcctgggttcaggcctggggcttcaacccaggaacaaggattctcctgcctcagacttccgagtagctgggactacgggcgcctgccaccatggctggctcatttttggattttagtagagacggggtttcaccatgttggccaggctggtctcaaactcctgacctcaggtgatccgcccacctcggcctcccaaagtgctgggattacaggcgtgagccgtgatgcccggtcaataatataattttttaatagcaattaaaagtataattactttttgctaaatctaaaaactacattggtatgttattaaaaatacatgcttctaggtaaatcagcatatttgctgaccctaaaattgttctttcccccaaaagtcaaaattatcacagggttgtaaaatagcctgacattacagccttacagctgacattatacctccctttacagtttataaaacatgcttacctgcattttttccttgagacacgtaacactgtgaagagctagatcatcagttgacatattccacattctattatctagaaaatagaaattaaggatggcgacctgcacttacttgctggtgtcaggcagcttattttctcctcctcccgttctcccacttagcactattcacttctgagatttcagcttctgtggctgctctgtcaacttctctgttgacatcctcaccctaccctctgagtttcgttctgtaatcctgctacacatcagacatgttcactttaatattgctgccactgcaatcacttccccagacagcttccctttgtgggatctgtttttttctatttatacccattcttgacatctcaattcaagacttttaccatcccatccttttatttgtaacacctgatagcctgggatttattgggctttctgtgtcagtatttgtgtctttcggcacttgtggaaaattgccagacattatcttgtccaacttacctcttattcattctctctggtattctctccttctgacaccttgtttagacatattttagatggactttctcactctatcctacctcttattctcttttcctattttccctccttttgtccttatatactacattctggataattttggcttttttatcttacccttgttcctctgcaggtaaggtgctgcttttctctgcttccttgaagattttccctttgtcttttactttctgcagtttatgatttccctaggtgtacattttttggtataaggcagtgtttatttctgttacagtgttttggtttttttgttttgttttgttttgtttttgagacttggtcttgttctgtcacgcaggctgcagtgcagtggctcaatcacagctcactgcagcctcaaactcctgggatccagcgatcctcccacctcagcctccctagctaggactacaggcacgcgccaccatgcccagctaattttaaaatttttttgtagggacagggtcttgctataaggtcaaggctggtcttgaactcctgccttcaagtgatcctcccaccttggcctcccaaagcattgggattacaagcaagaaccaccacaccctgcctaatttctaccattttcattctattcgtgttttttgtttgtttgtttgtttgtttgtttgttttgagacagagtttcactcttgttgcccaggctggagtgcagtggcacgatatcccagctcgttgcaacctccacctcctgggttcaagcgattctcctgcctcagcctcccgagtagctggaattacaggcatgtgccaccatgtgcagataatttttgtaattttattttattatttttttatgattattatttttattattattatactttaagttttagggtacatgtgcacattgtgcaggttagttacatatgtatacatgtgccatgctggtgcgctgcacccactaactcgtcatctagcattaggtatatctcccaatgctatccctccccctccccccaccccacaacagtccccagagtgtgatattccccttcctgtgtccatgtgatctcattgttcatttcccacctatgagtgagaatatgcagtgtttggttttttgttcttgcgatagtttactgagaatgatgatttccaatttcatccatgtccctacaaaggacatgaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatgtacccagtaatgggatggctaggtcaaatggtatttccagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttttggctgcatacatgtcttcttttgagaagtgtctgttcatgtcctttgcccactttttgatggggttgtttgttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgatttttgtataaggtgtaaggaagggatccagtttcagctttctacatacggctagccagttttcccagcaccatttattaaatagggaatcctttccccattgcttgtttttctcaggtttgtcaaagatcagatagttgtagatacgtggcgttatttctgaggggctctgttctgttccattgatctatatctctattttggtaccagtaccatgctgttttggttactgtagccttgtagtatagtttgaagtcaggtagtgtgatgcctccagccttgttcttttggcttaggattgacttggcgttgcgggctcctttttggttccatatgaactttaaagtagttttttccaattctgtgaagaaaggcattggtagcttgatggggatggcattgaatctataaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttccaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttactgatttgcgtatattgaaccagccttgcatcccagggatgaagcccacttgatcatggtggataagctttttaatgtgctgctggattcgttttgccagtattttattgaggatttttgcatcaatgttcatcaaggatattggtctaaaattctcttttttggttgtgtctctgcctggctttggtatcagaatgatgctggcctcataaaaggagttagggaggattccctctttttctgttgattggaatagtttcagaaggaatggtaccagttcctccttgtacctctggtagaattcggctgtgaatccatctggtcctggactctttttggttggtaagctattgattattgccacaatttcagagtctgttattggtctattcagagattcaacttcttcctggtttagtcttgggagaatgtatgtgtcgaggaatttatccatttcttctagattttctagtttatttgcgtagaggtgtttgtagtattctctgatggtagtttgtatttctgtgggatcggtggtgatatcccctttatcattttgtattgcgtctatttgattctgctctctttttttctttattagtcttgctagtggtctgtcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtctcagagattctggtatgttgtgtctttgttctcattggtttcaaagaacatctttatttctgccttcattttgttatgtacccattagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttaatttggggtggagagttctgtagatgtctactaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgtttattttgctcgttagttgatgtagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttctcttatgaagcttagtttggctggatatgaaattctgggttgaaaattcttttctttaagaatgttgaatattggcccccactctcttctggcttgtagggtttctgccgagagatctgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgcctcgctagataggggaagttctcctggataatatcctgcagagtgttttccaacttggttccattctccccatcactttcaggtacaccagtcagacgtagatttggtcttttcacatagtcccatatttcttggaggctttactcatttcgttttattcttttttctctaaacttcccttctcgcttcatttcattcatttcatcttccatcgctgatattctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgtatgtcctcccatagctcagagtaatttgatcgtctgaagccctcttctctcagctcgtcaaagtcattctccatccagctttgttccgttgctggtgaggaactgtgttcctttggaggaggagaggcactctgctttttagagtttccagtttttctgttctgttttttccccatctttgtggttttatctacttttggtctttgatgatggtgacgtacagatgggtttttggtgtggatgtcctttctgtttgttagttttccttctgacagacaggaccctcaactgcaagtctgttggaataccctgccgtgtgaggtatcagtgtgcccctgctggggggtgcctcccagataggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcatgcaggcctccttgagctgtggtgggctccacccaattcgagcttcccggctgctttgtttacctaagcaagcctgggcaatggcgggcgcccctccccccagccttgctgccgccttgcagtttgatctcagactgctatgctagcaatcagcgagactccgtgggcgtaggaccctccgagctaggtgcggggtataatctcgtggtgcgccgttttttaagcccatcggaaaagcgcagtattcgggtgggagtgacccaattttccaggtgccgtccgtcacccctttctttgactcggaaagggaactccctgaccccttgcacttcccaagtgaggcaatgcctcgccctgcttcggctcgcgcacggtgcgtgcacccactgacctgcgcccactgtctggcactccctagtgagatgaacccggtacctcagatggaaattcagaaatcactgtcttctgcatcgctcaccctgggagttgtagaccggagctgttcctatttggccatcttggctcctcccccaatttttgtaattttagtagagacagggtttcaccatgttggccaggctggtctcaaactcctgacctcaggtgatccacccacttgggcctcccaaagtgctgggattacgggggtgagccaccacacccagaccattctattctttgagtttccgtctttctgtttacattgcccgtctgctctgcttgttctgttatgtttctgttgaagcccagttttaagaagcatacgtctagttccttggagacactgacaacccagacacactttaaactcaatcattttggaccatagggagaatgttaagaaagctgtgactgggtctgcgtggtggctcactcgtgtaatcccagcactttgggaggctgaggtgggcagagttcaagaccagcatggccaatatggtgaaaccccatctctactaaaattagctggacatggtggcacatgcctgtaatcccagctacttgggaggctgaggcaggagaatctcttgaacctgggaggcagaggttgcagtgtgctgagattgcatcactgcactccagcctgggcgacaagagttaaactccatctcaaaaaaaaaatctatggcattcccagtcatacacaaaggccaggagttgtgatggagacaggatctgtctatccctactccaaaacaaagctaagtgaggtgattttctctgtattggtttctgtggctgctgcaacaaatttccacaaatgggatggctcaagtcatctcacagctctggaggccagacactgaaattagggtgtcagaaaggccacagtctctctgaaggctctgtgggagaattccttatatacttcttctagcttatggtggcgccaggcatcccttgacttgtggccacatcacttcagtctctgactccgtggtcacattgcctccttctcttctgtttcctctttttccaaataaagtgaacattcacagctcctgggaatttagaacctgggcatatctttggaaggccattattaaccgattacattctcttcactttttctcttgtggtgaaggaacttactcaaattaacccttttgctatgggtttcttatttgaagttccagtttcttcagcagagatttgttggacttcccggtttgtatataccggaggcttttctttccctgctttcctagctctttagtgccaaaagcattaagccaccagaccccatgggagtcattatttttggcctctgtgtaattctcccgttttcttcctgtgcagcttttttttttaaatttagttgcatatcgtacttttaaattttctgtcatgatgttaaatactaaagctctatttcttcttgggttcctccttccctccctgggtttattttcagtgactctcctttgtcgttttccctctcatctcatcattgggcctcatcatccatctaagtcaccagtctgcagtctgtactcttcaccagagctatcttcatgaacattcctgccttgattttgttcccttgcttagagcccccaaagctccttattctcttatgcctcagaatcttcccttccacacaagatccttcctgctctgggccttccctgtcttgctaattctgtccatgagtctttcactctatcaaaggcttttttcactctccctcgaacacacttggctctttcattgtggtatggtagtaaagatcatctaataatgtagctttctattttgataagcttatataaaactttagagataattcttaactcttcttgtccctcaaatcctttggtcaccaagtactgttgtgcagtggagctgaagatgacatttatctctcacttgttcttgcaagcaaatgcagtggcatgattgaacctggtcaggggtagaaccatgtctgtatgaattatgtatttataatactacctgcaattcacagaaccattcttaacctgtgctgcctttctgtattctctttactctgtgacgttagttaggcaaaagtttagtgggtgagaacttttaaatgtttagtgatttatctaagattaccacaaagttggaactttttctaattcagtatctttccaatctagtatctatagcttcgttttcattatgccttttctctcagaattgtctttcataaagtatcaataacttggtaaattagaagagccacaaaatgttgaccattttagaaacccttagatgtcttcttgcttgctccactaaactctaaacatcatctccaggtcctgtaattatctattaaggaagtagctttgagagtattctcacatctaggattgctgctaggtaggacaagagctatttttaaaggaagctcatctgtttgctttaaattcagatctgactagaagcaaaatgctccacagtaggcagataactttaaattttctttttttttgtttttgagttgtatattcagtatatttcaatcaattgcatttgggttatatttttggatgctcagagttttcgtcattggccatattggatcctgtattctttaacatgatcctttgtctttggtaaattcttgctttctcacgtagcaacatgtcctaggcttattatgtacttttacttctccagacgtagaaaatagctgttcttcaaattatagagaatcatattttgaaaccacatatctgggatactgagttggcacagcctctaggctttttttgtagacataggaagtatctgtgtatgaggaaaaataaccatcttggcagtacccagagttagccaaactgtgaagtgatggcatagtcctccagaaggctccaggagtctgcccgatatctaactccacctgcaaggagtgaggattctactcagggaaagatccacacaagacccccatcactgctggcaccaactgcaagttccagggattttcctaaaccaccctcaggttcagtaacctgctaggaggactcagactcactaaaaggtattacactcatggtttgaattagggtagggaaaggatacacgttagaaccagcgagagtgagagagagagagagaccctggagtcatggataatgtttcttcctctcatcccttacatctgacaacacagagactatattaccaaccagggaagctcactcgagccttggtgtccagtttctgttgaggtttcattctgtaggcatgattgctgtctttctcaactgatataccatgtgacccaaagtccccatcctaaatcatatacttggtctttctgtcctggccagcactaccctgaattgtctcattagcaacaactgtcaggtttggtgaacatacccaccatgagaaacaaagattcctaccaggaaattccaaggatttagaggttcacctcaggagctgggacaaaaggcagaactcttaggataaggccaaattccttactacacaagcagttaacatttttttaaatattcacccccaataggtaaaatactgattttttttcaactttttctttccattctagaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaatcccaggtgataatttgagtcctcagagaagcagatgacatgacaaagttagatgtgcaagaatttattagaggaaacataaatggaggataaacgggagatggagcaagcgtaggtcgagagagccttcagactgcagtgtgggtctgacacctgtaaaaagagaaaatgaagattgattagcaaaaacttagactgcagtgcaactctaagatgaagtcttggtcaggccaatggagagttcccaagcaaggattccttttagtagagttcagaattgggcagaaatagcctggctttgtttctctgacttcctcaagtcagtttctgggaggagaccaaggggagcgtggccttcgcacaaatgccttgatggatctgaaagtaccaactacactcctcatgtcagattcttttgaagggagatctgaatgatacatccctatggctactacaacagatgcattcacacaaaaacccacaagttggagaaaatagaggaaacaaccagaacttggggaattggaaagcagatagacggtgttaactaacttggtagacccaggaaaccccaattctaaatcaatggaggaactgataaacttacttacatttcagaattcacagcaccagttaacctctgggatgaaaggtagaagaggcacagaaatagggacgattgcgtgaacactgggaagccttatagcttctcccatttccacgttgctaagcaactttattccccccacagttggcatctggaaggtaaaaagtgactggttggtagaagtcggagtgaatggaagacaagagtacttgtaagcctggaggattcctaaaaccaaccctcagcttagataatttgctagaaagactcagaactcaatgaaagctattgtattcgtggttacagttaatgacagggaaatgttaaagatcaaaatcagccaaaggaagaggagagggcagagcccgggagaagtaccaaacacagctcttgtcctgtctctctgaagtcagcaagcattactctactggcatcagtgtgtgacagtatgcacagagtattgccagccagggaagctcacccaagccttggaacccagagtgtttactgaggctgctttacatatccatgattgattgtccatgtggttaatcgcagtctctaggtcagctgctcgtgcatgacccaaaacctccaccctaaatcacattgttggtatttctgatgtgttgtacaccccccccaccataagactgtatagatttgtcccaccccagccataaatcatactgtcaaggctattcagtatgattcaagatccccaggtaaacagaggcattcctatgtagcataacatccaagggcaaggccaaattcctttatacagagtactgtactggaaacaagattaagtggctttatgtatactgtccactataccaaagaagaatataaaagattgacaccaagtattggctgggaaaaaggctcactctgaacaattaactttgaagttgagaagtccatactcaggtcagtgttttagcccccaactcttattcatgagacttccatctagaattacgagagatctagtgaaagcctctaatccaaaaccaaaagagagtaccaaaacaactttgaggaatcaagcaatgcagtgagaagaaaattccccctgccaaatgtgttaatatccttagagttataagatactacatctgtaaaataacgatgctacaaaacatgaaaatctcaagaggagaaaaaaatgttcctgttaatataagacttaatagaaaagaaaaaaaatcattggaaaatagtgtgaaattttccagacactagatagattaa

SEQ ID NO: 12054 - DNA, 3538 bp, Human
ggattgctcgagcctgggagttcgagaccagcctgggcaacagagtgagaccctgtctctacaaaaaagtttaaaaattggatgggcatggtggcacgcaccagtggtcccagctactcaggaggctgaggcgagaggattgcttgagcccagaaggttgaggctgcagtgagccgtgttcaccctactgcactctgtactctagcttgggcaagaccctgtttcaaaaaaaaaaaaagaaggcggcgagaaagaaatgagcatagagtgctggagaatggctactgaaaggtcaaataagatgaagccagagaaatgaccattgggtttagcagcatggatgtcactggctcagggacatggtggggagagaccccagactggagtgagttgaagagagaatagtaatagggaagtggagacaagctgaggctactctggagaaagtttactgtgcaaaggagcagaaaaatgggccagtaattggagagggtgatgaggtcaggtatagttgtgtgtggtggagagtagaggcaacataacaaaaatttaccatcataactatttttaaatgtacagttcagtggtaattaatacattcataatgttgtgtaaccatcaccattcatctccataactcctttcaccttgtaaaactgaaactctgtacctattccccattcccctctctgcccagcccctgacaaccacccttctactctctgtccctgcgattttgactaagtatctaatgtaagtggaatcacacagtatttgtttttttgtgattggcttatttcacatagtttaatgtcctcagggttcatctatgttgtagcatgtgtcagaatttctttcctttttggccgggcacagtggctcaggcctgtaatcccaacactttggaaggccgatcacttgaggtcaggagttcgagaccagcctggccaacatggtgaaaccccatctctactaaaaatacacaaattagctgggtgtggtggtgcatgcctgtagtccagctactcgggaggctcaggtgggagaatcgcttgaacctgggaggcagaggttgcagtgaaccaagatcacaacactgcactctagcctgggtgatagagtgagacccggtctcaaaaaaataaaaaatacatgaaaagttgtagggttgggtgtagactctggaaggtggattttgagagcacgacagtccacccaggctaaggagagagaagaagggtgcagtcatccagagaaccggaagtctgtcctcgcgtgctgaggagttggatgctagggccaggcgtaacctttgtctgtttgtctccagtgccagcaccagcgccaaccccccagcaggccccaccgcctccatccctggtccccttggaggctactgacagcctgctggagctgccgcacccactcctgcagcagactgaggaccagttcctgtccccgaccctggcgtgcagctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggctgacagcccctctgcctgcacagggacattggacactaggtgctgccctcagggcatggggtctcctcgcctttcctgccccagccggcagaagctgtgtggggagatatgaatggtacgggtgaggagtggataaggggtggtcctcaccttcctaatggaagctgggcctagggaggcccatccagtcttctgacttctgacctctcacaagaaggctgcaggtgaggtggccaagtccagggaaaggccctgctacctccttttgaggggtaattaggaccctcgacgtaccaagaagcacataatgcctttgtatttatttcaggttgagttgtttgtttgtcctccctgagttttagcagggaggttgttctagtttttagtgagacctctgcagacaggcccatcactgtccatgttccagggcaggtctgggtttccaagggaggggcccaggctacatccttggtttccccactgtggtgggggctgggactctgaggggctgtccagtctgctagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccat

SEQ ID NO: 12055 - DNA, 141454 bp, Human
  misc_feature (1)...(141454): n = A,T,C or G
aatattttattctgtgcgtagacagcgttggttaactaatcattttcatttccaaccatttatattgtgttcaaactacaatatactatgaatatttgtctatatgattattcatcttaatgttatcttccttaagctatgagtagcccttcaatgtccgggaatatacatctggttcaattctgaattactagcatctgtttggcttctaggtagtacatgagactgagtagcggctgagagcatgaacgtcgagtgtctctagtctcattttgtattctccacttgtaggcctgtagccttggtcaagttatttaaattccctttatctcctttatgaactggagataataatagcaccctccaggttgtattgagggttacctgaattaatatacacaaagtccttatgattgcacctttttattttgtaagcactgtgtaaatgcttcagtgtactatatatatataaaagtctgtgcccagaatatatttaaggaatgaataataaatcagaaaatgttttattgttgcttcatacaggtaacattttaaattcttttggattattttctctttggttcagtgacaatgttgtgagcaggtgctgggtcccaggtatcctgagataaataaaaattttgagcaattaattttcataagtgatgtcaagaagtaaagtatcatgaacatttctatggctccaattacactgatatttcaccttaggaactgaagctccgccagggcaggggcagcctctgagtttcgtactgctgtgcacctttagcagcacgggcacctgctggtttcatttccttcccactcacctgggcccttttcttatttcacatcttttttctccttttccttaaatgctttctctgaatcttgattcttgaaaataaattagtaggattcagttaggtaggaggaggagaaaagaagatgtgatgagcaagaagatgtgcgaagactcgtcagtctggtaggtggctttggttagggggtttcagaaatggggacaggtcatgaagggccttgccagtcaggaaaaatcatgaggcactagcagtaggaacacagcagaaggtgcctgaacaagagagatgacttaatgaaagcctttataacgcttcccgggatatattacagactaccatctacagtggcagagggcagctgaaggaaggctcttgcaaaaacttggggaaatggaaatgaatgaaggcaaatatttgttttgagattatttccttctatgtaacctattagttcttttattcgttccccatacatgtattgagtgcctactttgtgccaggcactgtgctaggcaatgggtatattaccagtggacaatacagatttagtcttgctgtcatgtcctgttgcttgctcatatgaatgtcagttcaagacagcaagagctcaggactgcggagatcgcatctacatcctgccgcgctctgtgccggcacagggtggttgcgaaaatcgtgcagtctgaattgattcaaggccttgcagcatgattgctaaatacgtcgagacaggaagaaagggcagggtggcaccgatctcaactgcgagagcacgatcttgcaatgagcgcatgtgtgcgcctcggtgtgtagtgaggggcgtagcttcccacagcgcctggcagcgtgccgagctgcgctgcaggactaaccctctcctttccccgcgcgctcaagcccgcacaggcggtggcagggagccgaaggggccgagcgcagccttgcatccgtccgcaggcgggcccggcgccgcgcctcctggcggcgggcgggaccgtccaggacgccgccccgcggccgcagctcctggaagcccagagcgccggtggatcgcgagccaaggcggcgggtggagcctgagccgtgaggccgtggccaatcgcgccgctccgggggaggagccccaaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggtgagtctcgcgccgccgtgagggctcagaagtcaccaagccgcagaatctcagggtagacggattcttagagatcctatcgttaaaccctcctactttacagaagaggaaactgaggcacagaacgaggcagcggctgggataggtcatactgctagttaggactggagcccggattcgaacccaaacgttcagagacccatctttgctttgcagggatttaagtaacgcggttgtgggacgtctgctcgttgccgcccccatcctcagccctttgaggggtctacccttgttttcctcctcaccgccccctccccgctaccaccccccgcccccatctcctccttggtttctccagaccgctgctggaagcgccgaggacagaaggaagcggtgtgtcccagcacgcccactcggtatcacgtcgctctcagcgcagagctgtgacagcctgggaaaatgctgcttgcagcctcactccctcttcccctgacctgctttctcagaaagatgccccttcagagggtgtcggaccagcttctggaggagcgcggggagagaggagcgaggcccgggcgccagtgacctcctatggtactgtttcttcccagccccggaggaagcggagctagtggccctgtggggcacagggtgcccctcacttgggaagagctgacttcatggaaccatagagccccttccctcttctaaatactgagagggagcaaggaagctgagttaaagagaaaatcacaaacataaaagcaaacttcggctgtttcctttaagagctagcccacagcctgtcttccctccaccttctggttgtgaaattgtgaaccagggcgccacgcgaagcattctgctgctctgctgtacagatccctggtttagctactggatgagaaagaggacttgagttttgactccagctcttccatgtattagcagtgtgaacttgggcaagttatctcacctttccgatactgggtttttcttttctttctttcttccttttttttttttccagccaaaaaatggagatttataatggtcacaatgagccctttgggtagttggaaggatgaaatgggatcattcaagtagcatgtttagcacagtgcctggcctggcatctggttggttcaaaaccaatggcaactattgtaaatattgttacatagtaaccttgcagacagtgggttttcagaaaggtgatttcataccatcttacagaggcattttaaaaaaatctgtaaatgtggtgtctttcttcttttgaatttgagcaactcttttataataagaattttctgaatgttgtccatatgtgatgtggatcatggatgcttagctcgaaatgtaaaattgatgtttctcggtgatatgaatttcctactagtttttaggtcaaacctcaggcctgtgaactgccctgatctgagacatcctttattgacaaagagggtcttgaaatgggtgagaggcagaaagacaagaagacaaagttggaagttgcagctgtgttacagattattctaagccttctatccttgctctcttaggtcagtcgagcaaccttacatttttcatctagtatcagaaaacaaacaaaattctcatatatttcttttggattgtacagagatgctgctaaatgcaaacctttctggacacaaacttgccttatttaaacacgaacacacagacattcacatgcccacactagtcttcctgtattattggtattttaaagttaaatggattccctcccacacccttaacccttctcatgacaattgattttattctgatgaacttcatgcaataatttactactatctactggctttgccatgcgtccttaaattgagtgtccagcatttgtagttggctgcctccttcacaggccatagcatttgtatgcagtattggtaagtgcttgagaacagagtgtgatacatcttgatggaagataagagcccagtggtgcccacttaagtacctcccgcaccaagcattagtaaaggatgggatcacctgcttctatcagcttgttccatgtacatgcattgtggtgagctggctgggatatgactgaatgtgtgcctgagagacaggggccttgtgggggaaaaggaaaatgttcaaaataaggtcagatcatgaggatggaagggagattaaaagctaattcctttggttctgattcttcaaagaaaggttggtcaattatacccatatcttcatacagattattacttgttaccaaaaccatatatatgtatagaactttaaaatttccaaagtgcattctgtatatatgatactccttgttactcacaatagccctgggaggacatggcaagaatattaatagaggaaggagcccaggttttgtggtcagacctacttgatttcaaattccagctctcatgcctgagtagttgggtgatattgagcagtttatttaatcatttgaagtttctgttttatccagttctaaaatggaaaaaaaaaatgcttactttaaaaatctgtataacgaataaattcaatagaataatgtcaagtacatgtagtgaataggtgctcattaaatgatatctcttcttagctagtctcaatttatttagaacataactggaatgagactcagagaaatgaaaagttgctagaggtcatgtgttagtatgtttcaactctgggaatacagttcacaccttttcatgtctagtttagggcatttcccatcacactctgtttcctcgccaatgagatatttaacaatttacttcagttataaagttgaccttatttgtctggttatttcaggatatcctttttgttgaaaagcaggtattttcttgcaaagagaacaatccttaagcacagttctgtagagtttagtggagccaactgtcataagagggtatttaaagcaatggtctctaagacaaccttcctactctcctgtgttggatgtaatacacctttgattcctaagagaaagggtactaactaagaagacataaagtacagaattatatcactcttttcttcctgttgtgagtggtttcttccctctgccatcctcatgctagttcaaaggctgggaagaagattgaacaacaaatgttatgagtgtccatggcattattcaacttttttttttgacaattttgtgggtactgagtagagtagacagaataatgtgcaaaggtggcatttgcagaaagagaccactgcttcctggtggtgctgattacttgtctggagtttcactcctccttgtggaaagtgatggctggaggctcatgttggaagatgaagggatctgtttctggcccaggcagtggggctgttcatctgctgagacttctcataggccattagatttctcttctttgtagcaagcacacaggcttgcaaacgcagatgtagaaggaacattttgctccttgcttttggcattttggagcatatgtttgctcctataggtaagcagttagcatcatcttacctggcacggttaggaaagcagaatgtggcttgaggaaatcagaggacgtagaaaaaaacaaagattatctccagcctatacacagcttcatttgttgctcaacttcatcaggcttttgctggtgacacagatgtaggatctggtgagtcactgttgccttgcccatgaaatattaaagagagccacctactgtgctctttgcccattttggaaattgttctgcatggaaaaaaaagaagaagaaaagaaaaaagaaacaccaaagaataggaaggttacagaacatttggtaagtgatatttcggtggataaattcaggttagccattcatttgctgccttttttttttttttaaatgataatgcatggtttacactgatagggttgttaggagacatccctttggtctgactttattctaactctctgtagcagctgtggtagtgtggattttgagagtctggctgaaatctgaggcaagttattctatagagatgatcttttggctctgcagctaggaaatagggacactgatgcctgcttagaagcttaagtccctatttatttcaacatcttattcatagaaaacatttaataaacactgattctgtcctctgctaacaactccttcaatgtattagtctgttaaattacgatcatcataatttaacaggtactctttacttgtctccatcattatttgtgctgagtatcttaaatatatcatctcattcaatcctcacaataatcctgtatatttttttaggaaaccgaggctcatagagttacgtagcatggcctatgtattagtctgtgttcatgctgctgataaagacagacccaagactgggcagtttgcaaaagaaagaggttcattggacttatagttccacatggctggggaggcctgacaatcatggcggaagtcaaggaggagcaagtcacatcttacgtggatggcagcaggccaaaaaagagaacttgtgcagagaaactctcattttgaaaactatctgatcttgtgagacccattcactatcacgagaatagcatgggacagacctaccccacatgattcaatcatctcccactgggtccctcccacaacatgtgggaattatgggagctacaagatgagatttgggtggggacacagagccaaaccatatcagcctgtgtaacagcacaaagcaagacatgatgctgagactcatctacgcattttattctagagttaggaagaacttccaattgtcccacctctggactagaactgaggacttagactaagaccaatgacctacccaatcatcatcctacatcctcatcccggtactaccttgcctgtgactgagaaatatctttacctttggacctaaaatgtgggagagctgaactagatgatctctaaatttcttctgctataacgcattgtgtatctttaagattcctttcaactttgagattctgtaatcacatctatttgcaaaagttaaagctaaaatggagaaaggggagtaaaaagaaaatactcttattgttttattccctggagatgtatttttctgaacaaacaaagatgagcaagagaaatcagcatttcatcggcacatgtacttttgtcatttcatttaaacataaaaataactctcagatatatattattatttgccttttacaaatgaaagaactgaggctcagagagacttatagacttgcccaaggtttcctaattagtaaagattggaacctgcgtgtgcctgagtgcaaagccttttggtccactacagcatatttactagataccacaccatgaaatttggaaactcatataaccagattcgtaaatgccccatctctgtatcctcacatcacactacctcagcttctgtcttctcctcttcttctactctttcctttccaaacatactgctccaatcctttcttgattctctccagctcacaaaaccccttttaaatgcatataacatcttctatctctattgttattattattattttttttactgtggtcctggaatttgtaatttgtgcttttgtttttgttcatccccattgggcacaggacagaataagctatgccatcagctgagagacttacaaatgtctctatctaatctgtgtgtcaatcatctttctatctagctctatttattagtgaaattaaagaaagatagagcatattaagcccctggctcttaatagttggcacctagaagggacttggtaaatattcattccttcctcatcattcagcactgctgtttacccaaatcattactcatttaatgaatctcagatggagagggggagtatattgagtagatgccccagctggtctaagagaatgtgccacagtttggcaagcaattgggatggtaaaggataggaaatgaatgtgatatttaccttaaaatatctgctgaggatatggtttattctgccctgtgcctagcacagtgactcatacataagaagggcaaaattgaacggatgatgggttcatattatgtcagtgggcccaaaattgactttctggatttctcgtgctttatcaatagtattagttgtgtcaaagtttgcctctacagactaataaagtagttttaatttcctttaattttgtggtcacaaaatcagacaatgataaggagtcataggctccaagaaagttagacattactagctcaatgatgggaaaacccatttctgtcctaataataaagggcattttgcagaaaacacggtgaaggatgatgctgaagtgcccgtttgcatatattgacagcaagaccagtgtcaagtatcataaataaattgccagagagaaagtaggaagtttccattgaagtgggcagctgcaatgagcttcgatctcaagatttctaaaagcattgaagaatttacatcacttcaactattattttctgttgaacatgagaacaggtaaccttttatgtctagtttatatccagcagatgcttgtgatttctacctttctggcacaaaagtcctcatgattacacggcttcctcctctgccaatcaatgctaatggcaagagaaatgagaagcagtcattttataagcattatgtctggaaatgttcctttcgttgatagcagtttcttaacgccagtatggttagatgctatggcaacttaaaattgtgtttccataatatagtggacattgatgtcaaactgatctgcctgggtttgactttggccgaattatttggtctatctttgccttatttttatgatctgtaaaatggggataataaaacccatcttgtcaggcctttggtaagtgtcaatcatatgccatgacatttgtcaagaggcttatgcatagggattttaacctctattacaattaacaacagcaatgagaattgttccattgcatgcccagatggatactaaattagaaaaagaaagatccaggttgaaataataacagcttttttttaatatagaactttaagtcgtcaaaatgcttgttattgtatatgcaaatgtatacacatgtaacattttttttttgcaataattctgaggtaatcagggcaggtgttgctaatgttttacatcatgagtctcaaaggggctacatatttactacagccaagcagctaataaatagtagaactgggacttggaccctagttttctaactccaagattatgtcattttttttttttttcctcagtcaatcagccctggtcctggttagttgcgtttccttctccagactccttgctttcaccccgaaaatgagcaatttggaaaatattatgtctaaggtagagtgttttataaatctgtgactgtagaacaatgtcttaggaggtatctcattggcctcggtgagaattacaaccgggtactgcacggagagtcagatccataaagaaccctttatgtccttaaggatgtgattctgccacattactctgacctacagatcattccccatctgccccatccccttcaggacccaggtttggggatgggaagaaaaagtagatgactcggttaggcacatggacatttaatatttgggaaatgataatagagcctttcttaaaaaaaaagcaagttctgtatcaccgttaatctccatagttttctacaacaaaataaaggagaaaatattttgctttagtttggattctagcgttgagtacacattttctgctttcttcttttgagctcttagtgcccacagaagaggcttgactctcattaaaatgtgagttctttctgtttatagaaatgatggagacttgagaatggtaatacacactaagtagcacttttctggaagattatacttcagtttcccaattacagagtgagacagtggtgggggcagcagattgaatgaatagagtagatcgtaagaagtaggctgagcttcggaatcaggctgggtttgaattctagatactgcatgcctagcctgtccagacttagttttctcacctgtaaaatggtaataaacatgcctgccttcctttgcttccttccttccttccttccttccttccttccttccttccttccttccttccttcctccctccctcccttcgttcctcttccttccttcctattatctatgtatctttctatgtatctatctatgtatctatgtatctatctatctatccatctatctatctatctatctatctctatttattaataaggttcaagtaagaaaaaatatattaagcctctagcttttaatagctggcacctagaaggcactcagtaaatattcattccttcctcttcattcagtgctgctgtttacccaaagcctctctcatttgatgaatctcagatggagagggggagtatatcaagtagatgccccagctggtctaagagaatgtgccacaatttggcaaacaattgggatggcaaaggataggaaatgaatgtaatatttaccttaaaatatctcagaatctttcatgtgtaggaggaattagaccagtgataaattgcagtgcatggatctttcacaacagaatcatgtggataccttctgaaatgagcagatatctaggatatctgcactgaaatctaagaatcactggattagaattttcagtactcagaggcaggatattgtaggggtttgaatttggattcaaattctgctccctcagtgtaaacctaaggaagttatttaacttttctatgttactcattgggttgtggggagaagtaagtaatttgatacatatgaagtgcctaaaacacagttttacttactgtataagccagtctttgaaataccttgcatgactttgtttaacttacattttatttcctctctaactaaatgtcctagataactacttggctaactctttcatttgcttaaagtctttttcaatatctcctcagggaagcctacttggattgcttgaatttgcatgggttggggtaggggaagcaggaatagggctgcttgctctctgaaatcctgatctcccttaccctactcttatttttcctttattctgtggcatttggtaccttataagcttacacatactattttattattttatttagtctatttttaaaatttaacttttattttaaattcaggggtacatgtgcaggtttgttacataggtaaccttgtgtcgtggggatttgttatacagattatttcattgcccaggtattaagcctagcacccattagtaatttttcctgattctctccctcctcccacctatcaccctccaatgggccccagtgtgtgttgttttcctttatgtgttcatgtgttctcatttagctcccaattctaagtgagaacatgcaggattaggttttctgttcctctcttagtttgctaaggataatggtccccagctctatccatgtttcggtaaaggacataatctcattcctttttatggctgcatagtattccacggtgtatatgtaccatattttctttatccagtgtaccaatgacgggcatttaggttgatttcatgtctttgctattgtgaatagtgctcagtgaacatacacatgcatatgtctttataatagaataatttatattcctttgggtgtatacccagtaatgagattgctgggttgagtggtatttctttttgtaggtctttgaggaattgccacactgtcttccacaatggttgaactgatttgtactcccagcaacagtgtatagtgttcctttttctctgcaaccttgccagcatctgttattttctgactttttaatagtagccattctgactggtgtgagatggtatctcgttgtagttttgatttgaatttctctaatgattagtgatgttttattcatatgcttgctggtttcatgtatgtctttggaaagggtctgttcatgtcctttgctcattttttctaaataggttgttttttcttgtaaatttgtttaggttccttctagatgctggatattagacctttgtcagaagcatagtttgcaaaatttttctcccattctgtaggttttctctttgctctgttgatcatttcttttgttgtgcacaagctctttaattagatcctatttgtcaatatttgcttttgttgcaactgcttttcgtgtcttcattatgaaaaatctttgcccattcctatgtccagaatggcactgcctaggttgtcttccagggttttaagtctttaatccatcctgagttaatttttacgtatgatgtaaggaaggggttcaatttcaatcttcttcatatggctagccagttaccccagcattatttattgaataggaaatcctttcctcatttcttattttttatttcacctccagtagattataaagtccacaaggacagggacacttgatttgcttattgctgtatcccaagtgcctagaatagtttctagcaaatagcaaatggccaataaggaggcaatgatacataaataagtatatggatagatgttagtgtgattatttgtccccaagaagtagaaagagatagaaccggataagacagtaaattatacatgtaatattcaaataaaatttgacatacatatatgcgcatatacacacatatatatacacatttacacacatacatatacatatgtatatataagtgtatgtgtgtatttttggagtgttgagtatatatttaaatattgaagtaataatttatgtctatgtacatatatatgtgtgtacatgtatatatgtgtatgtaaaaataagtgtctatttatctatatatttaggagtttttcaaagctacctgaggaaacagaggtgttgaagtgtttacttgttaggttgctatagtgataggaagaaagatgaaaatatgtacatatgagtcaagagacaacagacaaacagaagaaatagaagtgatttcaggacaagaaatgaaaggctaagattaaaacagcaaccaacattggagggacatagaagagggacagtttttaagtagactagtcagagaagtgatctccgagaaactgacatttgaactaagacaaaagcctgagaaggacccacgataggcctgaggtcgtcactgaggtggtgggccaagtaagagacagtgaagagctggaaataaggttctaagataggcaaggcctaggtcagactggtcttgcaggctatggtgaggagtttggattttacgcaaagtgtagcaggaagtcactgaacagacagaagcaggatgatgagcaggtcaaaggtgtttagagccttgaacagagagtgaaggaaaatggaagaacttatttataagatgagaagaccaactgctctgatttcatcatgtaggctgttatgaacagatgagaaagacaatttggtttcattgatgtttcattcataggctctcgttcccattagaacatttcaaaagggaaaacaaaaacccagctaaaatagggaaaacctatatattctagatgtggctttgctttttctcaaatgataccattcttatttccaaatgcattaagtaatggatggaaatgtatgcactattgctcaattcaattcagctggaaattttacagttcttgtgtaggtgttttatgtaatcaattccccaaaacactgaacctagagctatttccttaggaaactttagctaccagtttctgaaatctgtcgtagtgaagagtaagcatgtgaaaggcaaattaaattccatacaagatcaatttcttctttctgactctacaaatttaaatggtacctaactcttgaagaagtagcttacaggtcatctcttccgtgatgtgtttactgggcccgtgcacatataatctcatacatgcctcttcataatatgagtttaaaatagcttgataacatatgccagactccatttcaaattttctataaataatttctttttgaagtctcggaataaccgtatgtggcaggtgaagttataatcaccattttacacaagacaaaactgagacccggaatcacagagttgatcagtggtagtgtcaatattggaaattgagcaagcttaatcattatactattctgctctttgattgtaaaaagtaaacctgcacatttattcacctctatttgtcccacttactttgtggtgccttatatgaaggaatagttcaataagcgtattgaatcagtgaattaatctgtgacctattctttcaagttgtatcatttcattagcaaatagtgataaaaacgtgggttttagactgaggcaacctaggtagcagaaggtactcactacctctgtgatatggtaaaattactaacatctctaaacctctttcttcatctatgttgttggcacaaatgtagggccattgtgaggattacatgaagtgtgcatgtaaagcacttagcacagttcctggaacataattagagctgagtctatctgaactgtttttattattttttgaactaaaataacctcctcaaacatgattacaattatgtaccaggcagttttttagttgtgcttgttttattaactttcttttaaaaatcaaagccaaagattcaatcatataatcagtgatgttaattttgttccagggctcatcctggcatcctgccctcagcagggcatgcagtgtggattctgaaaggccctcttataggaaggaaggccagttctggagaacagcatgagagcaaaaggtgctgtgtgaccacgcttttttcctccatacatctgacatagctaaaggcagcacttccaaccttgcctgtctatctccctagcctggatctaccttgctggaaagttactttgtattccagcgatgatcccagagcattttgggtgacaaggaaaaaacagcagaagactaaagttttgccccagataacacttaatgaggttaatttacagaacttgctggaggtttaggacctaatattgatcctgtgcctcttgtgtaccaggagctgtgctgaatgtcttagtttcattatctcattcaatccttactgcagccatgtacaaattttagtcgtaaaccaaatttacaactaaaaaataaaaataaaaagtgacatgcttgacatgcttgcctctacgtgtgttttgcagggctgtggtgataaaatcaaatatttcttgtgttttgccacatttttctttgaaagcaaattttgcagcgttgcaacacctctggagtctccagggacctcccctgcagtgaagacacatttggcagagaaatgaggcaaaggttgcatgtggaaggcaggaagtttcattccagttgacagtttactttgacctggaagaagctggtaccaatgagctgagttctattttgtggattacatttgtttgcttctttgtagggaaccaatatggtgcttgtttacatttttttttttttttttttgcttttggtcttgttatgggatgtttaaaaggtgtaacttttatccttctacattttccaagtaaagttcagatgtttcgatattcctgacactatttgataaattattttaaggaaaggtctacacacacacacacacacacacacacacacacacacacacacacacgagaatggtgcctgattcataattggcactcactatatatttgctgaatgaatacataagaaaataaatgcatttcctttttcatctttctctctctgagaatgggaactgctgcaggatttttttaaatggcaagtttcaatatatacctttcttcttaaatgtttgctttaagaataatttcagaaggagattattctaaaatatggagcattacttaatcttagttatgcagcacagctaattggagtggactgtaattcctttggaatttattgaggtgagatcatttacttgtatactaaatggtcccagactgatatactgttaaatttgtgtagtctgattttcataaatttgctggcctttctctctcttattgtctgctaattctcattgcttttggcatgtctggctctccattccccatacaattaacagtttctactttactgcagactaggaagctgggtaatgaatttgttggaccgggcatataataagaatacatagctttgaatgtggactagagagactcttttccaaggtaaggaagttaaaagttatggctgctatagaaacagtcttcatataaggtgataccacacatagtaacactgggtttcagttgcctgcgttaataaaaagggaggcttggtagggataattcatttactcttttggacaataagcattttctgagaaacttctgtaggcaagacactggtgagatatagagaattaaaaaagcaaatacacaaacacaactgaaagataaaacatacacaggggtttataatacaatttatacagtatttcaaatagcatgagaatacataatgtactttgaaaagatatataaggtaataaaacatttttgtatttcagaggaaagacaattgtgtaactcaggaagggctttataaggaagttgtatttaaagtgagtcttgaagtgatggacaggttggacagagagagattggtaaggagaagtggtaaatgaattatggtctgaccggggtgagtgaatgatatggattgtgcgatttatcagagagagctacaattgtgggagagactgggcaactgaaggcctagggcaggatatttgggagatgagagaacagttaagaaatcctgagaaggcactggttaggaagtctgttgagggctgttgcctctgcctgtggcaggcagacagtcagaaatgaaatctggatgtgacgtggaaaaggacagattggagcccctgagtctctagtttgatgatataggtgttctgcagaagagattggtgctcttagccacggaatttcacatctgcctggcttcagacggaggagtttaaagggaagatctggcaggaattgaaagagcagtgggcagccaggcgcagtggctcagcctgtaatccccgcactttgggagggccgaggcaggtggatcatgaagtcaggagttcgagaccagcctggtcaagagaccagcctggccaacgtggtgaaaccccttctctactaaaaatacaaaaatggccgggcgtggtggctcatgcctgtaatcccagcactttgggaggccgaggcgggcagatcacgaggtcaagagatcaagaccatctggccaacatggtgaaaccccatctctactaaaaatacaaaaattagctgggtgtggtgacgcacgcctgtactcccagctccttgggaggctgaggcaggagaatcacttgaacccgggaggcggaggttgcagtgagccgagatcgcgccactgcactccagcctggcgacagagctagactgtctcaaaagaaaaaaaaaaaaaaaaatttagccgggcgtggtggcagtcacctgtaatcccagctactcgggaggctgaggcaggagaattgcttgaatccgggaggcggaggttgcagtgagccgaagatcacagcgccactgcactccagagtgggcaacagagcgagactctgactcaaaaaaaaaaaaaaaaagaaaagaaaaagaaagagcagtgggcctggctgctgccccatctaggaggtgagccagtgatcagcaacaacgtatgtgagttgcagtactacctagaggcctagacagaccctctgaataaagttctctatgggcagccctaacttggaaccataaagagtaaggaattctaggaaacatcattccagtttaactatttttgcacagttaggaaacagaagtgacttttatcttagagaaagggaagataatgaaaacataaagtgaaggagggaaacaggaacctgccctggagagagcccagtctgaccgggagataatatgtgaatacatcatcattgaatgcaaggaggcactattttttggggaccttaaatgctctgttaagaaattcatacttaatcctataagacatggagacacaatgaatattctcgagtaagggaggggcattatcagatctgtattttagatctggcttagagagggaataagtggggcaattaatgaggattctattataataatcaaggtggaaaatttgcattcccagaactttcttctgttctcactaaaggaggtgacccagagtcatcataagatgttctggaccattctgggaattaaaaatgctagtgtacattacaagccaaagtgatttcacctatggctgctattgtcaactccgatgcccttatggtatgcctagataactcttcttaaaaactccctgataagtttgcttctagtaggtgaagaacaaggagaagtgtatacacaattagaacatcggcttaaatgaaattggcttatgcaatcatgtcagtatcattttgagaggagagatcctataaaaacaaatacttattacgtagtaaattaagactttggggctttactgagtggtaacaacagtattctcttatgtgtatccaagtgcccaacaagttacagaccacttacatgttcattatctcatttgatttgataacagctctgcaaggtcagttttatctgaattattacaagtgaaaaaactgaagctcagaggttgtgatgaccatcaagtggccacttagccccgatgattcaagagctcattggtgttctatatattcaaagggcaccattctattgctcaactttccatttcgctctatgcaccactgcctgataatcttgggacatatctttgttcatgctgtgtccttgttctaaatccattcatcgctgggccctgttgctcacacctgcgatcttagcactttggggaactgaggtgggagggtcccttgagcctggaagtttgaggttacagtgagtctggactgtgccaccgtactctagcctgagcaacagagcaagaacctgtctgtaacaataataataataattaaaaaaaatccacccatagttcttggacattctcactttaaagatctctttccacccaaagaacaggctttttgtaacccaggtgttacaatttcagctgttctgtttcctcactttcctgaagtatttttactgcctttcctcaaagcacaggacaccaaacacagggtaaagaggaaagggttctttacaaaagcatacctgagtggataccttaacaccctcaggaaatctacacatctttgaattagggcattccataagtcttccctgtcagcacttcccggcacatactcctgaatgtttaaaaaccaaccatatctcttggcttcctacttgtcaagacacagctgaacttactcacttgtcttgacttatgtaaaacacacacttacagtcagtgctgtatcacctaagacttcaacagccagcagcaagtgaattaagaaaccgtaatatatcctccattcaatgcacccttgcagggttttgcacccctaaagagatccctagggcacatgaaatcgggtgactaccccagcttcttgctgtggggaatctagggtttttgtagttaatgatattgagacatggacttaggggaacaggaggaggcatatagaaatcaagctttcgcagcagccattaaatggaatacgtgtaatcgttctcaaagaatactagattgctggggccaaagaggctaaacctctggctttgcagaaaggcctcagaggaatatgttgtgtttataaagtcagccaaacctacctgtaactggctttctagttctggcatagtgcactttctggtatcatgctgcttctcttgtcttggttctcacacatgagttttggcctaattgctctagtttgagagagtcaaaggcaagtcttctagtaatgaggggaaaaaaggataatagctaacaagttgaagtgcttactgtgtgccaggtgctttacaaaattacctcatataatcatctttctttttttttttttttttttgagatggagccttgctctgtcgcccaggctggagtgcagtggcaccatctcggctcactgcaagcttcgcctcctgggttcacgccattctcctgcctcagcctcccgagtagctgggactacaggtgcccgccaccacgccctgctaattttttgtatttttagtagagacggggtttcaccgtgttagccaggatgttctcgatctcctgacctcgtgatctgcccgcctcggcctcccaaagtgctgggataatcatcttgtctaattccatgtgaggtgctttactgaccctgtccaccaataaggaaattgagagtcaatgtggttaagtagcttgtacagctgtggagaaggacctgaacccaggtctatatggctgtaaagctcatgatgaaaccccgtgctttgcctccctgtgctgaggcgtgccgtgcatcccatggcccctatccagtttgcttgcacgtacagctgaacatcttataacaggcgtttagttagtactctgatgtgtctgacagttccctagaagctcagcttggactgagccagcccatttgcgtttctggcctcttcttgcttccttttctcctttttcaatttcctttttcggctcaggcagcatgggagatgccttaatcaattgatgatagttccttctgttttaatgacattctcatttcctcagtatgtttttctcactttgagggttggagaggggagtaagggaacaaatactttcaaaaacccctagtctcctagttttgaaagtaagttccatgacgttatggaaatgctgctttgaaatactggaactgctgtattgaatgcccataggtgtctgtgaaagagggaaccgtaggcccaacatggctcgaaagacttcatccaggataagtaggttgacatgacaagggatttgggtccagctcaacataaagagacatttattacaattagggccatatgaaaactacattagtaatgagttcaccatcactagagatattaaaagagggcctagacatctagttggcaaggatgtcacagggagatttgaatattggaaaaaggagtttgaatcaaaatgacatttaaaggcctttccggccttgagattctgtcttgaattcacttagaaactttatattgggaataaaggtttccccttgttataattaacaccaactagtgatgtctcctcctccctcccccctgtgcttcccctgtctgaacaactactcgatttaagaaggggacttaggatgaggaaggatgtggttccttcccacttggcagcactccgtgtcagaatggaagacttgtgtctgggcctggcacggttccgtcaggccctcttaccagcccagtcgtgtctgtgaccagagcacgtgggaggtgcacatccgtgtagaaaaacctcccactggctgccagctctggatttttgaaataattcctaatgaatgcagtcttgcccaggccaaacctcttacaggaatgatgacacaccctgaaacaagtccgagtcaggccagacaagcatcccctgaaaaatactccctttgcggttggcagcatatgagaaagtatctttgagagccgtttcttcttgccgtttcaaaggaaagctgcttgcaggccaggaggtcaggagtgaaaaactcctttttttttttcttctattttttcttttcttttaattggcttactactcatctgaaagctctgctagtcaaatatgataatcctttgatttaatgtcaggattgagacagttctctggttcttgaaggaaagagtgttgcaatgctaggaagtctccagcagctgattaacagctttgatttgaaagaataaaaagaaagatacaaaaactggcagtgggtcctaccgatcggtgctgcaactaagaatggacagtatttaaataagatgatctttcccctcaggatttacagagacttccataatctccagcccacttcattttttttttttaatgtaatgttacagctcggtatgctttgctcaaatctatcatgtttggatatttcaaactaggaagtttcattccttgtagaaaagcttcagaaactcaccagatattttaagtcaggtcagtccagctcttcccaggaaataaagatgttaagaacttcatagctgtagggactccttagagatccgatccagtgctgcctataggaccttgggccgagatttcccatgtacaccataaatcttcacaaagtcgtgggaaaagaacagcaacttcagctccttttgcagcctgatcattgcttctgggcccgagtagctgtcttcttttgatataggaccattgcctgttcagacatgactctttttcctggatacaaatggtatgttatttttagggggcagttatatttcttaatagttttcagagttggtagacaggcctgaactgggaatcaaaagccatcttctcacatttccactagtgagttattgacctcatgaaagtcacctctcctccctgggcctttacttcccaaatagtgttccaaataacattagtgacttctgaggtcctgtctaattttctagatgtcatccggataagaagataaagtgtaagagaattaaaaaaaaaaaaaaaaagaaagaaaaccagcaaagtgaagtgtggggcttaggaaaatgagagtcctctgtttaaaatatgtctcagagagccttggtagcaacaaaggtcccaaatataggaatcttagtctgtactgtgtattgcagggtatatggatttcctgtatttgcctaagttctatttgctaagagctgactagaaacatgaatagtagtcctgaggaagcttaaagatgctatcacattcagtttactcatttgacatatcaaccctgcggcctttgttctggaggtacactgaaacttgaactcaagtctcctgcctgcttgtgcaatgtgctttcaagtacactgcctattcagtttatttagcagtgatgaacgcttacagaaaccatcaagctatgttttgaaagttagttgattcaaaacaatagagtttagtggtcagccaaacagaagcaaggagatttgctagttttgcatatgtgtgtgacttagtttccctattatccacgtgttaaacataagttctttgtacagctctattcctggccaacaattagtgctattttttttctctcgggttttagaagatctacctcctccaaacaacagcaattaactacgacttataactcactctcagctccccaccagggccacttacattcacatttctgatcacaatatttcttaaggtaaatcttcagttctctgagaatgctgaacaatgagtgtcttctagctcaagttacagtttgtaatgaccaattttgtaattgtggaacagccacaaacacggtggcataagattcatgtatcctggcttaatagctcagattatttccaaaaacccactgacgttggatcaatcatgctacctttgtccttttgtttttctgtctattaagtgctgtgtttggcccagtcttcctcaggtctcctatggtcaaggatcgtgttttaactgttttgataggttgtctttctcaggtgtattccatgctacactgctatcatatagcaaagatcctgagaaattatactttcatgaacaattcagggctgtgattttgaacatgaattatttttcactgtgcataatgatgttcccagaacctattgaaatacgtaagactctaacgtgaaatggccccagacccccatattaccagtttttgcttgttgggtttcttttcttgttgggtgttagtagctcaactttcacacctgccatcaacatgcctccttataaaagccatttgtccttcatgcaagtttgtgacttcttctctgcctaggcataaggactcagataaccaagttgttatctgaagatctgtactataaataaagttgattctttttttaatttttttttaagttgatgcatcttagttaccgtttgcagctctggtttgtctagctgttggctactggtatttacttgataattgacactgtctagtaattgagttaccagctgttgaggtatgactgcatgcctctgattctgtgggtctcacttttctcttctttggatgttttcactggccaatagattcgttttgtatttttactgtgatcttctgggtagatgctagggaccctaatgatttttaagtaatcctgaagaaaattaccgtaagcctaaaggtggttgaaaatgacagttttttgcaaataatcaaaatgccatccatagggacatggttaaatacactatcataagctagacaatgtaatcatatttagccattaaaaatgatgtataatagatcataatgctacataagtgtgaattagggtgacaaccatggtctatgctttgcctaataaagtataatttaaaaaacaaacagacaaaaagaaatgtaattacataagctaatctggaaaaaatgtgaaagacacattactaaataaaataagcatcttttatatacacatatgattcaatttttgtaaaaagaaaaacagttatatgtgaaaaaatgaaagagtctgagtctagtagttatatatggttatattaagagagagactggatgaatgccaaagggagaggagaaggggccacagtgtttacacttcctacctaatatagatattttttttaacttttagacatttacttatttaaaaaattaacttggaacctcttactaagtgagactcgtagcctatctcaaagagcgataatgtgatatttaaagattttgctgatttggacagaaacagaaacaagaagtgatagagaatttattagatgctttactttagatacattttctcttctttttttttattattaataatgttggcagggaggcagtgaacttgcccattagagtttggcaacctgcttgagtttcctaggcatcccatgagtcctctctgtttcttgccacacagcattgactcagatctattcctttacatgcaggcagctgtacgaaaacctatgcactcttatagcctcatctggtttcctttgtcaagatattacattatgaaacattttgggaaattagcagcttttgacagtaaatacgaatgatttgtgattccactaagccactgcttaattttaggctgctgaatggtgaacactttaaggagcgtgggaacaggccatattttgttttgatcttacacagtctcatttgaaggaaggttatccatttgaagatgggctataatttacagaaaggcaattatattgaagactaataatgagcatttagtaatacatatcaaaatgtagaatatgaataacttcagaatttcaagatcttttattctacataattaatttttacagctgaaatgtgcctatctttttggcgatcagataccccctgccctccaaaatacagggttaaatctacataagacgtatacgatttctccatggcatatcattctaggcctgttttctgtaattccttgcctactcacctgcaggttatattctagtcttactagatttcttgttttcctctaaatatctcatgtacttttctgttttgagaactttactcagattatttttgctttttggaataccttctcttttcttcccttcttttctctttgctctccactgtctctgtgattctttctggtccctaagtacccacacagaagcacacacctctgttcctcttcctgtttagatgcaagatcttccccatgaaccctccctaccactattagctagcaagaatcactgctcacttggcatccacagccctttatttacactttatgccttacactgttgcttctcaatgtatggtctaaggagcagcagcaatagcagcctctgggggttgactagaaatgcagaatcttgagtcttgtcctagacttatggaatgtgtgaatctccattttacccagttttccagattctccttatgcatgctaccatttgagaagcactgtcttagagcagatatccaactttgccttcacttggttgcttttgtgtgagtgggttctgatagaatctggcttgtgatcacagactgtatcttcagcattcatctgcaaggcaggatggagtgctttgcacacagcaggagctcttaactgtgtgttgttgaataaaagcttgcattttcaatgaagaggggtgtttgagggaaaaaacaaatacagggtatttccatgattcttgtcggcacgatgtctttcagattgtctggtttccatcattgctgtggttgggttttatagaccctagtacaaagggactgatatggtttggctgtatcccacctaaatttcatcttgtagttcccataatccctatgtgtcatgggagggacccagtggcaggtaattgaatcatggggacggttacccccatgatgcctttcttgtgatagcaagtgagttctcacgagatctgatggctttataaggggctctcccctgttttgctcagtacttattcctaccaccatgtgaagaaggacgtgtttgctttcccttcctccatgattgtaagtttcctgaagcctccccagccatgctgatttgtgagtcaattaaacatctttcctttaaaaattacccagttttggatatgtctttgttagcagtgtaagaatagactaatacagagacttaccaccttatcaaatctctttcctcctctcacctctttgagaaagagttacagtggtgtggaggattacagctttcagaaagaagctcaggtgagttcattgtccaggggattgtatttaaagcatagggaaatactttgtattaatattttatgaataggactatatctgtgtatctgtgatgattgtatatttgtccaagaattggaagcctgatcacaaggtcagagtaagatccagaatcagaatttggtgcctctgaacttaggaaaataacattgttttagtttattatatttccttttgcaaaatttgacaaggaaaagcttcataatttcaaaaatgcttttctatcttgtgatacagattgtaacagacttatattcagatttgttctccaagtatctccatcttccccacttcccctggtattgctgtttttcttagtgtcacttttgccttctcctctcatctgtacatatttcttttgcggttttcttagttattctactcgtattccaatacttaaaacatctgtatcatataactctggtgatattcctgatccttcacaaaatgttgtgtataattaataaaattacagtgtgtataaatatgtaaaaataaataaggataaattaaaaataaaaataaaatgaaatatataattataaataaaataaaatgaagataaaatgtaaaaaataacctaacaggtgatttttttgacatagataagaacaaccctagtagggacttgccatttttatttctgttattaaagcagatcttgaatatgtaatgcccgttacatccatttcttttagattattaagattaagacattgtttaaatacttctttctacttttattggctattttttttaaaaaatatattttatggttccgtgctctccctctggcatttgaatgatacaaaaatgaattataggaaccaaaacataatgctacttgtttcatcttaaaaccttaagttgcttacaatgaaatgaaggaggtaagatgttaccacataaagagaaaacactgtcatagagtttttgtttagagagatctaggacatcttggatatgcaaaaatgacaaggttggtagaacattgagggacagattagatgaattctcgttacttgtttttcccattcacatatccctctctctcttctctcttccgtcctctctgccttcctccctccttcccaaggtgtcttattacctttccctccctttgtccttctgtttttttctttggtggatgaatgtttgtaagatgtccattttgaagctgaaagcctcaaaggctcaaaggcagataattctctttttggaagtcattttacaaaatcctttttatgaacctgtctatagggaaatttcttcctgtcctggctgtgcaatgaaccatttatttgttctcatggataccaatacttattcattattttaaactttgtattttcttttttttttcctcctaagaagttcattttgctctttcttctgattttcctacctgtttgtaataacaggaattagtctttccatgtgtctgtgttgatttttttaatattactttagtgaaaattatagaggttacaggtttaggagctgttggggaaataaaatttaaaaccaaagtctcccaactgagaaattctctctataaaagtaagagagaaagaaaacaaatctattttttattcttgaacaagcattaaatcagaatgtgatgtacatcacaggtaatccactaagagatggcaaagacagaaagaactctcactcttttatgaagccaaacagcccattacatacgtgttttcaagataaacaataacttgtcctcaagtaagcttgacagcaccatttgtcacacatagctcatcctaactttacctggtaattgaggtgaccatccatgttagctgattggttttggccagaggaaaaacaaacttcacatatctttatgacaggaggtagttttttaacttggtgcaagttgcctaccaaagttagggtccaactctcccatagaaactgggagataggggtgctatctaccaaagttagggcccaactctcccatagaaactgggagataggggtgctatctcctgtgatgttcacttttcaaagagatggcctccaggtcttcctagtaaaaggcatttctaggtcacaaagctgacaaaaggccttgcttagccttcaaaaggatttatatacatttcaaagagtacaaaaagtactcagtaattgcaagttggccaaagtaaatgctctgagaaaaagaaagaaggtgaagaatcttttcccttattttcaacaagaattatgcttcttagttttaatttgtacttaatctgacagaagataggtcctatttcattatgtttaactaagcagttcagaattaaagttttactttttctgagtttgacattcagctgacttttgtctttggccttgtggtaacaaattatacgcctccaagttggaatctgatttgacaattcattagcatttctttaatttgtatttttattgtaataaaattgaccattttaaccatttttaagtctactgttttgtggagttaagtacattttcattgtgcaactattgccaccattcatccccagaatttttcacattttgtactcaaactgtagcctttaaacattaacttctgagtctgtcctcccctcagcccctggcaacaaccatcattatcactttaaccaacctattcgaaatgcccatgaaatttcaatatcctgtctctggatgagaagtggagaattgtgtttgcccaggattttaaagataaagatgttttcttgggaaactgactgagaaaaacaactttaaaaccttgaatgtggtgcacccatttatacaagtgatgccacactaattataaataacttaagtctgtgcagttccccagaaatgtctcattcgtgccacttcattactttcaaactgataataaaataccctcctagtgaaatatttttttgcatgtaactcagggattttactattgtagatttggcatttttcacaacccttgctccagtgaatttttatctttcttaattgatcttttggacacagcaaacgaaatattgaacacttcatatattttgttttataaactgtcatggatatgaaggagaatgatgtgaaagaatcagggcagacaatctgttgcagtcagagaaccttaattaaaatgaagctttgctatttgattgtcgtgatagcttgagttagacacttcacctttttgcacctaatttcatcatctgtaagacaggaaaattatattcctttttgagtaagttgtgtgaatatgaagtaaaataagacatgaaaagaagcactgtgtatagtgtcaaagcatgaattatttcaactgagtaatgtacttaacatatggcagaaatttggaaaatacttgttgagtgaatgaacagatgttattctcaaggttaatttttctagggttctctcttctacacacatactcctgtctttgcttaaaacctaccctctcttggctttcctctgattcctgattgtatcttcttctccttacccaaattatgcttccagtttaaaaactccagatctcagagtttgggtagtgatttgaaagggctcaaggaatttctgttatattatttcatagaaaactcttcctttctaaatggaactgcttcctgaaagcttttgggggttagaaatggccattcgagttatccactgtaacatacacaaagattaagggaatttttttttttttttttttggctagcatcaacaggctcaggggagttcaccctagccaaaaaaaaatgatgagctgcaataatgttaaatcagacatgtgaatccaaattaaacagaattcttggtgtaattccaggctgttccctcgatggtcattgggtgggggctcactaagcaactctgttgttcagtgtcaccatacacatgataaatgcaaatgtatgtattataaagcagcataaccaaggcttacactgacaaaggcagatgacaatccaaaggtattctgttgaacatgccttgcctgacatgttttagtggaaaaatcacccccacccatgatgatctgagaaagaaatgagtgttgagagactgaaggagcagaaaacacataaaggaattatagtattttcctggattgagaaacagcctgtagaatcactctgtttagaagaatgtaatcattcactcaataatccagagcgttttctatatgccaggcttcaatgctagaccctgggagtcaaaaatgaatcagaagtggaccctgtctgcaaacgtcttaagagagaagacatacacacttatttaatagtacaagataaaaaagcacattactgagactatatgggaagcatagctaacgttttaggaagaaggtagaaattacatctggcagagggaagcagggaggtttcatgaaagaagtggtttcggaaatatgtcctgaaggacaggtggtatgtgtacacttggagagggtaatgaagggcatcccaggcagaagagatgagtaaaggggaaggaaggcacggggtgatctgtagcaatatctctatttgtacctgtggtgggagtgcttgatatgtgagaagtagtggtacagcaaagggttggaaagagagcttgctgccagatcgtgggaggattcagaatgtcagtgacggacatcagggaagtagcactaggatatgatgtgtgagcaaattgctttggtctttgtcatcagtcggcctttacaggtgttcccatggcacccaacccttacctgaggcttttacagccttcttgtttgcagtgtggtaaatatctcttcctttggatttagagaaggagatttcaggctgttttttatatattagagaatggaaagaacatttgcatgcaaaaactctcagtttttaggtcaccctaatacatacatgcattttcttccctttttcagaaagagcagaacaattgaaaataatagcccttttaatttttctaacattaaggtcacacaggtgaaagggttatttgctgggtctcataggtgcttactccttttatcattggaaaaataaaggctcccctctgttttctgactttttctggatggtgtcttatgttctgatttggcaacagtctttaagaatccagaattctggaagtagtgaaattataatcaactccaattagctacactggtggagcatagcattatcatacttaaatccaccagcatgtcttacatctcattttagctagtcattatgccattgttcctccatcagcttgccacaggagtggtttagcaaattagaaaattgatttgaatttcctacttttttcccaattaaaagttcatgagccttactctaaaactacctccagtaggagtaatacacccagtgagagaattcctaggaattcctcaaagcttggtctactgtttgggggcccttacacagtcaaactccacctccaccgtgtttttctgaaagaacttcattcagcatttccaaactgtggcaaggaacctgatgattgcagatgttactaaacaagaattactaaagtcaattagatttgagaaacactgtatattattactaagtaattgagtttcacaacatgcattagcatcctgaaaggccctgaaagaagtcctgtgggaaaagataacttttgaacctctttcacctaatattaataacctaatgtttctctaaactgagggtgaattactaaagcatagcctttcaaaatcattctgtaaaagcctaagctgaacaatgtggttcaatatgtggccttcagagggtctaagataatttaagaatgaaatttaaaatatcaggagactcgaattaagtaggtacatttattaggactctgcattgtatccatcctctatttacctaccaggatttacgtgaatattttttcatagcctggagatcctttcaaaccctgtctgtgttaacagagctgctacatctgatattattttccggaatctgaagaaacaccaaagaggactgaaataataagacattaatttcagctgtagaatgccgatgttgctgaccctgcagggttattgcagagggagattaattatgcatatctgccaccctaggctttggagttgaagtaccctgctgtaattcactgccggatcattcatgtagccagcatactgatatgattattattccaccaaggtttttatctgcccctagacaattacagaagcacttaccagcatctctcattgacttcttatttaaaattcccagggccacagcaggcattcgcatccttttatcggagacagctacagatcaatgacatgaagcaacatgggattttctgtaggacatgacaaatgctgagattgttgctaagcagaagatagacattcagattccagtagaaaatagtgttgcagtggctctctaacacaaacttttaaggcaatgacaagaacatacaatggaaatattatgagatttggtgtcaaggtatttgagtttgaacactggcttcactatttggtgtccaggaagctatagttcttctgtaaaatgggattgaaattaaatgacaaactcttggcagcttgaggatctggagatctctttaggttgtgagatgaaatgtatatatgtgtgaaatccctgctagggtatgtatatatgtgtgaatccctacgaggttgtgaagttttaatgtatacatgtgtgaaaaaaaactttgtgagtgacagagtgttttaaaaatatttttgtgctaatgggaatggctttcattccccgcgtagtcataatggaacatccttttcgtggccccactgcttgggtgatgacctatcgatgcctgtagtcacctcacacagaatgtagtgactatgcatcggtatgattagcagctgcatgcagtgtacatccttgaaatgatgcacagaataaaattcctatttcctattgctgttctcagcccagggttttaagggacttcgaacctgcaagataacattcatctgatttgcatttttttcagttaagttttcctctctgttctatagatcagtggcaaaaagtatggcttgttttgttttaattttcccctaagaggctttctcccttatgcgtggctgcatcacagaacgctacctgtcttcagagaccagctgtagtgccagctccaaggaatctttccaccctcactcctcagtctaaaccccttttctctccccacaactcctactctctaccacattaaaatgcaagtaattccttccccacagcatgctggcatgttgcttggactgatttgtatacttaataatagcatgagcaaacacagctacatagctttgtagagttaaagaaataataagagcagatacacttttaggtattttatatatgttaactcatataatcccctcagcaatcctaggaagtagaaattattattctccccattttgcagatgggagaagtaagtcaccaagagattaagtaactggcccaatatttcatgggtaccatgggggcagagccaggaattggtaattaaaataataggcttttaaactatgaggttacaatgagccctatgcaaattggagatttctataggttgtgagttcctggatgtctgaggcaatgaaaatctgtgtcatctattcacatttagcgtaagggctccgcatagtaggtatccagttacacgaaatagctttgcattgagaaaatcgccccttgaaagcttaggatgtggccacaaaatgccccccttgtcctctgtcaatatgtttttagtatacgttctgcattcctgctcaatatgcttgtcagagcattttaaaacctcacataagcactgcttgagcacctctctgtgagggaggccagtgttctgtttttttgtaagtagctgtgtggtaaagataaggcatacttgttgaaattagggttacttgagtctttagtggtttatggatcagtagataatagcactataacattccagctcattcgcattctgatgaaaggggaattgcatggtgttactttattttcaataaagtcaccaaatgtcaatgcatatgaaaagaactctggccatagtcctccgccccttccccccatccagtgtgatctggtggactgaggtcacagcccagactatgggactggtgggtgcgcattgccatctgtcaggatgatcctggtgcccaaaaattagtgaaagaagccatagaattttctcaacagggacacagactcacacagacctcctcagtgttagttcataaggggattttctttaacactttagatacagaaacatgatatttctttagggcttacttttttggcttatatgagttcccaggaaaacctggaatattatctttgtgtttcagggacaaaagtggggattggagcagtgaggatgcataataggctgttttctcctatagactgagaatacctgaaggtaaaggctgcactgaagcccctgtgctttctcccaggtggcgaagtgttggcctggtgcactgtaagtctgctgtgaatgttctaatttaactcttgactttaactcttcctaataaaactagttgtggaaactgaggcatagggacaatgaaatatgtggccaatgttatagcacttgttaatgccagagtcagaactaggagagggctcgtcctgcccatctctctgtgtaatggagaatgaggagcccctgggtgttgcagggtctgatggagtaaggggggcctctccgaggcttctgggcacctgaacaggaggggaactgaggccctcttctgctggatgctttctattgagccaatcatttttctgaaagaattgggggaatgatactaggaagtgctctgtgaagggacaactgactgttttgtgaggccaaggatgccttggatccattcaagtctaatttctgaagacaggttcatttcagaggcagtggatcttgatggctgtcacagaacttacggtggcatctgtttgaaccaaccttttgagaatattccattcttaggatgacctgtggcctgactagataatgcagcgtgcctgtgaatccatatgtaaaataaaagtatcaatgtctcatatttgtatcatatttcaccatttattaagctttatcataaacatgatctattgtgatccttatatcatcctatgaggtaatccttattttattgataaggattccagggttcagaggggttaagtacattatccaaggccacacagttaaaaagtaatcaacagcaaactagaacagaggttgactgtgtcctagagaaatgttattcctactacccagaaattgccttgtatttatatgtacttattgcataacaaaattggactatacactgtggacacaaacttagattcccagtcaaaaaaggagagtagtaagaaaaaatctaaacaaaacagatcagggcagaagtttctcaggcctctaagacaggtgtaggtatctacccagaggttttagaaaaggaatagtttatttttagacaaaggcaagatgagagagactctggagaagctgcagaagggacctgagtcttgaattaggctgtgggaaagttaagacttatttcctttcagtgatagacaatttggtctcaagtggagttttaaaaatcatctgtatcttgtggattgaggattgatttgggaattatggcttgggctcccccttctgcaattagagttttcactatggcagtattttccatgagaccttaataggtatattgcataaaaagaggttcatggtcaaattgttgtgagacattctccttagggttcttttcacgtgactaggaaagattaggctcacagacacgtagaagggtgagaaaaatgggatttatttggcaaaaaggaaaaaaagggaaacagggactctcaacaaagcaagagtcctgttaggaggcttcccgcctcacagattgaacccctggttcccacccaggaacaagaggaaccaggctcctccctcttgcaaacggtgtgaacctctgtagctccaccccattctcccagtgcgcaggctggtcagaggttctctagggacccctttacacttgactgtctcattccccctgaaagaagtacatctagctgccattagaataaggataaggataaagatggagaccaatcttaactgcttcctgctgacagggggtgctgttttgggaaaaatgacagtcagagctccctcagaggcctatgtaagggtccccagcagaaggggccatcatccaaagctccggttgcaagaccatttggagtttgatggcctgaatgtgagaagagacagactgggttattagaaaacatgtatttaaatgaaacaagtcgggggtgaggacagctcaaaaatcctgaggccttttaccagtttgcacagagagaggccaaaagcctgattggtaaaacaacttttacccttttaccatcatgtcaggcttctgggttgccttctcccgagcccaatactaagtcaactggtttaaggtttgggaaattaactttcccagtttggagcctgcatccaaggggagtgttctgtagtatagagacaaaattacctatcagtgaagagagggcagaggaggagaaaggaaaaaataagctgcttttttcaaaggagttccaggggttcaggatgcatttaaaggggtacggagtgaagatggatggctactcatctagaaagaggggagcaggcatccctggttcccttctcttcctagcaaatacctggggtgcgtgagggagagaaggaagagtgtcctctttccctcttccatccttgcatctctgagtcctggcagccttggcacgtgccgcccatggttgccaaagcaggcacccatgaaacagggggcgcttagagaataggaagtatcttctctcacctatgcctctattccccctactgtcagtagccttggagttccctagacctcatttgtgccagggatactagcatgacctttatccatgaaatgggaggcttggcttaattggcaggaattagccattctcacctcaactgtgccttttaacctctgttatcatggcctctggatcccttagatccaattttctttcctagggctttgacctgaagcttgaaattgagtttgggacaataatgtgtctcatggggaattgcatggactccttatcataagccaaatgctgaggtaaagctgcggaattgagtcgtcctccaagaagggagagaaaatgatgtcttgtgacatttccagataactggtgggtatagttatgcttgctaagatttgggtgcatggcgcttggctttggttagctcccttggtcttactttcccaaaaaggaaacctccagctgatggatatactatttattcccatcacctggcagaatttgcacgataattgctcagaactagaatattgatccagatttctacattacccatcccatttgctctttctgagctgcagccagagattgctggttggttcacaggaacaagcaggattagtctaaaatgtaggcaaaaacttaaaaataactaatgaatttagaatttaatgacaaaggtgtgagaagttttcaagcatagtttctctccagtccttatttttgttaaaaagaaaaatcgtggtaggactgacttgtttgcaaaatagactttagtcttatatttggcctgattatttgcataaagtacagcaagaatatctgtttctacatacaccttttagattggttttggtggaactctattccacaaggaatttcagataagaccttttaaagctgagcctaaccatgggtttgtatcttcaaatacctatgagttgggtgatcctctcctcttaaggtcccaagataaatttggagctcttgggcctgttagaaagtgacattctctactgaccacaggtcaggaaccctgtacaaggactgtgtagacaagagtatgaagccagtttttttccccagagctttcattggctctgcaagttgagcttgactccttaaaggggagcatattcttcagtcaaacccttggtaaaacaaacagtttctgcaattgtgtcctgttgcaaaagaaaaatggatgcttattgtactgatgcaaacgactatattgccgtaagttaaaaatactcacagatagcttccaaattctagaggaaccaggcagagagaaacaaacatgcttcaaattttcttcacaggaggatacttactcaattattaaaggctgtaaatagttcaaaataagtttctttgactctgaaaaacaaaacaaagatcagcaatattccaagtaaaagttggaaagattgtttcagttttctcagttcagtctgtttagttcttgttttgcttgatatttgtgaacactacagctctttgagtcctgtacatttttcttttattccactgttacaatctccaaagttatcaaaaacctgtatttaagagcccctgtcaaagttctatagctcattataaacaatcttttgaaaaggattaaaacaagtcaacaattgtctgtgaataacaaaatgtccagggtagttacagttagaaacacaattgacaaagtttggttatctctgtggtttacaataacttaatataacaagcttgttatgattgatagcatatactcagatattagaattttagaaatcccatacaattttggaacatatattagcattattcaccaaaatatttcctaaagaagattgaacatcattttggcaatccaacgtacctaaacatgttaaataatcctgtttacctctcttttctggacactccaggggccctttgaagtatccaaaaagccaggtgtcaggaaagacaattttgtaactaaagtttgattttgggaagcctgataagtatgtaagaagtttaaaacatttgatgttctgaaatagaattccagattatgataaattattttacaaaaatgatgactcaggaacttaacaagcaaaaatccttttatagccctttacaaattttgctaaagaataaattagtgccttaacagtcccttgttgtgctttgatttcaatcctcaatttacagaaaaaccatataatacctttttgaatttagtcaatatgttcacacagggaatttttgcaagattaatttttacactccttctactgcttgtttgaagttttagctttcttatctaatttaaaataattctttaatcctgggcaagaatttacatttttctcaaagattaaagtcacgtgaactgaaaggtaccacagcttttgtcttcccttttaaaaacatttgatccaagtgcttatcttcctttaggacaattaattagagctttttttatagacatcacacacaaaacacatatacaactacacccagtccccacaagatccttcatttggcaatctcatatttggattattagcctctgagtgctttaattttgggggttccatgagaaaaacagaggtctttcccctctcatgcatgcattaaaagtggtgaggcaaaatggagaaaaataatttggttgactgaaaaaaagaaaaaagcactttttccagaaaaacaaggtccaagaaaaggaaaacataaaggccttttaaatataactataacttggatatccacttttaattaagctgagcggtccttaagaaaatccttttaactcccttaatactcgacaagtggccaatatttctggctttcagattttactaaaggctcagagcaaggaaaatccaatgcagtttgtggaggggaagggaatcaacaaatagcaaaagcaaaaaagtcatacagatatcaaaccctgaagaactcatttcctaagccaggattgaatcccggccataggtaagctaaacaaagccttgccatgtggttacatgccacgcccccgaggacgtacaacaagatggaggcccgcaaggaagtattttacagaccatacagaaagactgcaaagcacaccagactggctacaacttaagaccagcctcacaaatcctttttcataattaaaactttacagagaatataaacattgatccttatcattcctagcctagtaaaatgtcttctaaaaggaaaacacaaacaaaaaataaataaacaaccaccacgcttaaaagtcaactcctgacctgatggagaaaaggaaagaaaaaaattttttttaatgcctgggaagaacctcttattcttatgcaaatgcgttcctccaccggggagagaaacttaattgctctccaatggggttgaaccccttggccaagggaggtgaagaggccatggatgcatagcattccccagccccagccgggatgggacggggaacggggagctgccgtttgcccgtccatccggaaaaaagaaggaaaaggccaaggaaaggctgggttggactgaggccgtcttttctgacccctgagcgtgacagtggtgggggcacagtttcctctagcctcagaagtctgaggttgagaaggtttagaaatgagagggaaaggccgggcgcggtggctcacgcctgtaatcccagcactttgggaggccgaggcgggcggatcacgaggtcaggagatcgagaccatcccggctaaaaacggtgaaaccccgcctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaatgagagggaaagagatttcttgttttgcatctcactcaccctttctcaaaccccatgttctgggcaccaaagatgttgtaggactttctccttaggattcttgttacacaaccaggaaagattaggctcacagacacacagaagggtgagaaaaatggaatttattgggcaaaaaggaaaaaaaaaggaaacgggctctcagcaaagtgagagagtcctgctagcaggcttcccgcctcacagattgaaaccctggttactacccaggaacaggagaggcaggctcctcccccctgcaaatggtgcaaactttcatggctccaccccgttcaaccagtgtgcagaccagccggaggttctcctggggaccctttatatttggctgtctcaaaataactttgcttaatgttgtgttaagccaagcggaccacagtattcactgggcagattactccaaacctttaaaatgccagtgtgtattgtgaatctccaagagatacgtgatatgttacttttcaaatttattttttggccatgcagtccttttgcagattgctcagcacaggacatgataattttcatctcggattttggaggaattgtatcctttttggccatttgctttcttgttgtttagtgtgtgtgtgtgtgtgtgtgtgtgtgtgtgtgtctctaactttgctccctacctgtgagatccctgattaaataaatgaacagtgtgtttatttctatatattgcacaacttctattaaagtgtataaagtaggggcttaataaatacattgatttgaatcaaatttgatgctgtagattcagaagctagggaattacaggttttgtagagaaatctatgaaaactcagccacaattttgttacttctgtcctttctaacagcttgtagaaaatgcctttctctcgagagtctcatagacaggatcgtgatcttcagaccatccttttgaattagagaggttattagtggcaatgtcgttaagtgaaatttaaggggagaaaacctcagatggctaagaaacttttctatgctgggaaaagtaattaatttcctaacctggaggtgactggatcttagtccacaggtgatatgtctgttttgggcctgtggtggtgataatttcacctaattccctacttgaacttcaaatggcgtcacattgcccaagtgatgtgctccttcctccctcctctctactccgcttccttctctactccctactctcaggtgctttgaaatgcctctgctgcagcactgttctctatactgtgtggggggaggtttggatgagaagagaaacatataatctcaaacatacagaaaaagttacagtacagcagaaagagcatttttttcctgatccataatcccaaacatgtttttatagccaaaagattcatttcacgatcaggcattgcatttagttctcttgccttgcttccttcagcctggaacagcctttccattttgcattaacttcctaccttgatacttttgaaatttacacagcagttgttttgtagaatgttcccctatgggtttgtctaatgttttttcattgttataattaaaagtatgtggtttgaatacctccaaaaattgcaagcttcatgaggaaggggatagtttctctccctcttcctccagactgtccagagcatgatacatatttgctgagtgaattaaaagtagtgtttgaccatctcatcataaattactcctccttccagccttgaagttccctgtcacattctgtgttggatttaatttgcttcctcggtttaaaattatatatatagatagatagagatctgtctatctatctatctatctatctatctatctatctatctatctatcttctatagttagttctgtatctttctgtaacctcttcctgttgtcttaaatatgctttaaccaacgaaaaagtttttccacattttttacagaagcacaacatattgacagtacataaatattgtgttcaactttttcattttgtttacataggcatcgtcatgtgatcatcacctaagaactagaacatcagcaggccctagaagcctcactcttgcccctccctttaatatctcaaaggtaattcattttctgatttaaattaagcaatttataaaacatttccttatcgactttaagttctctaccccttcagtttctttcaaatttaaacaaaaccaagcaaaaactttagcttatttcataataaacactaattgtcataatatatagcattttttatatatatatatgtatgtatacacacacacacacatatgtatgttttcacatgtcacatcctttgatcctctccatctaccctatcagatagtcagcacagggatttttactgctattttaaaaatgaggatatgaggcctagagaagggaaacctcctgagccacgattttccaatttccaatttcatcatagaggctatcacagtaatcttggcttttctgtaatttgtcaaggccagacttgacaactaaaactatcttctttgaaatattttgacaatagagcactaaacttggacctagtacacacaaagtgtagggcatggcaagttttgccaaatactcaatggtcaacttgaaccacgtaatttgggctcttttttgtaaataatattagtggtagctcacattgtctactactccatagttcctcaattatttcacatctattatctcacttaataagagttgatgataaacagcatttgctgagagcaatttgtgttcctggatggtgctaagcactttacagcaattgttaagactttcctctcaacaaatggtgaggtagttgtattagtttctatcattccccagcctcagtgtccctaagtagagaaatacttaatcatcaaattgtcctctggagagagggtacaatggaacaattccttaccttgtttagaaggatccatgaacccctagcacatcagtcttgaattaaccatcaagacagtgagctagttacagatcttcctaagaggtcagtatgaatattcctcacctcttctctcaggctctccagtatcacacagtcaaacaaactaggaactgcaagttcagtgctctttttaaattgctctttcaccttccactcactgaaaacccagttctagttctcccttgtgagggacaggacttcatgatggtatttcttacctcaccccacagagcatgttgctattcaaaatattaaagcacaaaagggaatcaatctgctcacattctattccaagcttctaaagatggcaggtggtatattatgtatatatgtcctctcagagtgctgagcactttgaagctatttcctaaaaagggagaaggcagtatctaagaggagtgtgctaatgttttcttatgaactttgactctgctgttatatcagtaaaggttagcagtactggcttggtaagctgaaagttggggcatttcattgatctctccatgtacctccactgctaggcatttctggaatattcagtgcttaatgacaaggctgtgttattttcaaagtaaatgttgaaaatagaaaccatatttaggttaaaacacctttctttaaactgtcaaaaaggctccataaatcatttgttgagtttttaaaaagaaaaatcataccacttaaaatatatttctaattaatgcactgtaacattaacttttttgggagtacagctctttgaatattaactcatgtatcgaatcaagtaaccactgtgacaaacaggatacaaaactgttctgtttctccaaacaactctcatgtgcccttcttttgcagtcatactctcccattatccctaaccccttgatctgttctcggtcactccagttctgtctttttgagagtgttatttaaatggaatcatacaataggcatcctattaaggttggtttatttaattcagcacaatgcctttgagattcatccaagttattatatcaacatatataatgctcattgcttagtattgctgagtattattctatttttttggatgccacagaatttgttgatccattcacttgtagaatgacaattgaattgtttccagctttaggcaattaataatagggcttctacaaacatgcaggtatagctttttgtatgaaagtaagttttcatttcccttggacaaatatccaagagtgagattactgggttgtatggcaagtttatgtttaactttattaagaaactgctgttttccagagagggtatatggacatttcatattccaccagtatgagagttccaattgctttgcatcctcttcatcacttggtattgtcagtatttattttttaattttagtcattctgaaaggtgtattgtggtatctccttgtggttttaatttgcatttccctgatggctaatgacattgaatgactcttcatgtgtttatttgacttttgcatatcgttttggtaaagtgtttctttatgacttaaacattttaaaattgagttgtttcttgtatgattcctccaactttattcttctttttcaaaatttttctcaatgtcttagggctttctattttcatataaatatcagaatcagtttctctatagctagaaaaaatctttctgggattttgattggaattaactaaatctttaggccatcttggagaaaattgacttctctatgttgagtttctcagttcatgaatatggtatgtctcttctattattttctagtaccattttaacaaattaccaaaaacttagttgcttaaaaagcacccatttattgttgcacagtttctgtgggtcagaaggccaagaacaatgtggcttagctggttccctgcttagggtttcgtaaggctgaaatgatggtgtcagcagtattgtgttcctttctggtgactctggagatgaatatatttctattcctttaatagttattggactattcaggtcgtctgtttcatcttagctgagctttagtagtttgtagtttttgagatgttagtccattttatctaagttgtggaatgtatgagcctggagtttgtaatattgccttattaccatttgaatatctccgtgatcactagtcatgtcccatcattcatttctatttttagtgatagtaccttttttccttacttaacgtatcacctggcttgaggtttatgttttattgttcttttcaaagaactaacttttggtttctttatttttctatatgtatatatttcctgttttgaaattatttgatttctactctataaaatttcctttattatgcttgtttcatttattcttctttctgtagtttcttaaagtggaagattagattatgggcttgctatctttcttcttttctaagataagcctttagtgctacaaattatcctctaatcactacattagctgcatcccacacacttggtatgttttattttatttttgtcaagttagaaatattttctaatttcccttacaactttcttttcaacccatatatactttattttaaggcatgtattttaattttgaagtgtttggagattttcctattatctttctgttattgatttctagtttaattctatggggagagaacatactttgaattcttttaaatttgttaaaatttgatttatgatacatgatacggtgtatctggtgaatgtcctattgaaaagaatgccttattttttacttttagaatcctcaaacagttgttccatcaaatatgcccgcgttttataactgcaaagacaggatgaagaatatttacttcattttaccccaaatcagagtcttccatgtcactttgccaaaactttcatttgctgataaatattagatttgaaatattctgcacaaggatcctattttcaaaaaaagccctgtaaactccacaaaagactgatgatgaaaataactctcatgtcttactaaatgctatcccttttgtgtagaatggaataattagtagcttttcctgttttcttcaaaggcttgttcattgtatcttaggtaaccacagaaatgccagacctactcagactttttgcagtaacttagagaaaataaaaggaaagatctgaatgggattagggcaggattgggactcaaggaagtgatttgactacagggttgaccttttatggggatggccttctggggtgtattccttggcgtgaatggccaagttttcaaaagtgcgaatggtcgtagttttcagtgggcaggtcatagaaaagggtgtcagtcaaccatggcagaatgaagcaggtttagcagtttcatggttataggaggtttatctagctgactgcaagtctttacagggacataaggtaggctcctggaagagggtgctgacgagcaccaggctgaaggcctaagtgggtgttttctgagtatagagctatatatgggatcaggaaactgagggacaaatccagtcctgtgatctggtgaagtgctgctgagcggaaggcaggcagaacaaatggtgattcatggcaaatcccacccttggcacagcaaacctagtttcagcctgtcacctgcgggctaggtgagagaattcagtggtcagagtgatgcagataaggagatgctaatgattaccaagtctagagaatgcagacgataaaaagtttcatatgcggaagtagatgttaaggtgctgagcacgtgaagacccatctttaacattgtcgtcgattacagagaactaagtacattttaaatcttcttgctaaatgatatagtcattaaagttgatatactgggaaacaataggattaaatatgagagatgtaccaaaagataagggagggagcatgaggattatcatgcagtaaattacacggataatgcaggaaaggctgggaagatattatatgtaggttagaatcatctgaagcaacagcagggtctgttaggccccattgcaataatctaaagctaagctctaatttagacactgagaatctgtgtttattacccacgtccctttgctttctgacagttcctccatctctgacccagcaccctctcactctaagacgcaacaaccaaaagtgtattactctttacgataataaaattctaaggctgaatacaagacaatgctaaatgacccagcattctctgagaggtttcagatcagccaggcgcctcccaataacattggtacctttaatctgtcaaaaccagcctgttcaatcacgtttccttttcagtctgctttattctaattcatcacagggcaggactggccctggatgtgtgttcgcagacaggttatctttagattagctttgccttggtgacctgactctttgctgccttcagcataatccagttactcttgggaatatcaattaaggccctcaatcacactaattagaatgtcttataaatgttgccttaggaattcagcagcttataaacaggcaaactgggaaaatctagaggtatgtgggggtttttaaatagctgacagcaatttgggagggcgtattgctttagcatagctgagaagtggggctgaaattacggttccctgaatgcagtgaaatctctagttgctctttgctggcaagtttaatgcagaattattaattacatttattaatgacttggatgaagatataggttgcatgctgatcaagtctgtagatgtcacaaagctaggaagatagcaattattgtgataacagattcaggagccaaaatgacttcaagacagaatttagcagccatctatctaatacgcgcctggcagtgctctataaagtacaatttgagggtcatgttgctcccctactcagaaaactttggtgactccctatttgctctttaaatcccaagcctttggcctgttatttaaggctttgccatattatgattctaccactgtctgctttccaacaaaatcttctgtagttctttttctaaaaccttgtgcttgagcaaaactcagttctttatatactattttccatttgtgttctatgctttcactacctttgagcattattctccactgaaagtttctttttctcacatgttccttctgtctcaagtctaaatatccataccagttcaaatgtcacctcttgtgtttcgtcttcttttattgtcttggctggagtgacctctttcctttgctaatcttcaataacacttatctgttcctctctatttttatcactttttacttcatattgcagggggttttttttttggtgcacattttaagtttctgttagaccctgcctagtgctagaatttctgtctggtaactctttttatctcttaagtgtctctagatgtgtgttctatacatagttgatgatactaaagtgtcttgctgggggttcatctttactgtggaaaagtgcctttagagaagaccctacattttgcccatgagaggcttcgtagctgtatcatagcaacttggaaactcaaaggataaatccttgaggggacggatattccattttccatgatgtgcttatttcacattgcttgcctgtatcaaaacatatctcgtccacacacacacacacacacacacacacacacacacacacacatctgctacataaccacacacacacacaaactaaaaaatttggaaaagaaggagaaaatgctcaatacatgttttattgaataaatgaaagactgatggagagaaaaagatttccccaaggtcataatataagagctggaaggaagaggtgctgggaagaaaacatcatttaatttatcagatgaaacaacagctcgtgatatgacgagctcacctgtgatttgtgtacaaccaggctaaaaaaggaagcatgaaccagagatttttggagaggtgtggtcaagagaggtgacgggagttggaaacttgcatagtcctttagggtggccacacctcttggattccttgtgtagtttataccttttgttataatttaatgctcttaaaattggcccattttaaatgatgttatatggtcatcttatttatcaaatacctctttgatctgtttaagctgctgcatacctgtggttgtgaaacttgtggcataggctatttgagataataatctttgtagttagcctaatgtggatataaatagcatctttgtcacttactggaaatatgagctggacaagttatcaagacctctgcaagcattcttatatggctgttaccttcgacacagaaagcagagttcttgagcatggaatttctgcatcatcttcaggtttcagtatttataacccacagaggttttaccagtggccagatatttcttgggtagtagaaaaagaaatacttcacagagctgtcaaatctccacatcttcagcattaaatatcatgcaaccaaatgtaagggtatggttcacagcagttggctgtttcagctggttattaataggaaggcgaaagatcatagaaagttgactcctccctcatcatttctgtcttccagtgagaagaggagagcacgaacagcaggaattagatttatatattttccttaatataaattcacagtatggtagattgcagacaaagtctgaatccaggatttctagactttctatgtgtctatgtgtcactaaaagggaaaagtacctggattgtaaagtattccaactagaaatagaccaagggaatgcaaagaggggtaagaaggttgaatttatctgccagaaatgtaaatcctggtcaaaaaatccagatgaatattttttaagtaggcagttatagttcagtgaaaaagagagttgtggagccagaaagctggagtttgatcatagctctaccactctctagccaaaggatcgtggtgatgttattgaaacttgtctctagccaaaggatcttagttatgttatttaaacctgtgtattaaacttctttatctgcatgtaatatgggaattgaaaaacaaacaacaaaaaaacagaaacaaaataaaacctgtcttattggttggttctgacaatgaaatttgttaatattgtaaaattcttagaacagtccctagtctatagtcagcaggcatgaatgctagttattattatttaagcccttgaaagtagtaagtgatttcccttacctttgtatttatggttacaggatgacacttctgtggtgtgtagtgagtctctacttttatggaatcctgcaaagtgatgcctcaggtaagtgaatggcttttgacaatgtattaaaatgcaagtcatgcgtagggtaataagtccactcttcctgaaaatgaatttaaataaacataatgttattcatgtccattgtcttctgcggtagcaaataatcataaagcagaataatagaattttgatgatggaaagaaccattgctgtctctagtcttcatgggatagagtacacagggggcagtgggccgctgtgtttaaacacaggtatttttcattaccttcacactcagccaactagaatattgcttttttcccttacctcaggtcctatgggggaaaaatgggagtgataatagcacaatctgtttttcaaatttgagccagtggtggaaaagttatcagtggtaataatccattgagatgttaaataaaataatgagtttttgtcatattgtttctatataggaaaaagaaaggatctgtctttagactcattctttctctggatgttgctttataagaggaaccagctaagacctttatagagtttgaaaaccaaactcagtcatcatgggcctggatcacgtgaaattagatatggaagagacttgctatttgaaagtccatcttttcagatctcctcttcttcccagaattatgcccagaatcactctctatctctgactattaatcattacatttcagcctatgtttttggactaatcaaattcttagaaagtttttagtacataaaactgaaatttgtctctttgattttagtatctaaaactgaaatttgtctctttccaaacatttacttggttcaactgtaggactgaaaaaaaaaaaagaaacaaacaaacaaacaaacaaaacaaccaaaacctaatgcaatggttctctaattgtaatgaagggaacctagaggtcctcattttataaagcttttcatgtaaaattcccctgaacaccataaaccatactttacatatcgttgctttaattccttttctttgtgagagggcttctgcaatgttaagttagctaccatataaccatgacctcagtgttctgcaatatatgccttcaactgtttttcatatgacatggatttgagctctcctaccatcctgatcatcttttctgggtgcgtttcagcttttctatgccacataaaacattgtattagaaaccaaaaatagtactaaaggagtggtataagtaggacagagtacagctcagtgctgaaactagcagtaacttctagccttgttggccctttggggcttcacagaggaatggctgtagataaccggagatgttattcggctgggatgcgctaggagacagctccttggctgtttagtccagcatctgtcctgcttggttaggtgtcgcgtttgataggtgagtttcttgatgtcctgattttcaaatatgttaaatataattcttgattttagtttgttcttatttgatttagttctatgtttgaatgctatctgctcacagaggcttccttgaccatcttaactaaaaatccctaccagtcactctctctccctccatcctgttttagttttctttgtaacactcacattccctgatattatattagccttctttctcttctctcctcctcctccctcttcctcttctcttgtttcctcctccttttccttcctttttttcttcctgaactccctgtccttcctccttttctgcctcccttctttcctttctctccatctctttttcttcctccttccctccctctgtcttggattttaagctgcctgagggcaggaacttgttcaggaacttttgtttgttatccaaacactcagaataatactgacacatagacacatagcagatgctcaatacataggtgttaaatggttgaatacatgtccctttacatcctttcccctgcccccagactgtccagttttataatggaacgtgtttgggttcatgccagtaattcatcatgtggttttatgtcctccctcatcctgaaggaagagggacaggtgactgtgttaccattgctgaaggatcatggaggttccagaagctaatgagtgctggtgccttcccagcagtcctgaccatgttacttttctgaatgacctttactgtaatccatccaaggagtccccagcccccacctcaagtgctgttggtaagagagctttctatccaggaactgtgactcataattctgccaggggaagctaacttcttgaataagataagttctcataccagccacattgcgtcaccgtgggagcaggaaacatgttgtaatcccctcagcccatctggcacgtactcatttgccttccttatgaagaggtgtattgtgtctgacagtgatgccacttcctagttggagggagaggaacaaaaaggacatgttgttgacaaaaacgaaaagagcaactggctctgggctagtgggggaagaaagaaatcattgcgcatcttgagggatcaaccaacctctctgcacatgaaagtattgccttttacaaggcatctgtggatgctgacagatttgttggtctttcatgaggctctccctgtgctcaggttcccatctcaacggaaacacaggttgatgtgaggaacaaagcagaaatgttctgaaaaccctaaagcaatctacatgcgtatcatattagtaagacatttattttgttctgagtccttccatgtgggccttttaagagaatcctcaaatataaaaaagaaaccataaaagcataagaacttagcgccatgcaatgtgttttcacacgcagtgaactggccgtgaagtcatacgattctgacttccgatcatgatttttctggtagcagtactgtgatccccttatcccctcaggaatgggggagcaacattttcatcttaggtgatgataaaagcaaatgattttttaagaaagctttatttccctttaaggaattaaagcttggataattataatagcgattctataattataatgtgctagttatagtaataataataaagctccctttgcttaaaaaagcagtttgcattgtacatattcaatgtcagtctcacacccaaaccatggggtagtcagagctgttgtaactacctttgttgggtaagacaagttaggatcaaagtatttaattgtattactcgaagtcacacagctatacttagcatgcttgtgacttcaacgagtttctggattcctgacatccatattatttttacgaaatatgctccagttggggtctattagaatataaattactaagaaaaaagattaagatctaagggatcacaggtaatcattttgcaaactgttgaagaaccactctgtgataggtttctatgctttgtaggtaaggtatatccttacacgcttatcctgccccctcacagcactgaaacattttcttcaggaggaaaatgattgtaatacaaaattcaaacccaatattcctttttttgcttattatagtattaaatattttcactaataaactcgaagaagttctgtttgtaagacttcgaaatggaaacttcagctcaatacacgtctcttttgctgtgcctcattggcagtgtgtcaggaagctgaactgttaaaagctgcctttggagtagacataaattttggaacctgtgatcccaagttgaggaggtaataaaaatagcaccatatagaatatagtgaatttaaaaaatattaccatatcaaaattatttgctggacaaatcacatgaaaaagagagtacactgccaccccaaaatgcaggcacacacacggatctttgagaaagattttatttcaaagtcaacagttgactgtgtgccaggtgcagggctggatttcacacacattatcaggaacttcgcaggaaccattgtacaggggtaggggctggagactcttctacctgtttgatagtttaggaaatgaagatccagggaggtggcccaagtgctcatgatagcctggcttgcctgatagagccaggctgccttgactccagaaacagtgctcttttttatttttccatactataattgcctttctttaggactgtgctctgctactagaagtaagatcctctgattccttttccattatattttacaaaattggtagagaatggaaatcatctatccaatgattgggagtgaattatacaatgcaaaataaataaatagtaaaaaacactgtggtttcctagtaattgagagattcaagttctgttttactctgtgacttgtttgatgacagtaaaggggtcatttcatcactttttgtcattgcatccttatttataaaccaagccaaccaaccaaacaattaacaaacaatagcagcagatcccagtcaattccagtttcttgatttttatgaaggaacactatgcatcatggacacacacagggtatactcctattagctacttaaattctttctaataacaatgttaacaatgatttcactttattctaaagatcatgcgtttgaccattttagattgtagaatccagggttagtaagaggaatttcttattttaagaggaatacagtaaagtttgagagaaggaagaggaaataattaccaaatagaattccgtgagagcagagaaagttaccaatcctatcaggagatattggggaagacttaatcattgctccttcctaggaagaaacgcatctcttatttgggaatgaaatagttcagggcaactcaaaagatagtgcaaaggcatttagaagccaagctggaaaggtaggttgggaacaaattatgcaggacgggaattacttcaggtaaagagaatgtccacatttaatgtattttggttatagttggctaggtttcttttcctttttttaaattctgtcgtatttttgcaaggacatacactattattaattctatgtgatggttctttcaccttttggtaagaattcagtttgttaccagccccagtggcctcattttatttgaatatccttgctttaataactccgtgctcagatatacttgtgacattgtgtcctgtcccagttgcccatggctggtcatcctgaacactcttcatttctatgtaatttagtccaaacatttggaaaatgtatgaagaatactgtttcattttattcttagtcctaaaggtcattggaattacagaatttcaccctgttgtcatttaaatgatgcctctcggaagcagatctcttcacttttttttttttctttagctgtgtttatagcttgaagcacacttatattttagttacttatatttcccaagggtggatttactgtagcctgattgaaaagaaatttaagtaccacataattggcttgatactgagtttgcaaatacacagcttcttgtatcacagtgataattctaagtttagaaaaatgacctggttctttttcacatggctgtgttagttaaaggaaaccagtatttttgtaggaactcctgcataccgttgtaggaaaaaatgtttgttttacaagaatttattctaccctttgaattacctttgtttttgctatcctttccctcactcccccaaccctgaatattcatttctaccatattttagggaccagattgccaccttagcagtgactcactaccaagaccagtttctacccacttttctttcaccacttaaaaagtttcttttctgtttaactgattaactttttagaaaataaaatatatacccacccaggataacaacacaatgattgctttatttttaaatccactgagtgctgccatctctcatttatttttgaggaacagtgagaaaatggatacatttaacaaataatttgggaacctcagtcaccttcaagttacctgctatccaaacctataaaagctgatgtacaaaattttctggctttgcctttgcgtgttttagagatagtgggaataatgaaaatgcaagatgactacgacaatgagagaaaataaataaaataatcacttcctcagcaacctagaccatattctgttgtgttttatgacattcatttctccttctaccataggaaccaaaatgcttggtatagctatacattactgggaaataaatagcacttttctgcagtgtttgtagggtctgaaatagtttaaggctcttatccatcagcccatttttttttacttctgagatactttcatatttatttatttatttatttatttattttttgagacggagcttcgctcttgttgccaggctggagtgcaatggtgcgatctcagctcacctcaacctccacctcccaagttcaagtgattctcctgcctcagcctccctagtagctgggattacaggcatttgccaccatgcccaactaattctgtatttttttgtagagatggggtttctccatgttggtcgggttggtctggaactcctgacctcaggtgatctgcctgcctcagcctcccaaagtgctggaatggcaggctactttcatattttttttaaagtgctctttaaggtttatagtagtgttcattttgatatgtgcaccaagatactggtgtttgcgtttcccccttcccttatgtaagaaaatgttatggtctctttgagatttggacttgccacccagtgctaccaagactgaccaatttagtctatttgccaattacgtttcctcagtggaaccttctccaggacctactgcatacgtgtagatactcaagaggaaagaaaaagaaaacaggcacatcgatcatgattttttttatgtgtgattttttctgttaactattgctttttattaatttattatggtgggttttattttttcctaattacttacccttgcataagaagtataactatgggccaggcacactggctcatgcctataatgccagtactttgggaggctgaggtggggagattgcttgaggccagaagtttgagaccagcctgcacaaaataataagaccctgactccacaaaaaaaaaattaaaaaaatagctgagtatggtgatgcacacctgtagtcccagctaatcaggaggctgaggtgggaggatcacttgagactggccggtaaaggctaaaatgagctgtgatcacgccactgcactccagcctgggcgacagaacaagaccctgtctctctctttctcaaaaaaaagtacaactatagttgaaatatagacctttattattattactagatgagagattaaattgtatttatcatatgtaaaatgacatttcgaagtatttatacattgtggaatgactaaatctagctaattaacatatgtattacctaacatagttaccatttttggagtgagaagactttagattcactgttatcactttaaagcaagcttgtccaacccgtggcccgcgggccacatgaagcccaaaacggccttgaatatggcccaacacaaattttgaaactttcttaaaacattatggactttttgtgattttcatttttagatcatcagttattgttagtgttagcttattttatgtgtggcccaagacaattcttcttcttccaaagtggcacaggagagccggaagattggacacatctgctttaaggcaaacagatatacaaattattgttcccaagtggataccaaccattattaattattatttactgtagttttgtttgccctttttttcaagggggagaaatctttaattgtttgccatagacttatctgatgaccagatgcaaaaacctactagctttaaattgatgcacctgagttaacctgaatgccctatccttctctagcgtttgggacttcagactatcccaaaattgcttaatggactgatgtttgatttttagagtgaaaacattaattttattcttatattttcaatgttttttgaatttttaaatttatctggtcatctagagaaaactgaatttcttatatgacagatattttgacattcacagcttgattctacatgtctttttgtcattttctggtgtccactcaaggtaaaggcaaataagaaaaaagagaagaaggagagaaaagaggaataatgagggagagaggaagagagagagagacctttttttgaaaaagagagatagtaggaaaaagagagagagaggcataaaatgcaaagagaaaaatagagataaaatattcctacacgggtttcctggatctgatgtaaacccggctatatacttttttcagattaccaaagaagctaaaccatttttaataccacatttaaatactcccccctttttttcctgagctttgcattgaatggtttcctttttgaacagttaatgttttctaggtttttttgtttgtttattttacattcttactctttccctccttccgagtatattaaaatggtgagagaaaatagaaaccttaaatattccagaagtttccttacatctagtgcccctacagccatgagagtggtcagcatctccagggttaatgctttgtttttttttttattttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcgtgatccgcccgcctcggcctcccaaagttctgggattacaggcgtgagaatgctttgttaatcaggatacttttattctgaaaaaaagtgtacagcagagatggtggagacttaaagctttgcatgcccctcaggataatgaaggaagaagagatggcgggcaaaagtgtaagactctggacccccttttgcaagtttatacgttctaaggcagaaacaatctgctgtttgcaattgacactgagctgtgaaatgtttttgctagtagcagtgtatttcttgaggcacagtagaaacccaaccaatctatattcaagtctaagaggagggtgtagctttacttggaggttgattgaaatcatggaaattgtgaatggagtaattagtaatcggaagtgttggaggactttctccctcccgctgcatgcagtattcttagtgaaatgctaaggggaatttcaggaagaaagtgaagacggggttggttgttttattaaggcaaacttttagctctctcacctttattactctaaatatcctgttcttaaaaaggattcttcctctcatttataatgcagtaataattgatgactacaataatagccatgaagcattttacagtattgggtttttaatcactaaaagaagaccatgttaagctaaacatggctttaaatctattttattttaattctctgtaaattgataattactatatagtggtgggtaggtatgtaataggaaggaaggtgaggaaactcacattctttgaatcaaggattatattcatataatattatattcatttctgaaaagcctcataattcagaaatacatgttttcttccatcgttacaagtgagggactccaaattcaaaaaattgaatgaacttacctaatatcactatagaagtaagtggtaaaatttgtattgctctttgactttaagatgcactgtcatttaaaatacaccatgctgccactgagttatttataattaaaacttcattttaaaacatgccaaccaaatctgtcaataattgatgatacggaacacacatatttgaaaagaaacgtttaaccagttaccaaaacagaatctagtatgtgatttttcgtgttgcaaataaaatttcaagatgatttgcttcagtcttcctgaaacatatacagtacattttaattgtgtatatttagataatatacatctttccaagtttatacaaattttctcaaaggaaagcagttctatacaggaagaagattgcagatgaatgaaggaaaggtggcttggtacaggtgcagtgggtttgagtgcagtgggaagctgttaactttagtattctgcaaggttgctttggcattattcatatggcttcccctgtggctaactcagagatactaactctaactccctagcttttgctccttttccaatgactgactgcaggctctgtccctccacttaggtgttaagggactcagtcaaggatgtttacatgtgcctcagagatttttttgggtacccagcagtgtagagttctagaaagttcttttcagtttacaaatgccagttcttttctgctagtctttggcagtgattgaatgtgaattgtgaaatttgattgtggtctcactccaagttctattttatttctggtggagctggaatgttttatctttctcggaaacgatcactttttgtgtgtatggcaacaaaacagctagaataactgtcacttgggctcagcaagtacacaaaagtatgggctgggggcattttaaccaatccatattcatacacaggtaagctattccacttactgcaaactctccagaattgaaatcccagcagatttaatacacaaagcctcttcagtcctagggaaatgagtttttttttaacagactgattattcatttcaaaacatggaatatttttgtcataaaaggatgataagtattgccctcctattttaaatatgtacctttgtgatttaatagaaactggtcaaagatctatataacctccacatttagggaggttggtccttcatgattagatgtgaaacccagttcagcatatgtctcctgggcacctgttatgtgcagacctttgtacgtagggtaggcaaagatgaagacattgtgcgtgtattcattcattcattcatctgtagtgtgtatgtgctggacactgtgcttgcctgtattggtaaccaaaacaaaaattatctttgccctcatgaaattcacagtcttggggatggcttcaagtcttttcttacttgaagaacgtaagtaaacaaatttttataagaagttctctatagttataaataaggcattatattgatggaaagtaatgggatattcctttccttatcccatagttaaggaaaatctattaaagaatatgctatttaattgagaattgagggatgagaaagagccaccttcaaaggcagtggcatgagatgtaggccttgggttgcaggagctttgagaactatggggaaagaaacatgcgacgaagaggaagccgtggtcagagtgcagcacatactgagggtgttgttacatttacttgaactgcagtaaaaggccattgaaaggatttgggcaggactgttacattatccagctaaggtattaaatgatcttgtgagctgctatgtaggaataagattggaaaagatttctgtttttcccagtatggcggacaaggtcctctaaacaccccttttgctgtaaagcagctagaaatgctgcatttaaaaataaatgtcatttaaaatgaattgctgagttggtaagaaatccttagaggccaaaattgaagtgaaaacaggaatccagaaaagaaaggaagccagctctgcagctggcggctacccagggtaacatccagagtcagaggaaggagatatatttaaatgcgaggacatttggataatttttagaaaaaaaaaatagttaaattcctaccttgtactttacctcaaaacaaatcgcagttgaattaaatatttaaatgtaaaaaaccctaagagtagtagaaaaaatacatgcaaatatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatgcaaggagctattatatatatatacacacacacacacgcacattttaatggaaaaattggcaaagatttgaaactagcagttcaggcagtcaaaaacagatcaacacaaattgatcagtctaaaaagaagctcaagttaacgagtgacaaaatagattcaaactaaaccaacatgcgatgccattttttttcactcatcagtctggcagagattaaagaacaatccagcctagcattggtcaggatatggtgatctaataaccaggtatgctggtctctcacacacagtggttgagagctcacctggaataggctttgtggaggggacctgggctatttgtttcaaagataccaccaaaatgcctccctttaatcttgtaatgaaccatacatgctatattctaagaaaatactcggagaaatgcatcaagacatgctcaaaaactatatttttcataggattgttacaatggccgggcgcggtggctcacgcctgtaatcccagcactttgggaggctgaggtgggcggatcacgaggtcaggagatcgagagcacggtgaaaccccgtctctactaaaaatacaaaaaattagccgggcgcggtggcgggcgcctgtagtcccagctactcgggaggctgaggcaggagaatggcgtgaacccgggaggcggagcttgcagggagccgagatcgcgccaccgcactcccgcctgggcgacagagcgagactccgtctcaaaaaaaaaaaaaaaaaaaaaggattgttacaataagtaacattggaaacaatataaatattcatgataaagggagcttaaatctatatatatatgtgtatatcaatacaatggaatatgatggattcatttatggtagatgtttctgtataaaaacaaataccatatagcagaactagtgtgaaacctttaccaactgtggcagttgtttgccggagctaggtggtatgggcttgtaagaaccaactattcaatttttaggaagcttttgagtcatttgtcaaattagtcatttgaagttggctttggtaagagtttttaccacatgaaaattggtaaaccgatgctagaaattagctttgtcatcatcaacccccggctgtttaccagcacgccactctggtcatgcatgtgtaagcatgtggaaaacctttctggcagaagatacatgccttttctttcccccctgcaggatcttgctctgttacctaggctagagtgctcactgcagcctcaaattcctgtgctcaagaggttctcttgcctcagccttccaagtagctgggactataggggcatgccaccaggctcagctaattttttaatttttttgtggagatggggtctcgctatgttgcccaggttggtcttgaattcctggcctcaggagatcctcctgagtgatcttcttgtgttggcctaccaaagtactgggattacaggtgtgagccaccatgtccagcctacacccaacccttaacagtgattatctttgaaaagtggaattatgtttgggtttatttctgccccttttaaaataactttattttctgttactacattaattcatttaggattatggcctccaactgcatcggtgtttctgcaaagggagctaagcattgggcacacatgggcataaacatgggaacaatagactctgcagagaactaccagagggaggtgggaggaggacacaggttgaaaaactacctatcgggtatctataccccaaacttcagcattatgcaatattcccatgttactaacctgcgtatgtacccccatatctaaaatgaaagttgaaatgaaaaataattcaaaaatgaaattacttattgtctgactgtatttcaatctaattaaatttataattggaagtaaagggtaacttaatttttagaagtaagaaagtatatagatctgagctgttgtattcctcgggatggcaagcaagaggcaattgtgacaggtatgatagtttaagccttggctctttgtttctgtctgtaaattggtatgttaataacttctctagcacagaggtaacttcaatattcatgaaatgacctcagtagaatactaaattagaaactttgtaatggaaaatagatattaccatagattttcctgcattataaccatggcttgtgtttgtgtatttgttagcatgttgtgtcaagaaaataagcattagctacccaaatacttggaatttgaaattagcaactccccactttcctccatcagtctactaatattggatactgtattagtctgttcccaagttgctaataaagacatacccaagactgggtcatttataaagcaagagaggtttaatgaactcacagctccacatggttggggaggcctcaaaatcatggaggaaggtagaaaaggaggagcaaaggcatgtcctacatggcagcaggccagagagcgtgtgcaggggaactgccctttataaaaccatcagatctcatgagactatcatgacaacagcatgggaaaaacccgcacctgtgattcaattacctcacactaggtccctcccatggtatgtggggagtatgggagctacaattcaagatgatatttgggtggggacacagccaaaccatatcagatacttagccctaaacctatctatacaccctgattcttaccaactttatctactcatttaaacatatctctttgttacaggcagctttctgttttgtttgtttttggttttgtttttaaaagctcagtactacagaacatagtaagctagttatcaacatttccgtatctgtaggcatggttatgcatgtgttaaattaatacttcttccttcaaccatcagcctttcttcatttctctatgcaataaacatatgttgtattgggcttacactgtgtgctagatacagttcacattatcattatattcactaaccattacagggatgaatgatatcatacagtatttacagtattaaaatggttatattatttgatcttagaatagcattgtaaaatatattattattgtcacttcacaaataaggaaatagaggcccggagagattaggtggtttagacgtagttttgcatataggaagtagaaccaggactcaaggttttgtcctctgttcccaagcccattattctttttcctggcagacccaagggattcctacctttttattactgaggacatcttttattttatattttttctaaagattccttttattgcaagcaataaaaccagacacattagtcgtgctgccatcacaacaatctaattttagaacatttcatcaccccaaaacgaagccctgaggattagcagccaatccacaacccattctcccccacccaagccctaggcaaccagtagtctacttcctgtctctatagatttgcctattccggatatttcatacaagtgggatgatattatatgtggcatattgtgattgatttagttttcacttaatgcaatgttttcaaggtacagctatgatatagcatgtatcactacatcattttttagtgatgaataatattcatcattgaatcataattgagaaatattattcatccctgatgcacctgtgtgtgatttccaaattttgactatcatgaataatgctactatgaacatatgtgtacaagtttttgtgtggacatatgttttcatttttcttgggtatatagctgtaagttgaattactggatcaaggtaactctatgcttaacattttgaagaactgccaactacgttccaacgtaactgtgccattgtaaatgtctttttgaagtattttgaagtatatacctatttgaggtatttgcactctcatattcaactgagaacatctcctgtgagtatctcatgttcaactgatttcagctcttgtgtatctcgtgttcaactcttatgctcaactgatttcaactccaatgaatatctaccaagaagtgggactgctggatgaaatgctactctcatttttaattatttggcaaaacttccatagtgtttttccagaatggataaagagaatgcattatatcatacaattgagtgtcagtcagccctaagaaaggaggaaatcctgccatatgcatagacctggaggacattatgctaagttaaataagccaggcacagaaggacagacactacatgatgctatttacatgaggaatctaaaatagtcaaactcatagaagctgggagtagaatggtggttgccagaggctgagaagggggagaaatggagaggtgttaatcaaagggtgcaaagtttcagttacgcaaggtaagtcctagaaatctactctacagcttagtgcctatggttaacaattctgtattgtatacttaagaactcgctaggaaattaaatgttacataaagtgttcttatcactaaaataattaatacataaatgaatacataaatagggcaggaggaaacttttagaggttatgtgtatgtttatggcatagattgtgatgatggtttcttgcccgtgtatatatctccaaactcctcactttaggcacatcaaatatatacagctttctgtatgtcaatcatacctcagtaaagtggtttttaaaaaagaaacagcagaagaggtcattgtgaattcagaggtcttcagaggactcagccctttaatctctgattcagtaaagtggcattcgagtgtttccttttttgttagtgtaacaaatataaatctcagtgctatgggagctcagaaagtgttctggatcagaacatgccctgggtaattcacagtgtataaggcagagaagaaaaacctggactcaagtcaaatcctggtttccgtatgactctcagtgtccttatctataaaatgaagctgatagtatcagccctgcataccccacagagctgttttggagatccagtgagagaatgaatctaaagttttctgtaaccagtaaaagcaaatcaggaagcagaagctcagtcaaatgagcctagaaaccacacacttggcaggtaggtaagcaccagttggtgctctgtattatgagattaggactgagaccttttacattcgaagctgggtgcttgccgacaagaatccgtatttccaaatgtgagcaaacccttgcccagcagagttttcacaaaatccagatgttgagttttgtgtcaattgtttaagaattcaaaagcagatagtagcatatttttcaaaatcagttgcttgacaaccagtttatggtcctatgattctctgccaccttccctggttttgacgactctaaatcagttgaaacttgtattatttttctattgtatttttcaatatatttgccaaagaatatgggaaaagaaactttattcattcaacagccattgtttgaggtatttccatgagccaggtatttgataggcattaggatatggtgaagaacaaatagtccctgttcctttcttcatgctcgtttgtgtctcatatgtctaactgtttcagggtccctgctattcaccgtgactcacagatggcaccaatactgtgttttaaaaatgaaaagcaaagtggaggtcaaagttaggttctaaaaaaaataaaaatgaggaataacataaggaggataaaagatgttgaggctgcagttcagttctgttgctaatttactgggtgatttgggcaagctacttaacctctcagaatctgtttccacatctgttaatttgcttagttcttgactctaacaagctagcattctgtagtttgagatttaagagcctctgaaacaagtttcctttctatttctttacatttttgatcaatccatctttgctcattttccatgtggctcttatctgctcctctccatcttaagtattatcctagtccaagccacatcatctcattcttgaacttttcttttcttttttttttttttcatttgagatggagtttcactgtttttgcccaggctggagttcagtggcacgatctcggctcactgcaacctccacctcccgggatcaagtaagtctcctgcctcagcctcacacatggctgggattacacgcgtgcgccaccacccaggctaattttgtatttttagtagagataaggtttcaccatgttggtcaggctggtctcaaactcctgacctcaggtgatccacccgcctcggcctcccaaagtgctgggattataggctgagccaccctgcctggcacattcttaaatttttctgcagtagcctcataattagctgtttctccttcacttttactctctacagtccattcttcacacagtaaccagtgttacctatttcaaattgtaaattaaatcaggtgtctcctctgtggaaaaccctggaatatgtcccattattcttagaattaaatttaagttccttacagcggcctatatgctcttatatgttcaaattcctacctgttgcttcagcttcttcatattccactgttttccttgcccctggcagtgaagttttctgagattcttcaggaacttcacatgtactattccctttctcacctaagttcttccttcacacactctcctctcaactttgtccctcacatcttcattctatttcactcagctcaaaagtccatttctcagggaacatcccatctcctgccctaatcagcgacctctcaggctaagtaagatccctgttaatatatccactttatacgctgtacgtctttttcatgataatcactccaatagcaattgttgttaattgggtaattatttatttaactacttaattaatgtctgtgaccttctctagaatgaaagctccatgacaacaggcagatttatttgcctctgtatgttttatgtgtagcaaagcctttgcagttagtaggtgctcagtaaatactcagcgaatgaatgaaaggatataataaataggtaacacttaattctttaaatcagctatgagattattttgtatgagataacaaggtatatatgccagagagttctgaagaagcatagacgtttctttctatgtagttactgatctctgtttttactgtgagtgcaaacaatactcatgccaccccattagaaacaaatatccaccaaactctgtgtgctgggcactaagctggatgagcaggactaaagctctctctttgagctcacaatctagcagcaaattagcctcaaataacagttacgcaaggtacgaagtggttagtatcataagagaggttcagagaaacagctatggtggtttcaaactgagagaaattgcttcaaactgagagcagccatctatatatccagaggtgtagtgttcaatttaggccttaaaaaatttgtgtgatgtgactacttggagataggtgagaaatggcaatgaagaatggagctatgattaaataattgcctctgcccggttgttacaagtaaagccaagtctctaaacaagaggcaggaacttaaccttttaaaatttatttttatttttattcactcttatttacatatggtcaaattgagttttttggtgtaagaagtctgtgaattttgacaaatgcatacaaccatgtaaaaaccaccacagtttaggtacagaaagtcccattatcctcccaaatttctctcatgctgccactgtgccgtccccccacacccagtcactagcaaccactgatcgttttctgctcctataattctgccttttccagaatatcagatagatagaattgtactggtctggcttccttcacttagcataacacatttgaggtacatccatattatcatatgtttgagaagtccattccttgttaccaagtaacattccattgtatggatataccactgttgtttattcattcattagttgtaggatatgtgattgcttcaagtttttggctattatgattaaggctgctgtaaacgtctatatacaggctttgtctcaacacaagtttttgttacctaggactgatattgctaggtcatatggtaaggtcattaggtatgtttaacctaataagaggctgccaaactcttttccaaagtagctatactcaattctgtattcccgtcttcaatgaatgagagtccagctgctgcacatttcatgaacacttgctattttccattttttaaaatgctaaccattctaatagttttacagtagtatcttgtgtgatttttaatttacatttatataatgactaataatttggaccattttgtcatatgtatatctcctttggtgaagtgtctgttaaaatattttgtccctttttaattaagttcctgatatttttctttgacttttgagagttctctatatattctgaaaatgagttcttcattgaatagctgatttgtggcttgtctttgctaacctttaattttcttgttattttaaaaatcttgctcccaggcccatcactggatctcctatagtctcttaggtctactcagtatgtttatagaacttctaggttttttcagacacagtggggatctaggaagatgaaaatgaccattgccctgttaacaaggagcttttgagtagctggaaagagaattcaggtatccaaatatttataacccacgaaataatgtcccgagtgccatagggatgtatagatggtgtgctatactgcagagtgttgtcactcattgaggtttctggttactaaaatactttgaggccccgaagagagaaacaataaagactgtggatgattacatcctacaaactgtaacaaagtggcttccctctttacagcctcatgtattatctttgatgatgatgggcattaggggatgaaaaaggggccgtgccaggcaatgcagtctttctcaacttgatcagtcacagtgcccactctaaccattgtcaagcaaaaggaccacatcagaagccattagcctcactgcatctccccaccccctcagcccgtttgctgtaattgtcccatttgacttcgtttaataacaaatgggtaaagaaattccatgcttgacacatgtggagttgcatgtgtgtgtgacccatcagacagcttcagggcacaagtatactgcccagcctatcttttgcttctgctcatactaatcattaacatgtgtcactttaggctgggcatggtggctcacgcctgcaatcctaacactttgggaggccgaggcgggtggattgcctgacctcaggagtttgagaccagcctgggcaacagggtgaaaccctgtctctactaaaatacaaaaaattagccgggcatggtggtgtgtgcctgcagtcccagctacttgggagggtgaggtaggagaattgcttgaacccgggaggctgaggttgcagtgagccaagattgcatcactgcactccagcctgggtgacagagtgagactccaactccaaaaaaaaagaaaaaaagaaaaaaaagtcactttattcattaagtaccattagtgactctcagttgctacaaggataaagtttgttcttaccctgattgaccctagtctcattgaccctttaccattctcatgctttgtgaaatcatcccacaccctgtgatctaaccccggctgactcatggactaactcatcatggctcacatcagcctggactcctccccttggaggaggagtcagtgcacattctatgcattttttccagacttaaatcagatgccatctcttctgtgaaggcaccgatgagtgtcacccatcttgaagtccgaattaaaagtgccttctgccctcctatgacacgttgcatctttattttttccttttagcatttgcttcattttgctttgtgttgtggttgtttgcctgactctccacccagtcttgacagtgagatctttgagagcacagtctatatcttccttgtatctttatccctcgttggagcctaacataaactgttgcatgtggtaagttttcactgagggtttattgattgaaggacatgccataacccacagttcaccttgctttgtgacccagacagaagaggtgtctcagtggctgatagttgtaactggaggtgacagggggctctgatgtgttctaagcaaagacagccctgtttccctattggccgtgattatgccctcctatctagaataggaaaagggtgatttgattttgagcaataagcaacctgactctaattgtctaccttaaatgccttccattgttctgcttaaggtgattttctaccagcatgaaatgttctccttcccagacagttgatggaggagctgagtcatgcctgactatacttaataagacagaggcagctaatgccccagggagctgccttcgaggacagcttgacatttctgactcctctgctttttaaaagtgggtgttgtgagggaaagttaagcatgaaggtagcttcggagtctccactggaaacaggactatatagtgacactctctaatttagacagatgtgatctaccccgctgcctcttggctgtgatatgtgccttccgatgctgggaggtgctaatcaaggatgtcatgtttttcatgaaagagtctcacttgcttactcactttgttctactttctattaatgagtgcccacccacttccgttcttttctctgaaaaactggcttgatttatatttttcagagtcaggctagaaaatactcttgaagttagcatggattataaacccatcatattatagagatggacagggttacagatcatctggttttaccttcttatacgtgataaaactgaatcccaaagcaggaaagtgacttggtcacagtcagcattaaatttcagactctagagagtgacagatctgcgttagaatccccgtctcctactgacttgctgtgtaattgtgtgggtatcttttaacttatctatgcttcatgctcgtcatttgttaaatgagggccataataaagctatctgaaagaggcattatgaagagtgaaaatgataataaatgtaaaacacttaatacctggcgtatagaaaacactcacaattaagtgaatggtactggtagttcctatggtggtggcagttttataatggtggtcacactggcagaattaggacaagaaaccaggtcttctgaccctatgtctttgttctccatagggtatactacaagatgtatctcaggaactatatttagctatgaggaagtttaaagtgatctgtctgaagatgaattcctatattcaaagaaaggatcagtagcgagtttgctgtagcacagaaggaaaagaaaacatggtttgagatgtttgtcaacatgaagaatcaaattgggcggagtgtttgagggaagaaattatatgtaaaatctccaaaataaaaaccaaggggctgagtaagacctgagaacctgaggtcagtggatagaggactgactctggaatcagaaaaactgctgcccaatagctctgtgagcttcccaattcactctctgaacctctctttcaaaccccaaaatggggcaatatcctctatatctgggatcaaaggatataatatgtctaaaacttccatctaaactatacattactatggattatgtcaacaatgttggatttgcagtctttggtgggatgtggtggaagaaataaggcaatgatttctaagtgatgcatttgaaacattttcctacctcaaagcatacggagataaaaaggtctcttacatctttttttctttctttctttttttgagatggcatctcactctgttgccaggctggagtgcagtggtgcaatctcagctcactgcaacctctgcctcctgggttcaagcgattctcctgcctcagcctcctgagtagctgggactacaggcatgcgccaccacgcccagctaatttttgtatttttagtagagatggagtttcaccatgttggccaggttggtcttgatctcttgacctcgtgatccgcccgcctgggcctcccaaagtgctgggattacaggcgtgagccaccatgcccggcctacatctttctaagcaaccatcttcattattcattttccactaggcagggaatcacatgcagcattgggagtccaaaagtcctcagggatgagtgtcttggacttgacagtgttgtcctggaatatatacctggacacacatgcacacacacacaagatgtttgtgtgtgtagttgtagttgtaccatgcagttcctaaaagccctcttcaaatgactgtgagttattttcctggtctttcatctatttttctaaatttgatttttctagaatgtttgttttcttcacatatgaaaagtacattctcttgttttgcttcctttgttctagattttagagaagttggtttgtagttttctctttcccaataaacgtatgaggcaaatgttctcaaccttagcactatagtaagtcaataagctcaacataaaagtacgtataaaaatttaacccctgacataccaagagaaaagagaaacaaagattgatataagtccagtataaactcttatttttgcagttggttttatatgcagaagtaatgttcatgatatggttatcagagagacttttatcctgcctctgctactaacccagtctttcacctcaggcattccctagcccctctggtgtcagagcctgatctgtataatgtgtcatggggctggatgatttttgaatccaccttccagctctaacatgcagtggttttctaagatgcacggtggattataggggacttcagtgttcagaaacttagaccaggattttatcttagcatttactcttcccaagaccctgcttctttccttgggaggagatactgttctctaggtgagtgaccactaaaaacctagccactcagcacccccacctcttgaattcttcctgtcaccccatcatattcactgccagacatttctccaaaccccatttctcatgctctcagcttttgttgcttgcttcacccaattttctctcagaatcttttgttttctgcttgtcactaccagccatcaagaaaaatctacacgcttgacacattattaagatagaatgagactgcaccggcgtttcgcaggtgatgcctctgttaaacacagtggcaggattgtcgcctgtgtctcttcctctggcaggtgatgaagatcataaatgttcttttactccaggcagtttcctgagaattgctggggaggttgctgacaaggtttgctagatgcactttcctttgactttgtaattttgcgtggaatattggctgcacatcttgaggcggggaagttagaaagctcctaattgaaagttgaaggccccgatgtacttttatggaatgagtctctctgagcccccaactgggaagtgtaagacatggtgttgaaaggtacagagacccattaaatacatgatgggctttaaattccaatcatgctgttgagtggaaaggtgttcactgacgtatccttggtaattaagaagagagttcatgctcagactgccttctgcattttaccactcaaatccaagctttgagtttcctgcccttggctctggtaaaaggcaataaaaactcaaaatcaaacacacataataattcctttctctgctgattctctttccagatctcaattttctcatctgtaataatccacatcatgatagctaaaacatattcatattaagttcttactgtgtcagagtccatgtggcattttcgtgtatcatcttatttaccgctaacaacagctctatgggattggcactgattaacttcatattttgtgacatatatttgtgacatgtactgttacctatgtggcaactgtggacaggattcttcttcttctttttttttttttggtgagacggagtcttgctctgttgcccaggctggagcgcagtggcaccatcttggctcactgcaacctctacctcccgggttcaagcaattctcctgcctcaccctcccaagtagctgggactacaggtgcccaccacattcccggctaattttttgtattttagtagagatggggtttcaccatattgcccaagccggtcgcgaactcctgagctctggcaatctgcccgcctcggcctcccaaaatgctgggattacaaggtgtgagccaccgtgcctggccaggattcttctttccaggtgccacacttatgggcagcgatgccatttagcttgttttcagcctcaaggacaaacccacatatcagctttttcacttgtaaaatgggaagggtgaaaatagtaattttatgacttgaccatatagaacacatgcagcgttatcttttttggctcagtattaacgttgtctgttccagtcttcctgggtttgattcttagcctgcttcatcctctgttttgaagaggagtgtactgttgtactatttacattcaaagtgccaagtgggaatgtctgtgcagatatttatttggaatatatatttcactgggacaatgtagtagaacacagaatttggattggagaggaatgattttatacttgctacaagtaaactcttgtgttactcaagttatctttctgggtatagtttgtaaaatcttctcatttgcagaatgagaagaattttttaaaatgttgtaaaatctcccttgtcgtccaacactctcagacactttgtcacaggtgaatctccagagcttaaacatcaacaacatttgttgagcacaattcagtttgaaatgggctatactcagtttgaaagtgaaaaagagagaaatataatcataacaacagcaaagattatgtgaccagctctccgctaaacacattaccagtgttgcctcatttaatcttcaaaccagtttttgtttacacatgggaatatttaatttatttgcacatagtcacgtggataggaagtggcagaacgaggtttagaacggggttgttggagacttaccattgcatactccctagggaaagcagttgttttgggacattagagccctggtttggcccctccccaccactatcatatattgtttacccatctctcagacgtgttttttgtcctctctcgactgcattcacttcatgtatggaatgggggtattttcagctatcttactggaattcagggctgcaactagacctgaggcctgtattttctgggactctaatgataacatgtgaaataactttatttcatgcgctgtcagtcttgaatggaaatttcaacacagagactgtatattttctagatattcttcatagcccctagcactcacaggatcctgaataaatattatctaataataagaataaagagagcaaaagctgtttgattattatattaaaataatcattgaatttttacatcttaatcatggattagaaaagatagcttggagggaaaaaaacccccacaaaaacaagctaatgactgcttagcgtttctccagtgtactgtgtcacacttgacacagcctgtttatttattgtcacaacagccctgcaaaaaaaatcattcccttcagcagcatgaggttgctcattacagtaattttttttaaagaaaaccatgaaccatggtacagaagaagcatactcagaattcgttcttttggtttgtttgtttgttttgagatggaatctcgctctgtctcccaggctggagtgcagtggtgcgatctcggctcactgaaacatctgcctcccggggtcaagtgattctcttacctcagcttcccaagtagctggaattacaggcacgcgccaccacacccagctaatgtttctatttttagtagagacagggtttcgccatgttggccagactggtctcgaactcgacctcaggtgatctgtcctgccttggcccagaattcattatgtgggcttctatcccctggtgccactttgatgagagaagcagagcttgttacaggtggctattagatgatgttactgtattaccttccttattctgcacaacagcaggaagggtggctgctggaaccttctgggacataaacacatgataattcagggtctttttgctggtaatccaaaacccagttatgaaatgatttgagatatggaaacagcctggagaccttcagcagcttcgttagaccaggaagctttaaaattatctagaaaacccagggtttttattcaggtgctctcccacaaggaaaactttgtagaaagtgacgcttgtatttacaaactaagagtgaaactccagcatggcagatactgactgcaaactgctcggaggtgctaaaatattcatcctttaataatgctagactctgaaagaccccagctcttttagatttgattttataactctaagtattgcctattataattctgaatttaaacttcgtaggattggttgttttcatccgtcagggttcactttcctttcttacctctttcttttcttcttttttcctttgttcaggtttactttgtaatgatttgtccatactttttattttttaactggatggaactgccacttcaaattgatatgaaatgacagtctttagggcagtgtaaatacctggtgccataaacaggagtagtacactattcggaataaaaattattctaggagcaaactctaatgaaactgaaaccgtggcttgtggatttctccctcaccaaaccctttttttttttgaatttggcattctttcctaatctgacaaatgttatcatcccttgtatctgtcagagctattttccatttttttttcaaattattcaatcaagaaaacttccttttgttggtgggagtaaggtatgtctaattatctggtcctggaaagcagccatctgcccagtgatgaacacgggtttgtatgcagtgccagcaacatgaggatgcgtgatggatgctcacagacactccagctctccctcctccactcctgacttcttgctctcctcttgatgacttagtcagtgaatgtgaattttcagaaacattttctagactttgtttgggtagctctaccctgaataaacatatctaagttttaatattgtgttagttttctctcatactgctaataaagacataactgagactgggcaatttataaaggaaagaggtttagttgactccagttccacatggctagggagccctcacaatcatggcagaaggcaaatgaggagcaaagtcacgtcttacatgtcagcaggcaagagagactgtgtgcaggggtactctcctttataaaaccgtcagatctcgtgagacgtattcatattatgagaacagcacaggaaagacccacccccatgattcaattacctcccaccatgtccctcccacgacatttgggaattatgggagctacaattcaagatgagatttgggtggggacacagtcaaaccatatcaaatatcttccactataatataaattatactctaggtgaatggtgtttgcagatatttttggaaaccagtggtatattataggatactgctagaaaaatgtctagatatttaaaataatttgtcattgaggaacaaaaagaatataagtcaaagagacatagactcataaggtggttaaaatctcaggaattgttcatctagccacttatttgaacagaggaaataaaaccattgttatcagtgaagacaatgatcagccataagtagacatgtaaaataacagctgtttaaactaattcctttccaagtttagtgagcatagggattacctggggattgttaaaatgcagatcgtgattcaatacatcaggatgggttctgaaaatctgcagttctgacaaggtggcaaggaatactgatgatgctggtgggttgaggaccagactccaagtaatgaggatataaaaagcttatttatcacataaaatgtagaggtggaaagttcagggctggtaaggcaactccgcaagttattcaaggtcccacctcctttcactttcagatttcaccatctttagggtgtggtcctcattcttaccgttcattatgtagcgccagctatcatatctatctatgtcccacgcagcaggacagaagaaatgggatggtaggaggagcatgggaaccataggaacatgccagtgtctctcaaggaagatttctgggatctaccatatgacaaatttcaaaccttttctattagccagaacctagtcacctgaccacatccaggtgagaggcaagctgggaaatgttacttttaaactgagtggctatgtgcctaactgaaagtccccacactctattgggaaggggcgtgtgaggcatggaaatggggcatgtctagcagtccatgccacagatgcggatgtctgacacaagaagtggtttgccaaagatcacagaaaaattacagttcatagattaattataaccagtacatgtatggacattctcagtttatgtgtggtgctgttttatgtcataggcttatttcattttcataactattttacactattatgagcttcttttttggttgtggaaactgaggttcaaaatggttgagggacttcattgatcataaagcctacccttactactctctttataattgcatattcctgtctctcccttctctctccctccttcattcctgattcctcttaccagattctatattgttctttgttcccttcactcatcacctttcaacattctatatatttttcttatttagcatgtcaattgcttattgtcagtctccttgtgttagaaggtgagctccgtgagacctttgttttgtttgccagtgcatcccaagcacccatttagtatttggcacatgacggaatgctcagtacatagttttttaaatgaaggaataatgccactaggtatcaaagtccgccttggaattatgtctgttatcttcaaccctaatgctatacgccttctccatcagggcttctgctaatgttttagactctggaactcctgtgtttgcctcagaaatgtgctcacacttaaacatattgatttcctccttgtcttcgtgacattcatttaatgttgctagccaacttaaccagtttgctcttaccttcagttctctctttatctcagtcccaggttaatatttcctgaggacccaagcataccactagaaaaacaaactttagcaaaactaccaaaattaacgtcaaaccagcgttcctgtttgacttagtctctagcctcaggcttagataggactactagcacacgcagatgggacagtttctaagtggcctgatccgcattggtttctagtttggaatgtaaaaggggactggttctggtctcagccaaatctcaagactctcacctccaccctccgccctgtttacagtaatagaattaatataaaatgtagcacaatataatataatagcatttaatattattatgcttctgtttagaaacctgttatgacaattggttgatttcattcagttaactctatttctatgtctttcttttgtgaagattgttaattttctgatgggaattttctgatacaggttcagctaatacgtactgagctcgttttgcatgctaggacttttaactctcacacagcactgtaagataggcagggtgtacatgcagagactagtttaagagaagcattttgtccaaggccatatggcaactaagtggcacatggaaaataattaactatggaaagtaattccactttaggtctcctaaaattcaaatctttgctctttcttttctatacctgagtttcctgattttttatacttatatgtctgtctaccccagcacctagcatagtgctttgcgcatagcaggttctcaataaatatttaatgaatacaaatatatgaagagcttttctgtggaaaatattctgctttgaatgtgtgaggatacatttgggacaaacatcctagctctatagtcaggcagctttttttttttgtgctaccactcaggcaaaagtaagtcaattaatctctctgtctccgtttcctggcatgtaatgtgggaatgggcatgaaagccctagagtgtgttgtgagattaattagttaaaacgtataccctgctatataaatgctaattgctgtcaggagcgtgggttggatcttccagtgacttggctttgcaaagctttgcacatttccattagtcctctgtgccaccaagtctcagccttaagaaacccttttggctgagaggaatgatgactttgtggttctcccatgttgagaggccaatttagagaggacttccactgtggagtaaactgaataagaagggacattataaacaaaaaaggaattcttgtgctagtaatttgctaaattccctttgctgttattagagacaaatgtatttgcataacagccttttcctgtcttttctgaggctggtgcctgcagtgaatcatataattaatttggtattacatgacactccagcctgttgccatagattttatttttatttgttcattgaataatataaaaagctctgacaaaatgcgctcaggtggctgtctagagaacttaaaaactcacagaactaatttcaaatgggcaaatatcccaaagaaaaagctcaataataataatgtttatgaatgctaatacatatattttcaggctctgtggtacaggaggctgactcactttacacacatattcatttggtccatgaaacatcatgtaagggagatacatggcaggtataattatttcctttccctttaaaaatgtattgaatttaattgaagacatattaagccgatggattgggccagaaatcttggtgattgacttgtattcaaattttagtatgtaaggaacaaatgcttttttaaaaagtgtctggtcttgatttattaacttatgttatgaaaggaaaattctaccttcctttttttgttaatcaagataggcagtactagttgctatcacaaatctcagtgacttaagacaatagagatttatttttcactcatgtcacagccgcttgaaagtcaagtggcattcctgaacagctctgctctgagcagtggcaggaatccagattcctcccatcctgtgatgctaccttttcaacagtttctggacttcagggcctccatttcagggaaagagagcatcagagattatgctggggatttcaggctctacagcatttctgcccacatttcactggccagaggaaattcacatggccccaacccaattaccaaagagaagtagttttcacatgagtcaaggagaacagaattaatgagcatatagacagtctctaccatagtctgttctcgtgatcactaaaaatccattttataattcctcctaaattggtctgagtatatgcttgccgttaaaatgttatgttagctctccttttttatttcctctttcccaatcggcattctcctactttacaaaagaaaaatctacatgtcgctcatcatctatcttactattaattattgcccagggctataaagattttcagggtctaacatgacacttattttattggtgtcagaatgtctccttaataagggcactgttaaaccccagcaggccttcctttttctctccaatttaccaatgtttctattaagagtgaatcatgacatcagaatatgatctgtggcccaagttggagtgatctgaattgatacacattgtagagtgggttataggaaagatactaatttccatttaatagtctttcgtctaccatcatctaattgcagtccaaaaagtgcagtcttcagggagatgcttttgcaaaacacgtgaagaatatctgtaggaaataccaatggcagtgacatcttattttatctagacaacaaacagtataatgaaattgcagactccatttgctatccaactgttttcttcctctttttttttctatatactttatcattcaaagtgaaatgactgtcaagccaatacataacaacacaatttttggaaataaaatataaaatcaaaaatttttctaacagaaagtagttatgataaggatggtttgacatagaatgggtttgccaactgtattacctagtggatattttcttccttctttcctttcttccttttattctaattattattttaattaatttgaaagcaaattatgcacagatttttaaggtcaatatattaaaaaaaatcaaaataattatatactttctgccttaactatcctcacttttactaattacccttctcagagacaacaacttggatgtcttatttatctcttctaatatttcccatctatattttgctaacctatttgtatacattgttatcttttgtgtagtcaacccaaggcattatcttttcacttttttcattatagtaaatgaggataatctcactgaaactgctatcccttctacccattcttctctatatttcatatttggtcgagtcaataatcatttcattaatatgttttcacatatttatgaactataattctattacgtctcttagtttttgaagttattaactgcattgcttttcatatgcttattttaatttgtatgtttttgtaaccatttttatagctttcaattgcctttcagcataatttttcacatttttcacactgttaatgacatcagataatctgtcagttgtgattattttttcccttattggaggtttccaatccctactacctatactggttcgttaccaagccctggtgcataaattttatccttgggtctcgttcactgtcattctgaggatccctttcctctcttgaattagaatccctattcccaatcctaggttttctctattattgttttattctctcatttttgtggcacacatcccccgaagctccctgataaggaggacatggtaaataaattgtggagtctttacgtgtctgcatttgtcaccttcacacttgattgttttattatgtttaggttctaggttggaaatacttttccttcagatgcatcgcttcattatcttctagtttccagtcttgtgtttgggagttcccaaaccattctcattcctaatatttcgtaaagtgactttttttttttcctttcctttcttactccttggcagtttgcagaatcctctctttctctgcaattgttttgaaatatttatgtggtgtgagtctatttctatccattattctggggcaattgataggtccttagaaggttgtatacttcagttctcagattttgttttttttctgtgaattatttaattgagaactttcttggtattttgggtttttttttttttttgaaaggtgtggtgcagagagttctcttattgagtgattgagattcctgaagtgggcttctaactttcttatctattttctatttctttttctttctactctgctttttaggaaatctttaaatttaacatctaaaaaaaaatctattaaagttttttgttttagtgggcttttgttctctgaatattgcttggttatagcatttgttcctgcttcatggatgaaacaggttccttatcgctctgagaatgttgatagtattttttacatgtttacttttccttgaataatttgattttctccaagttccttttacttttttttttctgacattacattttgtggtagaggtttttctcagatgatctgctcagatttaagaagaagtgattaagaagctgattggaaattctaaatgtgagtgtgaagccgtgatgctcgttaaacttgagcttttctgttggatgatgtggctgcacaattttctaaagagcttctgatagtaagattgtcatatatttcttcttaaactggccagattttccacggaagattctttccttctcttctgtggagagtaaatgtctgactgccctcatccttggagctgagtgaagaaaactgttcagtgctagaagagtgggcttggaacaaagcatgtaacttttttatatagctgtcattctgtcttctttcttttaccattcttcccatatcttcggttttgagatacctgactgcatgtgccaggatagattattgatattggtaataagcaaatccaaatcatctctgccttcaaagaacaaagttgtgtggtatgccatccatcaaagtacccaacctaagggagcctctgtctctgtgctttcatatttgccaaggcagaagaaaagggaattttgtaaaatataccccatccaaaacatccacaagtaggactgactacatcttcttggtcaaagtaagtcacatggccgctccttacttcagaggtgtggaaatgtacaatcttatactcggaggagaacccataaatagtgggtgaacagcactaatgactctttatcttgatgctgataattcctgggtcttttcagcaccctgaactacagattggtttgttctccagttctctgctgctggtttaggatttgtctttttaggtgtgttaagtctgttaccacttgtccatgttggtatcactattgtcttttctcctactcttgcagttacttgggattatgtattaaacattattttaattttcttttcttttctttttttgaaacagagtcttgctctctcacccaggctggagtgcagtggcacgatctcagctcactgcaacctctgcctcccgggttcaagcaagtctcctgcctcagctttccgagcagctggaattacaggcctctgccaccatgcctggctaatttttgtatttttagtagagatggagtttcgccatgttggccaggctggtctcgaactcctgacctcaggtgatccgccccctcggcctcctaaagtgttggaattacaggcgtgagccaccatgcccagccaaaactttggttatacttttatataaactgaataagcgaactctgcaactttgcaaatattttcaaagaatgtgatactttataaaatacattgtgttacaagtgtgcattgatgtgaacaacactgatttttccaattatttctctgtatgttttttaaaagttgcttctaactaaaaacatagcaacaaatagtcatttgttgagtcttggaaaaactagttgttaaatttccccgagctttattacttacctgacaaatccttttgcaagtcagaaagcttcagattcttcacttttatcaaaattagaataatgacaagtgagttgttttgccagttatccactgctgcaaaaacggtgccttgcaaagaagcacaaatttaaatgaccaaacttcattttatttatttcacttgtatttttgcttctgagtctgtatcttgtgcggctcagctcgtccaggccggacttgctcttgtacctttggtcagttgtggaaagccagatagccatacttctggaggtgggccagctgccagctggggtgtctcagctgtcctctctgtggtctcttatttattaatatgcttttgtggacttgttctcatagtgacaacagagttccaagagaaaaagcaaaatcttttaactcttaagtttagatcgtcacacaccacacaatcacttttgctgcattttgtttgccagtagaactcacaaggacagcccagatttgatggctggtgagatagactcttgattggaaaacttacagtttcaaattgcagaggatgtggagataggggaaagggaaaactagggctgtttttgctgactctgtattccagagttttcaaatgatcgttaaaaataatgtttgatgataaaaatataaaatgggtatacagctcagaaagaatttaaagaattgagtgaccttgtggaactaagctcctttagttccttactgtaaacaaattttcccagttctcacgtgtaagcaaacaattttcaactagtacctaaaaactctcattcaaaaatagcccttctatattactaagaaatgatttccaatgcaagctttacattttataatcattaattacttataaaatgaaaacatattatttaaatttataagacatttcaaaaatcttttaacacttagcactttacatattacacaaaagaataaaatgatgaaaaataaagcataaactatcaaacataagaatatattccattaaagtaaatttgcatgtggagatagtggaattaatgtaagttcaaggaaaaaaagaaactatggaatttataatggttaaagaaagcttttttacatgtttttaggttggatattggtgtatggcaaatcactattccattggatgtaattaaaagaatgatgtaactcttttctttcaaaatggcattacttatgacactaaatatatcctttccaattatacttggcatgagaagttttagatgtcaatggaaacgtagggaagattacagagttaaaaaaatacatacataagcatgtgtatgtgcatatgttagggacatgaggaaaaaactactttaaggtgatggttttgtggtccgcaggactccatcaccctgacctctgttcactcttcatctggtgacttctagagccctccattcagatatcactctaaagaaaataaatattttcttgttttcttaaaataaagaaaaaattctttaaaagaagtttgtttttttttctgagtagatgagtgattacttttcattataaagaataaattatagaagccattacgcacaaggacagtgcagattggaggggtggtaagatagactcttgattggaaaactcacagtttcaaattgcagaggatgtggatacaggggaaagagaaaactagggctgtttttgcagactgtattccagacttttcaagtgatcgttaaaaataatgtttgatgataaaaatataaaatgggtatgcagctcagaaggaatttaaagaattgagtgaccttgtagaactaagctccttttttatttgactctgtcattgaaactgtagcacctttagttctgaatgagtattccaccaaggagtattactgagatctcttgatttcttgaggtctactgtcctgctgtccaataaagtagacagtagacatatgtggctagtccagattgagatgtaagtgaaaaatacattgaattttgaagatgtaccacagaaaaagaatgtaaatgtaaaatagctcatttttttatattttggatatattgggtttaacaaaatattaaaattaatttcgtctgctttgttttacttttttagtgtggtaactgaaatgtctaaaatcacgtatgtgtgttgcattataatttctattggacattgcagatctagcccatgaatcagaagatctagagcaaactgggagtcctttctcccatttgcccaaggattgtctttttcagttacaatttcctccttaaaccattctctgttccacaaagtgaaaaaacacttgatgtctttcttaggtgaaactttctcccataccttgcagggcttaacagggtcaagctatcagatcaaatcattattcaagagatactcagaaaataataaataatggggaacagcagtttcttcacaccaaaggtgcctactgtatgcaattattagagggaggctggaagatgaccagagaaagaggttctggaaaagaccgggtgaactgaggagaaggtgtgttcttttgaggcctttgttgtaaaatgactcatctgcccctttctttcttttttgattattccagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggtagcctgattcttggcagtggctttctcttttccctttagtttctgggctcttttccggatgatccgtgtgctaggaagctggggagaagtcggaagcatttagatagagtttagtgaggtaattgtctgcagcttagctgaaggggtctgaaggaggtatgcagagaaattggttgtggcccttagaatgttctccagaggtagttccttcccagaccctgagacatatcaaagttgtccgaaagtggagccttgttattaatcccctctcaccacaccggttcctgcctgcctttatgccccacctggagacatccatttctccagacattgaacagggcagagaatagagcccatttgtatctgtttttcttggcatctttcaaagtacttggcacagaagagaaactcaggtgcattgtgtgatgcacaatgcctcccaaatatgtgtgatgtgatgcctcccaaatattattttactttttgagtgtggcaactgaaatgtcgaaaattacatatgtggttcgcattatcatttctgtcagacactgcacatctagcccccaaatcagaagacctagaacgaactgggagtcctctctcccatttgtccaaggtttgccttttcagttacaatttcctccttagaattttgtctgtcataatattctcccaaatattattttgggaggcatgacatatatgtatgacaatgctttttaaacttctaccaactttcccctaagaagcaagagaataccatatctctggcaatctaaggatataatccaaacaatttaccatgactgtaaaatttcttttcaatccacttttttttcccttgaaagttttgtagattttatattttactcttcagtattcctcttttttttttctgcattaatgttgtttttggggaaaaaaacaaaaaaacaaaacaaaacaaaacaaacaacttctaaaaactgaggcctctccacagaatagcccttttcagggttaattatttggttactttttactcacagtcactttttagctgccaggcttgcctttgttttctaaactcccatccgggttatttttttttcttttaacgacttcctgctatttaaccggtgtgtggctttgctagggctgcaatgacaaaataccacagtgtgggtgactttaacaaacaaaattaccttctcacagttctggaggctggaagtccaagatcagggtgttggcagggttgatttcattcttgatgcctctctccttggcttgtatatggccatcttctctccttgtctttacatggtcttcctctgtgtgtttgtgtcttaatctcgtcttctgataaggatgctagtcatatgggattaaagaccccctttatgacctcatttgagctcagttatgtctttaaatgttctgttttcaaataaagtcacattctaatgtactgtgaattaggaccttagcatataaattggggttgggtgacacaactcagtccataacaataaataatcacaaatgttttttctctcatggagagtaactactccctgatggaaaactatgactatgctttggtaaatgtaagctatgttatgattatgtgaaaaaagatctcttttctatcacagaaaagcctttggatcactgtgttcttgggggttgcaggtaagggggatccctgtagcctctgaaggtccttctgaggctttcattggacacttgaattttaatggagtggactttagactggtatatgggtttctgaggatcctgaaatactcatgttgtcattatttatgttctaatacaacttggtagaagttaaagcagattatagtggaaagagcattaggagaagacagagaaaccaggccatcacttccactctgccactacttagctggtgaccttaggcaagtcctgtccatgtctgagagctgtggtatctacgtccacataggaagagagttggcatacatgcttgatgagctcctttttttctttgataactgttcatctgttaacatttcccaacgggaagaagtcatcaggagctttctgtttaactatggtctccactgtgtatcttagtgcttcaatatcagttttactttttccttaattacttactacttgcctgtagatcttccacaaacttttctaatcttcttttacattataggagtagagctgcatgactattaagacctgcatatacctttaatgttatttatcaactttcagattgtcacctcttcagtttacttctctatcttccatgttcctaaagcaaatctagaattgaaattgtctggtaggagcactactaggtttcctgttttactgaggaaatgtcgaatctgagaatgaccttaaactgaaacatgtagaaccataggcctgaatgtctttaaggccataaagttagtttcgtctttcagtattttatttatattcttgccccaatactgttcaactttgggagctaaaaaaaagtcggttgaaccactgttcttcatattttttaaaatcagaaaatatatccttaaacttaaatttactttctataacttccacctatagaatctgtcttccacgtggcagatgttttgttatttgtaggtaggggtcatgcctaccactcccccttgccaccttctgagcgttgtcacaagtcatctttaacacccctccctccctctttgagagtgcataccccaccccttccactatatttagtctttattcataagtcattttggtaccagataagccaaataggtgttatgtgatgcctcccaaatgttatttagacaaaaatcacagaaatggctacacatagactccttatcccatcactgtaaaaaattagttgtttttattattgtatgttctttttcatgttttcctatatttagacacaagttttacatccattccatttatttaataacaaatatttatttagcagttactgaaagttaagacactgtactagatgcaatttatgtaataaaaaacataaatagcgttgtgggacttatattttacagaggataagcgtacgtatctataacataacaatctaattttgagctataacaaatttaataaaggaaatgtccaaggtgctcaataaatgacagatcaaatttagatatgaggtgggaaaagataacagagaaggcctgcatgtgaaatggagggggtgggggaagtaagccctccaggcagacggaacaacgtgtgtgaacattatagcaccaatgtaattccccagtcatcctaaggaattgttatgtgtttgtttttttccttcatgcctgattgtttgtatacattctcacaacaacttggaatgattgtaccacaggtttcttgataatattccatttgtcacattttcttctattgattttaatgttttccttgccgatatggctctggatgggccattttgactatttgctgtctctattcctccttttctatcgttctatcatgtgacaaaatatccagacataggattgctagggcaaaaacaaaggcgttttatgatcctgaaaacatagtttttcccaaaggttgcttataccattattgactctgcataaatatgccattcatgcctctgccttaccagcactgagcattattgagaatgttttaggtgttacatatatacacagttatattttgctgtgttgaacagcagaacaggggatatgttctgagaaatatttgttagctgatttttgtcattgtatgaccatcatagagtatagttacatgaacttggatggtagagcctactacacacctaggctatatggtatagtctgttactcctaggctaccaacctgtatagcaggttgtggtactgaatactgtaggcaattatcacacagtggtaaggatttgtgtacctaatctgtctaaatatagaaaagacacagttaacatacaatataaaagatgataaaaacggtacacctatgtagggcacttatcatggatagagcttgtaggactggaagttgttctgggagagtaggtgagtgagcagtgaatgaatgtgaaagcccaggacattactatacacttttatttgtctgacggtgcataggtttgtttataccagcatcaccaaaaacgtgaataatatgttgccctatgacattacaatgacgattacatcaataaacaatagaaattcttgagctctattaaaattttatgaaaccaccatcacatatgtaatccatcattaactgaaatgtcatcgtgtgacacatgactatttatatacactgacaaacacacacaggatcacatctgaaaatatactttagtacattaatagtagttaattaattgtgcctgtttttttattctgtgatgtcaattcgtgtaggaaatgcctccactaccattttatctcttacatgaacttacatgtataaatgatgtctccgtatgtagcctggcttcacttagttcatttgaatgtggttgctctatgaaatcaaatgcaaatactacccattcattgtatatttcttttttcaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatggtaaggaaaattagactacattttattctctctaatggcttataaaatgataatgcttatttgctgagttatatttataagcaaaggtgtttctcttcagattatctgatctattccgtaatagctttatggaagtatttcagcacgtcctcattttgtaccattttaaaggaagtggtgcacagtactttgtctcaggccactatttctgaaattattctaactagaataccaaaactaccttatttctgttaacttcatgtgaaatacattttaagaaatgctgcccacttctagttcctgcttagtgaagtcataagctgttaattcttgtggtgaatttcaattccttgattaatcagtactgcattttattatttatgtgtgtttttttctttgccctcatttgtgagcactgtccatctatggtcttttccacatccaagggatttggaaaatgtttcatcaaaatataaaagtgttggaaggtagcgcttgtagcagcagcatagcttttgtatcacttcaagtctccacatacaccaaagccgaaaccccacggccagaatttgcaacataactcagtgactagttatccataggaaccacctttgataaagttaactgagacaagccaccaacagcctaagcccatatgggatcagtgtttgtggggaaggaagcagatggaagtaacgtggtgtctgtcagacttgacaacaggagaacgccaaaagagccaacaggtactcactggaaagtgtgatgagccaacgtgagaccaggagctgaaattgggagaggttttgctctctaataaggggtagtgcaagagacctataagaagaagctctgaaggggtgggaaaagttgtagttcctcacaactctgaaatatgaccagccacgttgaggagaagctactgtgagtagaatcaaaagtaaactggatgaggacaatatataggaaggaaagagaaggactggtgaaaaatggatcaggagaacaaagccaggacgtcttaagaccaagacaccattgttttcaaaagatatcttggtgaagttagaaaatccttttctattttaaaattcagaaaaaactactatttcctaagtgagctaaatgacattttaaaatgatacaagctgtgaaagaataataagaattagaaatatccaaaaattatatatattatataactccatacaaacttagaagaaaataaatcattttagaaatgaagataatctaagaggaagatcacagaataaaaaacacaatagataataccttaagattagtagaaggtgaaagggagaaaaaattaaaattaaaaaaatgacaaatacaataagaaaattagaatggctgtaagaatatcagataaagtagacagtgaggattaccagagataaagatgacctttcataataataaaaggatcactttatcagcgaaacataaaaataacaaaagcttgtgtgcttaataacaatgcttcaaaaacatgcagcaaaatttggcagaactcccgagagaaataaaaaattccacaaacacaatttgttgtaaatttcaaaagctgaacattttaaattctgtctctgcttaagttgttaatgatacaatttgggagtcaacttgaagagtcttctgttggccaaagatgaacaatttgaaccgaaataatttgaacctaattgcaatggtttaaatcctatgaagtcagtttaaatttataagtttataatgacatttcacaaaatttaatgggttacatttggatgatgataggaaatcagtttattatcttgaaaactggtaaaggagaataatcaagtattcattctggttttcctagaagacatgtaacattgggtaatgaagtgttgtagagaagtgtgttttgtaaagtgtttctaatagtaaatgaaaatttaatgatccaattagaattatcatcaccttgcaactctcaatagattaataaatctaggcatctaagcatcaatgactgctaacatcacaagaggaaaaaccatcagacatgtttcttctgataaaagaagaaaatattacatattgattcatattaccaaattaattaaacctgagtcggattaagcctttggatcccactgtcattttgcaggagatatataaataacatagaaatacattgaactgcagcatgaatatgtcatccataaaatccagactatgtgaaactctatgggccagatgtgctgggtttttcaaaagataaattgtaagaaaaggaatgtcatgaagagggactgtatagattaaaagaaacatataagacatttaaaaagtagatagcactgtagcatctaagcatgcatatataggtgaaaagtatataaataaaaacaaggaagtgattttactataaaagtatagatagtgcctactttggagggtagtaaaggaggtgtgattgacatgggccgtgacgaaggccttcaggagggactggcaaagttcctggacctgactgatggttacaaaggcctttgctttataataactcattaactcttagatgtgttttgcatggtttttttgtatgtgctttattttacaataaaatgactaagagggatggagggagagagagaagaaaggtagaaaaggagtgaggaagagaaagagatgcagagactgatttaagagatttaaccaccaattgcaatgaatcaactttagttggatctttttcatttgaaaaaaactataaagcaaattatgaaaagatcagggaatttggaacatacaatactaatgttactaataaattattactttttaaacttgataatggtactgtagttatgcttgcagaaggagttttcttttttggagatactcaaatattgtttaaaataaaattatatgatgtctgtgatttgcctcaaaataatcttggggtgcagtgagtagctgtgcatgaaataagacatagtctcaattaatacttgttgaggctagtaaagatacaggagctcgttgtcctctctctgattataatttttcatggtaaaaaacctaaaagatggttaaaaaataatattaacagttttacatcaataagtgtaatataccttccagttaaaaaaaaaagtttatttaccgtgcaatctaggttttaatctcgaaccttatttgattttttagttttgttcccatacacatcctgccgttttctcatctccttttttcctcatgcatttcctctgcctagaatgtcctccctttagaacagaccaaattgtaccacctttattaattgttccttgttccctccagctggaaatcatatttctctcatgtattcctgtttatttatacctgtttcaatattatttttcacttctttatttttttagtcattcattcatgactacagatagtcctcgatttactatggtttgacttaagatttttcaacttgatcatgggtttattgggataaaacctcatggtatgtcaagtagcttcttatgatttatgatggggctatggtttctactgaatttttatcactttcacattatcataaagtggaaaaatcataaataaaaccgtcataagttggggaccgtctgctgtgttgtgagaattaaatgcatttttgacttaaccatatttttgacttatgataggtttgttggtatgtaactttcatcataagttaaggaatatctgtatactagctgaagattaactgtgatcagtgcaatatgccagggggttgagggaacaccataatgaataaaatatatgcccagagctgtgtagtcccaaatgacctcataatttaatacaaataactttgtaaatacaaagaatttctactcttatcaaaatgtaaacttctaagtttcataagagtgacaaggagaaaatactgttggttttaaggagagagagatatgtatcctagaagacagcatatttcttgagggcaaagctatgtaatgtcttactctgcatctccagatttctggttttcacgaaaggatgacatggtgctattaaccaaggtatgaagtaacagaggagaagcaggtttagggagtaagtaatgggttaggtaatgccatattaagttagttgctgatgtctgtgagacatctagctggcgggtggcagtgactagcaggtagtggttacgtgattatgagtctggagcttaggagaaaaatcagagctaaagacagaaaattgggtgcattcatgtgatagttgaagcacttaagaagactaaataaagtgagaagagaactgagctaatgccatactctggagatactattcatgggtaaatggagacataaattctgagaaggagacagaaaaagtcacagctgtaaaacaattaccatggccaatatccaaccatgcacaggtgactaaaaaaggcaaacaacatggccaatatggtgaaacccccatctctactaaaaatacaaaaactagccgggcatggtggcgcacacctgtagtcccagctactccggaggctgaggcaggagaatagcttgaacctacaaggtggaggttgcagtgagctgagatcgtgccactgcactccagcctgggcaatggagggagactccatttcaaaaaaaaaaagacaacaaccagtcatgttttctcttatttgattaagaagattgctaataatttctgatatattgcttcctgttcctctacctttgggtaatcaactgacacctttaatcctaagacttctgccatcttggaaacaaaacaaaggttcttggtcactgcatcctcctgtctctgtacagcagtgctaactttgccttctattttctgccttttacaatcatccccaagcatctacccggatgtcttggtccttcttcagcaattcttttttagttgttaccaacagaggttcctacatctgttggttcctacctctatggatctatcttttaatcctcatagacttatttgcattactaaaagagacatggtaaagatgttctcttttagtaatgcaactaagtctatgaggattaaaagatagatccataataataagtttcaggaaatttgctttcccgttatctgaaagatgaaagctgctaatcttaagaaagaaagaggaaactaatatttcttacatttcagtaatcacacggcagcgtgctgtgtgctttatgttcatatgtaacaccagctctgcaagggagataccatattttgacagattaggaaatggcgattcagagagataaacaataacagctaacatttactgaacacacgtattgttccaaacgcttgattttacttaattctgtcaacatccttatgaaataggctgtcatgttttccccatgttatcgttgaggaaccaaggtatagcgtggttgagaaatatttccaaggccacagaactaggagctaagattctaacctatgtaatgtaatgtgtcaggaaaccacacttttacactttcatatataatttactcaaaacaatgcagctactgatgggagagtctgggatttcaggccagttctgtgtgattacaaaaactctactctctagaactgatgtaaggagggtggtccagcctttacttttggagcttaggacattttggaagggcagggtgatctttgaacacatactggggtgtggactggaccgtgggacgtaggtgaacctgtggatagagggccctgagaaatcggaggcatctcagacaaactgagattacaggaaacagaaaaccaaatgtttacatttcagaattgctgaagaaatgggataggattggattgtcctcctccacatgccttctctttctcctctttttttttttctgcatggcggaaaaaaattctgccatgaattcacaattctctaattcaacattaggtattctagtttaactcctgtgagttaaactgatgttcagcaaatatttgttgaataagccaggttttgtaactagtctggaaagcaaaccatagtttgtaagtgatttacagaatttcaaacagctggcttataaaacaaattctgaaatataccatgtgtataaatgggagactgccttgtttattcacataggaacctccaaacatatagaagtaaagacacaggtaatgcagtccttttgttgttgcttttgttactgatgagattaatttagagtctttggcaggccatcctaactttcatattactgtattaattctcttccttatagtttgatatttaaaactttatcttttagagatgcttataaaagcatagacaattttctcaccgaggatcaaaagaaccattttattgggtgttttgtagattacatttatgacagctgctgaactactctcacctgctatttatcagaatagataatgacttttctattatctttgtggttgtaactttccacaaagctagttttccttgtagccacagtgattactaaaattgatatattacctccacttttcatttttattgtggtcaagcattttttataactatctcttagaaaataggaaaatatttgctcttccagactaagtgctattaggaaagaacatttctgaaaacgtgcctggcttggccttcttgttggcatagagatattgttgagaagttagttcaaggtctgtgtagtaagccttattttttaaatgcctgcttctatttgatttgacaacatagattggttctttaactcttttctttacctacacttcctatatagtgattggattttcaacctttagtgtgagagagtatgtaccatattttctttcagagctatacacatataattctatatgtgtacatatatgcatatacagataacatttgacgtaaggtttagggcctctgaggactcaagattcatgacttaaacacaaagccaaattcaaatagctatgaagtcttgaagccacttcaggccatataaatcacctactctgtacttcgatagcacttcattcatatcttgtctttattattctagagattttctcttttttctgtagtaagtagtgaccactcttttcctgtctctttctctttcccttcaataccaagcacacagcataaaactgagctaactatattgtacttagaaattgattaaataattgaatgaattagcctgccctgtaaaattccagagaataagcaccatttgtggtttttttttttctggcaattgtatagccagctcctaacccagtgcctggcccataggagggactttgtaaatatttgttgtgtaatcattgcatgacttaattctgttaattggaagtgactagtttatctaactcttctaagacttcatagcaaagtatgtgttttataccaactttatcttgaatgcaaaaacttcagtagatactactaacagttcaaaccttgtatctcaattaaactctttgtatctttacatctactttccctttccatcctacaacccaccatccaatgtcttatattccaaatactcatcagcacttatacactcgatgagccctcagctccatgccttttgggtcttggcttctctcattcatacctttgatcaggcaacactaacgtgtcgagcatttaccaagcaccaagtattgagcaagtttccgaccacgcagatatggaacttaaaaaccccactgtccctcatacaagttaattttccaaaggaggaactctgcatgaaaacagagcattataataatgtagtttaagtactaacagtcagggaaaaaaattaagacaatacaggtgagttcttcacgctttttcctgtgcctgaagtgtctacttcccatgtctaccttcttcctcaacagatgttaatattcttatcatttaagaaccagcccaaatctttcttcattaagtttttctaagttgttttgtttttatttcatactcccttgaccctaaatgccttttattgtgtttgttgcaatccttcattagaccatgaataactataagttagaattgtatcatttccattttggtgccttcacacagttctttacacattgttggtttcttgaatggaaacacttgttcttacttcatcatgacattcctccactgcacccttcccctccccacatgattcgtttcagttgaaagatcccaaagtcatttcttgtgttgttctttacctatatgttgtggtcggttgccacagcaaccatagcatggttgaaaaatcgctcttctatttaacttctctcttttgaattcagaatgaggaactaatgggtcaactaggattgtttgtcttctagtcagacaagtgtttgctttattgtggaaattcacttactgttcactcatttcttatattttaaagcaagtttcctattcttggagaatctaaatctttttttatgtttgttttcttctggattccaaataaatggttttgaaatcattataacattttcaggttttatttttatcaacagtttattatgtttaaaattatcctatgtgtctcaggtacatgtgttgtgaagggtctagagacagagttgctgataagaaagagagagctaaccagacacacagcaggttaatgttcatagacatttgtagtgtaacaatgccctgaattaccctcacacacgtattagaatgtaaaatattccctttatttctaaaatgttttaggcctaatagctttgaaacagctataaaaagtttctttcatcacattcttaaggaaatactgttgacaagttcagtaaaaataattgacttctcatcctcaaaagtgtgcttcctcagtttaccactgattgcaggaattagcctgttttaagtgatagagccacatcacgcttttcactcaggctggctccagggatggcacaggttcagggctgctatatggaatgaagagacactatcaggtgaaattaaaagcaaggactttgaaacaagtagatctgaattcaaattccagctttaacactgtctggtggtatgacattgacagttacttaacgtttctaggccttgttcattcatctataaaacggaggtaaaagcattacaaactttacatgtttggaataaggatcagacgagacagagtatatgttaagtgcatgtctcagtataattttttatagcctcaactcactgctgaggagaggtattcattcttagttaagaagctgatgaaagaccgttattcggctttctggaaaactgaatttcagctctctactgtgttatctagaatatctctgtctcattttttccgtctataaaattacagcgtatttagtctgatctgtctacttcacaggagtttcagaatagctaagctaacaaatgagggggaaatacctttgaactgtttaaatgaaaagtaccacaaaaataaaatagttctattgatactgtaaactcaattcaaaccaaatctgacataaacttataagaatacaggcctttgagaccttatcctttgtgatatcctaaggatattgaaatcgtttgctgacctgacaagtgtctacaagtattgcttatcttacaggagaagctgcgttgaaaaaaatacgttacccaagcttatagtagcttcctcttgatgatcttttccatgaaatggaagttcaatgctgttcttaaaatacacatttcctgtgacaaagcattacaaaatgtgcctcaatgtaactgtcatatttcaaagtacatgctccaggaattgaagaaaaccttaatcatacaaacattaaagatgaaatatgtgaataaaaaaaattgaagttacaagctagtagtagactcccagaaatttaaagatgtaaaaagccttagagataacctaatctttttgtcataggtgacttattgatatttaaaagaaaaacaaaagcttttctaaaagtaaatgttcaacatatatttttgtcacagatagtgtattgattttttttctcaaaaacagcaaaaagtaataatttagccaaatagtgagactgagaatttgaaacaggattctagatatgttgaatgagatagttgtggactgagatagttcaatttctcaattttaaatgtcaacagttatatgcaaatgtgaattaggagcagaaatacattcctagatcttgatcaggcccatgaagatattttatttttagtttctgaaatctgtgatactcagttataaaaatgggataaagttggtggctcatgcctgtaatgctaacactttgggaggcccaggcaggcggatcacgaggtcaggagttcaagaccagcctggacaggatggtgtaaccccatctgtaccaaaattacaaaaattagccaggcatggtggcgcgcacctgtactcccagcttctcaggagactgaggcaggagaagtgcttgaacccagaagactgaggttgcaatgagctgagatcacgccactgcactccagcctgggtcacagactgatgagaccctatctcaaaaaaaaaaaaaagtaataaaagaaaaatgcaaaacagtttggaaatatctgatacagggaaacaacagggtgattaaaaatgccaatcagacatctaaattggggcctagattatcagacggagtgactggagtcccaaattaatataatcagtgaagaaatattataaaaagaaaaagaattgctttctaaatagcaggtcttgcagttgctcaagtttccttagtcattatttcaaaactgtaactttgctttactatcaacataggatgcccagaatttgatcctgagacaggaagcctgtgtttttgaagtcacactttagtttagaattttaatttctcatgatcagaaaagataatgacaggtgtttcatttattcttcgcagaaatcttgtcaaatacttgaccaaaatagttttataaaaactgcagcatgaatatttcggtgttctgtgcaaaattagatgtgagtgtgcgtgtgtttgtatgttttctatgcatgtatctaaaaagtaaacttttttttttttttactttttctagggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggtaagcatgattagtgtccagtacacacaacaagcatgtgatcatcttgttatggtttttaatagtttattacacactagtatgtaaattgtataagaaaagtgattcatgttttttgtttacagtactgtctctagagccttcaacaattccatgcacatcgtaagcattcagtaactgttggtcaactgaatgaatatgtgaataaatgaatgaagtaaaggtagtttggggagggaaaggagcaccagacagatctgtgttcaaattctgtcactgccacttattagaaacatgacgttgaacaaggtccctgtctttatctgtactctggaactgcaattgattgagaatatttaaaaaaatattcatattgtattaatgcagtttcaggcaagcaatagagactcagtgcaacacttttgtcaaaagaatgttttacttggattaagtaaactctatttttctacatactgaaactgctgtacctattgctgaaggtatttgctggcaataatgttcaaccattattttgcactaagagaatagggggtgagaaactaggaaagtgggaaaggcaattcttagacagagttgacaaactcctagcaaacccagaaatagagaagtagtgtcaggatatatggcttttggggattacccctaaataccactgtgtccagtgtattaaaaaagatagcatctctgggtattgttttgtcataccccatcttttaatagatggaaacattaggctcactgacaagaagtaacctgtttagagacactcagtgagttacttgaagaagtaattctagatcccaggtctctgctcagggctttttctactggtctgacatgatttagtataagttagctacaaacagcctttcatatagtgcaaatagtattcaaacaatgtcgtaatcacttctgttctttttctgcttactttctaaataatgctgagttggggattaattcataagaaaaaaacagactaaattttaaaagtcaaatgaataatgtaaccttatattcatcttagcagttgtttctaatatatgtgcttaaaagtatgcattttggggaagttgggaataagcatactttgtcactctgattaacagatttaaaaattcacagacagatctgggcactgggggcttctttctcaaatttcaagcaacacaagtttgttgttttaaagctgcaaagtgttgagtatttattatatgccagtagcatatccttaatatatattccttagtttatttctcatagtgaaactgcgatatgagttttaattatcctcattttagagttatgaaaaattagcttttcaaaaattaggaaaaaccaagtaactttgcttttgcatttttatatggttaatatatggccaaatcaggattagaacttggttattaaatctttggagctcatacttttgaagacaatactaaaaactctactcaatgtattatttttaaaaaattaggagtactgaatattataaagagcagcaatctcataaacaaacattcaactggtaactagtcatcaagtagactaatgtgccggccttaacatcatgattgtgaattttccattgatttactcattaatgtaatacttatttaaccagcttccatactagacactttcggtaatgttgtgaagaaatacagagagaagaaacaactgactaaggcatgaaagcaattaggtattatgcaacataagacatctatctcatgtaagctttggaaagctttgctaagcaatccgaccttaagcatggagggtatttagtatgttttatttttttctttgtaaagcaaaaactatttttttctatgctcaaaacacttttgtcactaaatgtgtggctcttctatacaaagtaattctcaccttttctgaggacattaactgcatgtcctaaagtttaattcaatttgacaccagttatccagagttagcactgaccccacaggtgaaggactccttcctaaaagactgccccaccccctactttagattccagtcacaagcaataggttcccgcgttacccacaactctgcctgagttggctacaaacttaagattcctactacttcttcctcaggttctgtgatttggtataactgctcacaaaactcaggaaaaccttttacttacccttactttgttattatagaaaatattataaaggattcaaatgaacatccagctgaagagatacatagggggagttctggaagggtcctgagttcagagctccaccctctcagcttgtggatgtccttaccaacctagaagctctccgaacctcattgtttagggtttttatggaggttccgtcacacaggcattattgagtaaaaggactggaaatttcagccacactcccaaacttccagggatgggtgagaggctggagattgtgttaatcatctatggtctttctggctactagcgctcatccagaagctatataggaaccctagccaccaatcatttcattagcatataaaatccactcgttactccagagattccaaaggtcttagaagctgttgtgttaggaatttgggactagaacaatattaaaacaatagatgctcctattacccctgtcacacaggaaatcacaggggatttaggagcccatgtcaggaactgggagcagtcatcaaacctgtatttcctttattttatgctttgcttgttttaaatgactgaagtgcagtaattgagtatatcttggactataggccttctctaaaacaactgacaaactatgccaggaagttaggcaagattcagagaagagcagaatttttaataaggctgcctgatttaacatcatctcccttttttatttcctctaacacaggctctccaaaaaatgcagtgccccctgtgatccattcacctaatgatcatgtggtctatgagaaagaaccaggtaattacagctatgtctctgaatttcacttagattctcttaattacaaggaataaaatgtcatttaagttaatgcaagaaaatagacgactgttgtagagaaacacatgaattgaaactgaaatgtcagaaaccaaagcagctgtggagatcagttacttccctgatcccatgggcaactctagaattttttgcttcactctcggtatctgctcccttctccctctgctagccgtcttcctctgctgatgagtgatttctgtttgatgcaaactttagcttgcacagggctttggtttgccaaggctgcaacatgggcacaagatttagacatccttcaagctcctgctccattatgaaaggtcagtggtggatcttgaaggcaagactgtgaatataatagctaacaactgataaaactagtagacattgacgcagaacactattgaatgcttactgtggctcttcggttcttcttttagtttccataatttttcattatagccaaaaatcattgataactgaccaaatacgggataacatgttactcttttgactcaaagcctcccacagttaagtgaacaggaaactatagaaaattttaacattttctatgttgtatcacttacaatacatccagtccaaacccagtgagaggtgttaacctaaataacaacaaagacaatagctctccaaaaagaaaaggatttattcaggaatgaattgcagatagcaatccaggaatatgagtgctatggcatcccatgcgggaaccatagccatacccagaaagcataggaacataacagttttgaaaggcaaagtgaggaagattacataaagttgttctgaaataattatccttggttataagaaccaataacagggtaacatccgtccaggcttgactggcatttggtggtcagacctcctcacagaaatattatttgtttaagaatcgcgctggcctttgtgcaagatagtggtgctcagagtctttgtactagtttttataataggcatgtgtgtgtgagggccctttttatatgacctcccaactgtttttctttggagtgtgacacgagtgactccattttgactctgacagctttcacagaggtataaaagagcatctgtttaaaatgtgctaaagataatagtcagttgttaatgggtgaaagcaacggagaggatgccattcaataaaaaaaaaaggtggaaaaagaggtatgtagttgttcatggaaagctgacaaacacaggaactgtcaaaatgcatcctccacttgacacacctcttgtttcaggcagtgcctgttttgtggtcagtggggagtatgtaggatatgtatcagagaatgaaaaaaattaaaaagtttatggagtgggtgcaagacacatacagccctgatgcgtatctctgggccctatctaaagggtccctgaagtcttcagctcactttccttaagccataagtacaacttgtcggacatgcacgcagttgccaggcgggtcaagtggcagtaacttgagggtgatgtttccgagggtgctccctacccacactgcagcggggtcctcgtgtgctcgcggtgcatttttgcagctggcgacttgaactgggttgtgcacaagcaccattggtttgccaataagtttaacctggatgtggaacatagatgtggacctcttcgccatccagtgtttgggtgagcaccggaggcataaagctttatagaccttaaaacactgaccattataggcaatcttagggtgcattttgtgcatccttcttattatttctatttagttcctcttgccaataagcatcagaaaaattgtatggagtcctctttggggtagggatgctaagtcttcatgcagaaaagctgcatggtttctgcagagcacaattggctagaaaggctgtaacattaaatgtttatctagaattaacatgagtaggagtaaaagtggctgtggcatcagggcgggcagcaaagcattctggagcgagggggctagggtgactggggaagaggctgatgaaaaaaataaatcaattaaaagagttcagggacttaacaaaatgagatttgacctgtgccaaaactattttgagaattttaaatatgacatttttcctggtatgaataaatttatagcaacaaacaataataaagatacaattgatcttgtatgttatgtatgttgacagagaaatttgattttgctctaaaaaagataatagtgatcaacatagatggagaacaatgccaaaaaaaatcaagataagtttgaaaatatgacttgctttgtgaaacacagagaacatggtaagaggctgaatttcctagaattaggtatggctttatatagtcatatgaatactcttcctgctgtcagggtaaacccttattaataacataaatatatttgtctacctgtcaaactatgctgacagaaggattgttgaatccgtgttccctttatctttcttagtgacatacagatagggaaaactggagggaaaagacttaaggacgttgcaatgggagggtagatagagtatggccacgcagtcaggtaagcctaagttcaaattagggtgacgatataatttatcatctaaaccaggacactttctgtgagtaaacatagccactacctattaatataggtaaccaggaaagcaggcataaaacagaactgttctgggcaaactgggatggaaggtcagtctaggtcaaatcctggcccttcacttattactgatttaacttaggaatatcatttagcatccttaagcttcaccttttacatttgggaaacatagattttaaaaaataccttatggtgcttttgtaagattaaataagaccattaataaatataaatatttagcataataacttgtacaaagttcttagtaagtatgttgctactgctgctgttactactgttttctgcctagggatctccctaacctcatgttccatctcagagggatagcatagagttttctatttttaagttatcttaaaatttattgaatgcaccctgataggtggagcatttcaaggtgggcctcctcagccagatctctctgtgatggtatttccccatctttcctggccaaggactgaagatatggagaacctgtcctcagtcacccttcttgaggaaaataacaaaggagaagagcagtctctggaggtctagggctaaaaagaatattgtcagagacctttttttttttttttttttttttggagatggagtctcactctgttgcccaggctggagtgcagtggcacagtcttggctcactgcaacctccacctcctgagttcaagcaattctcctacctcagccccccaagtagctgggattacaggcggtgccaccatgcccggctaatttttgtatttttagtagagacggggtttcaccatgttggccaggctggtcttgaactcctcacctcaagtgatccacctgcctcggcctcccaaagtgctgggattacaggtgtgagccactatgcctagccttgtcagagactttttaaacaaatatcatcattttagaatttatttagattacattaaaaatggtcactctggtaattttatacaaagttgatggccttctttatttggtttcgcttgtttgttttggaatgaagtatggtgcattaccttatgggagtcgactagagaattactcataagcagggtttcaggtacacataactcgtagcttctgattagccagagagtagaaccaatatagccatgtgaaggataaacactaatgggctaactttgtctttgttttttgttttgttttgttttgttttgttttgttttttgttttttttgtttttttggttttttttttcaggagaggagctactcattccctgtacggtctattttagttttctgatggattctcgcaatgaggtttggtggaccattgatggaaaaaaacctgatgacatcactattgatgtcaccattaacgaaaggtatcatgggggccagcaagggagtgattaacctttgtttctcaacttaatgatctctgatgtgtgttctagtcaatgaaaataaaaattctcatttttccctatcactaacaaaaatcggcaagattttcaaatctttggtgattgcatcccaaaccagggttactgggctagcaatgcaaggaatagatgctgcctgatgaccagtggagagctgaattagaatgttctgaggctgagcatcttcatcagattgtccagaggacatgcaccctattgtcttaagcccagcaagattcacacatttatgatacccacatggaagtagagagaatacatatcttacatgaataaaaaggtcacaatcaagggttgtgggtacgtggaaacctacagtgtagttgtgttttttccttttctcaatcctagtgtctggccctatgtatttgtgccttaggtaattgtgttttgtttttttttgcattgcagtgagcatgcattttctctctcctcctctttcttatctcatataacctatagttacatttataattagtaatttttaatattaactaaatacgtttgtgtaatttaaattttattttaaaggtagatgggtagtaatataactcacttttaaaataaaataacattttattcctaaataaacctgattttttaaagcgttggcaaagtggaaagtgtgcgtccttgaagacagaaggttccactgcaaatgaagcataccattaccgaacagcagttggctcactgcaccaattaaaaatttgcagctggtcagctatatgacaaagtaatgtagctggaggctcacagggagaattattgatcttttttaggaatttttaacactttgtagcccatccttataataataatgaataaataacaaggaaagtcatgttgttccaccttgctgctgttgaaacgtactcagtgttcataggatagcagtggcgttaagcttaagcaaaaccaatcagagcccttaaccaaattctcatacctgacagtaagcctagttaaaaagagaacctagatggcagtcagctgtagcagagagatttttctctgcgataagtaaaggagttcaaaggaattttaaattctgatcttggacccaaaacacttgatctctgattcactgagagttggatatatttatttttacaaagtttacgtgttcataacagctttctctttttatatgttaggatttaaccatgagatttcagatttctgaccacagtattctagctgtgttcggaatccatgctttgggaatcactgaaatgcatcagctattcctatgggataacagtaatacctacatgaatatttattaagcattattctaatattcatgccttagcatattcagtcctcagaattcctgaataaattaatgcatgtaatgcactgtgtgggcattatgacttccctcttttccaaaagaggaacctgagacctggaaagattagttatctcacccaaagtatatagccaggaattgacaaatcctggataaaaacccaaaaggacctggccccagaagcttctctctaaactgatacagcatcctggctcagaagtttaagcaaaagagacattttgttttgaagagagatctataaaaagaagccagtattgggatttggtctagacaatgggatagtgtgtagcgtagatggtatagtatagtgttagaatcttaccattaatactttgtaatcactgcattataggtggctcagcttatcaaccttcctcgccctcacctgtagtgggggtctgtggttgcttacttgtctgattcctacacagtccatagctcttgagtcactctcaaatgctttgattttcttctctctatttctagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaatcagactgtgtctaaaactttctttgtgtctctcacctaacacagaatcccagaaaatcccttcaaggatgttttcaatggtcttgagaaaagtaatgatgagttatcacacatgaaatcatgaaatcaggtcattcagaatcctcctggctcctagtctatagagtgtgtaatatttcttcaaaagtgaataacatagcacataattgttacattttacagagacttaatgcttttttaaagctgatgaaaaacaggattcacctcaaactttcattacaactttaaaactaaatagcaaaggcctgaaatgtatatgctgcgtatgaagtactagtgaatcagttcagggtaattcattgcttctgctcctcagaagccagtgtgaaaaggaaagactgaagtacatgatgtaaggcagtttcccaaattgagttctcgggaacactactaagaatcagtattgtcctgcaatgcattattgtactctagaatcagagcacctgtgttgaaattctggtttctgcacatcctaactctgtgaaaagtaaatctctctgagccttaatttccttatatttaaagtagacacaataataccactaccttataaggttgttttaaagtgctcagcacagttattggcatatatacctatatatgaaatgctcaataaatatgaactcattatttccttaagattttcataggtgttatttgacaaaggcttttatcatcaaataagtatcatttatgtctggattttaaaaaatcaatcaagttactttagttaggacccattcaagtatttaatatgtgaacatttgatgggaatatctgcgggaagttggattatagtggcaggatgttttcatatgtatttgactccagatttcttaagtatggagctttttgtggggatcatcttctgagggatgtatcctggggaataattatggaaggtgacataaattaataacttattgtcaaatgaataggatcagaacaatcaaagcaaggtgtaatgtaggagtgaagcacaagtttgcctcccagagcgaccagagtagctccccttttacagaagcccctgctctaaatggtgtaataaggacagtgtcaggaatgtgaagtgacaggtggatcctctagactagatgatctgtgctgaaagctgatataaaatcactgtttggtcacacctgtgtatttccggtggtaccagaggagttgtggttttcttcacttggcttctattctgggccagctaatgctgaaattcagaggttatatctgagttcacattcatacattacatgtatgggactactctaaatttattagcaaagcattatatgaacttcctcaaaaggacatcaagaaaagactaaggcctggaatgagagaaagacactggtgtaggtcttattgacagcaaaatttcattatagtcagttaaagctaagtattaaagaggaggcagttgttttatttatattttatgtatttatttttatttattttttatttttgagacacagttttactcttgtcacctaggctgaagtgcagtggcatgatctcggctcactgcaaccactgcctcctgggttcaagtgattctcctgcctcagcctcccaagtagctgggactacacaggcatgtgccaccacgcctggctaatttttgtatttttgctagagacaggatttcaccatgttggccaggctggtctcaaactcctgacctcaggtgatcctcctgcctcagcctcccaaagtgctgggattacaggtgtgagccaccacgcccagctcattgttttataataacagcatgaaaaggactaaggcaaggtatctgtttaactttgtgagaaactgccaaacctgtttccaaagagattgtaccattttacctgtcctctagcaatgttcacaaattccaggcgctctatttcctcaccaatttttggagctgtcaaactttcaaattttagccatactgatggatgcatagttttattacattgtgctttaaatttgcatttattggatactaatgatgttggacaatttttcatagccttatttgtcattagctaatatatctttttgtgaagtatctgttaaaatgtttagctcatttttgttactggtcatttgtttttaaatttaatgtatgttaggatatagacacagacgcatatatatctcaaataaaagtcctgtgtcagatatatgaattgttaatattatcacccagtttgtgaattcattttcttttaaacagaatctttaaaactttgatggcatttattgtatcaatttattctatgcttagtggtttctaaattcagtattagcaatctttgcctaaagttagaaaggtattcaggttagaaaggtatccttctgtgttttcttctggaagactggtagatttttcttttagagttaggcctatgatccatttttttaatactctgaggtactgggttaatgtttagtgttttgtttttccacatagataaccagttgttctcatatcatattgaaaaatctttcctttgtttgttgaattgttcagaaaagagcccaaaaaattaattctatgaatatagatctatttctgcattccctgctctgttcatctgtttatctatctttagtccaatgccactttatcctggttaacatagttttaaaatttaaagtaagtcatgaaatcacatactatatgtcttcccccttttttctttttgaagattgattcaactattttaggaaccatatattttttttcgtatagatcatagtatcagtttgtccatttctacataaaggcctgatgatattttgattgtatttaatttataaatcagtctggagaaaattgaaatcttaacaatactgtattttccagtccatggatataatatatctctccatttatttagatcttaacttttttcagcattttttcttttagatttgagtgtacaggccttgcatatatattgttaaatgtatgcctaaatattttgtttttgatgctattgtaatagtacttttatttaaatttatttttgagacagagtctcactgtcacttaggctgcagtgcagtggcgtgatctcggctcactgcaatctccacctcctgagttcaagcaattctcctgcctcagcctccagagtagctgcgattacaggtccccactaccatacccggctaatttttatagttttagtagagacggggtttctccatgttggccaggcttgtctcaaactcctgacctcagatgatccaccctcctcagcctccctcccaaagtgctgggattatagtcgtgagccaccatgcccggcctgtaatagtactttttaaattttcattttccagttgttcattgaaaatgcaattaattgatttgtatatattgatcttgaccttttgaactttagggtggggtttgtttgtttagtttgttaggattttccatatgcttgattgtgtcacccatcatcaaacagatttttacttcttcctttctaaatttcataactttaataactttttactgtccgtttcactcttttggacctccagtacaatgttctgtagaagttttgagagcagccatctttgcattgtttccaaatttagagggcaagccttcaggtttttatatacaggatttttttgtagatgacctttattttcatgagcaattttttcattttcagtttgccgagaatttttttgtgtgagtatgttgagttttgttgaatacttaactggatctattgagagaattatatgtttttatttttaatctgtcagtgtgatgatttatacttactgattttgaaatgttcatccaattttgcatgtccagaataaaccctcatattgtcatgatttattgtcctttttatatattactggatttgatttactaatattttgtcacagatttttgttcatgttaagaatttttttttttttttttttgagacagagtttccctcttgttgcccaggctggagtacagtggcgcgatctcggctcagtgcaacctccacctcctgggttcaaatgattctcctgcctcagcctcctgagtagctgggattagaggcacccgccaccataccagcgaattttttttttcttttcagtagagattgggtttcaccaaattttgttcatatctttgttcatgaaggatattggtttgtttggtttgtagtattcttttcttgtaatgctgtgactaatgtgagggttatgctggtctcattacatgagctgggtaatgttccctcttttgtgattatgtgaaagcctatgggtaaaactggtattatttcttgctcaaaagaattactcatataactatctgggcctgttgtgtttttttttttgttgttgttttttttgagaaggagtctcgctctttcgcccaggctggagtgcagtggcgcgatctcggctcactgcaagctcggcctcccgggttcacgccattctcctgcctcagcctcccgagtagctgggactacaggcgtccgcctccacggccggctaattttttgtattttcagtagagacggggtttcactgtgttaaccaggatggtctcgatctcctgaccttgtgatccgcccgcctaggcctcccaaagtgctgggattacaggcgtgagccaccgtgcccggccgttgttttctttttgggaaagcttttaattatgaattcagtgtcctttttagttattgagattttctgtttcttcttgtggcagttttggctttcaaggcatttttttccatttcatctaagttgtcacattattggcatacttttctttagattatttcctattatccttttaatgtctgcaggatttttagtgatgttccactgtcactcctgatattagtaattggtgttttgcctttttttgtccttcatcagtcaagataagggtttctcaattttgctaattttttcaatgaacatatttttattgatttttctctgttgtttatatatttatttactttattcatatacttattttcctctttttgcatactttgcacttcattttctttttgtcagtcatcctaaaatgtaagctgtatcactgatttttaagtaattcttcttttccaatataagtattctgagctatgtgttttcctcataggattagtttaactaaatccaacaaatgttgaaatgtcgagtttttgttattattaagttcaaaatactttctaatttctgttttcatttctttttgacctaagggttatttcagtgtgtgttttttaatttaaacatgcttggaattttccagatcgttttactacattatatatgaaaattcatttgaattttagagttggctttatgttcactcttgatagttatttgtaacatttcatattgtcatttaagtttagctaatgtaaaaaattagaaaaaaagtctgggagcaggtatctccaacttagaactacctgagagaactacattacggagtggagaaacataggtttttgttctagatagacctgggttcaagttccggactcagtgctggctgtgtatatgaactagtacaagccttccttttcttatccttcaggttcaatttccagggtatctgtgaaaaccgagggaatggggaatgagagctttgccacagtgctgcacacttgattctaatttctaatcttttatttaattctgatgtgtccaaagaacatactttgcatgattttattctttttaagcttattggtacttaaaaaaaaagtatttgcagactgcctatcttggtaaatgtttgatatgcatttgaaaaagacatatattttgtagtttcgagtggtgtccagtaaatgtcaactaagaaaattggtgtcagtgttgttcatgtcttcaatatccttctgatttttccaatatactttgttattcagttattaaaagagagaatggtgttgaaatctttacatataatatggatttttccaattctctcttcagttctgccagtatttgtctcatgtattttggaactgtgatatttaatacatgcttatttaggattgacaagtctttttcatgaattgactcttaaattgtgaaatgtccgttttttctctgttaatactctgtgtctaatatgaatgtagccattccagctttctttttttttacttttttaattaattaatttttttttggtagagggacggagtcttgctctgtcgcccaggctggagtgcagtggtgcgatctcagctcactgcaagctttcttataattagtatatgttttttccattattttattttacctatcagcatctttatgcttttatacttatactttatacttaatgtatgtatcttatttacagcatattattgggtattggatccaatctgatcatttctggcttttaacttgaatgtttaatccatttttctttaattattaatatgactgcctttaagtttaccatcttgctatttgttgtccacctgtctttatttttatctcctctagactaattggtattttcattgtattttattttatcacttttttgagcttttggctcttcctttttgtttggggcttgttttgttttgtttcctctagagtttataatatttttcctaaacttatcagttgatcttgaattaatcactttacatattttatgagaaacttactatggcgtatttccatttcttccctcccatcctttgtgttgtgctataatacattttggttttgcatgaattacagtgtaccaacatgtattgtgaaagtttggctttaaataactgtcttctattaagttaagaactgatctttttttaaatttatttgcttattttttatttctgacactatccattcttggtaacattttaatctgaagaactatttaatgtttctggtacatctgctggtgacaaattctctcagctttgttttaatctgaaaatgtcctatttcattttaatttttatatttcaaaactttactaagaaagttttcaaatatatggaagattttaaggaattacacagtgagcagtaatacagcctacctagatcctaccattaacattggttatctttgctttatcacatgtctattcattcttctgccagtatatcaatccatcttattttctgatacatttcaaagtagatgcagacatcagtaaacatttaagctccttatcattatcagtgttttaatatttatttgtaggtttcttttctaggtaaaatttgcataaagtaacaaattgcataattcaagtgtaccatttgataatttttgagaaatgcatatatatatgcattacctaatatcctattaagatatagaatattaccatcaccagaaagtaacattcttccccttatcagtcaatcctttctacccccaccttccccacctccccaaacaatacaactgtttttatttccttttttagaatagttttttttttatatattctagaactctgcgtatgtggacccatacagaatgcgctactgtataactgtaccttcactcagcaaatgttcttgatattcacccatgctgttgtgtgtatcaggcattttctccttttgtttgccatggagtggttttgttttgtttttgttttgtttaagaatgcagaatgatttgtttattcattctctgggtggtgaacatttgggttgttatcagttttggggtcttttgaataaagcttctgtgaactttcttatccaagtttcttaatggactaccgcttttacttctctgagatgaatacctatgagtggaattactgacttagttttatcagaaactgttagacctttttttttccccaagtggctgtatcattccatattccaccatcaacatatttacatcttaaggatttggtgttgtcagccttactttgttttagcaattataggtgagtgtatggtggtatcttactgtagtttaattcttcatttccctgatgtctcaaaatactgagcacttacacctcatgtgcttattggccatctgtatgtattttttgatgtgactgttcaaacattttgttcattttataaatagtttgtattttattattgaatcttagctgttcttcatctgtcctggataccagtcctttgtcagacacatgttttgcaaatacttttccccagtctgttgcatgacaatttgttttttcgtgaagtgttttaatgagcagaggttctcattttttatgagatgtaatttattaacttcttctttaatgattattaatttctgtgttctaagaaagctttgcttacccatagtcaggaaggttcacctttgtttaggcctatagtccatctcttttcttttttttcatgaatggtgtgtagtagaaattgaagttcagttttcctttcataccgatatccagttgttccagcacaattaattggaaagatttttactttctcattatgtttctctggtgcctttgtcaatattttcacaggatatgttgaaagtgtatctatttcttttctttcagccctttaaggtattccattgtctcctggctaatattatttaaaatgcaaacggggcagtttttgttgctgctgttgttcttgtttatttttgtgccctttatgtatttgttatgtttttctttggcagattttaagatcaccttttctttattgattttgaaaatcaaattatgatggcctgtggtgtcctttgtgtgtgtgtgtttcttacttagagtttattaaacttctcagttctatgtgtttatatttttcctttactgtgaacaattttcagccattttcttttcaaatatgtctagctttccccctcactctttctcttcttttagtactccagttgaaattaggatagaccactgctatccaattagtagtgccccacagatcactgatctcgttatttttatttcttcctttttcatccttttccctgctctgtgtttgtgtagtttccaatgtatgctggccattttctttgtgatgtctaatcgatagcattttctttatttcagaattgtatcttttagcttttgaatttccatatcttcattgaaaggtccctattgatattttctatttgctgttcacagtgttcatggttttaaaaaaattgaacaaatacacatagaatactcatttttaggtgtttatctgataattccaccacttttgtcaatttttgttctgttttgattagctatctttttattagctaatatagacttttttgcttttttatatagctttttaaaaattatatgctggatattatggatgttacaattttgagttctgaatttcgtaagacagtgttaaattttgttctagcgggtaattaaattacttgcataactgcttgcttttaaaaaagcatcttatctttgttaaagcaggtctaaaatagccttttctgtaaggttagattggacctacttctaaagcatgtcatacctgaagtctctaattaatactggggagctaaacacagtctcttcactctgagtggcctgtaccaaatgtctcacagcccttcatgtgctcctagagttgatctgttcccagctattctttgcctaaccttttaaagtattcccccaaatatgtgtagctttgtatttggccgaagactcgagataatcctgtgcagatttctagagttccatctctaaatagttctcttctctataaatgcaatctgactcaacagcagccttgaactctcatttctatctctttagctcagtgtgaccactttctcattttggctttcccttctctgtgccacagtttaaaaggtgcctttaatcgaaaagccagagtgatcgtagcatttacctcttttttgtcttttctctcacagatcacattcctgtgttaccagttgtccaactttttacaaactgtattttagatatggaaggaaggctagtccaggactagttactcctttaagaacagaagctgaagtccaaagtgcacatgttttaacacactataatagccaaatcagtaacatctgcgagttaatttagtcataggtctctgatttatcataattttaataaagcattccctttgtttacaactcaggagaatggtcattaccacagttccaaaaattatccatcagtcccaataatttagaacggagtagccatgggttctgtggcagggaacacttggaggtgcaagcagctggcatttagttgggacatgcagtggatggcaaggctccaactgcaataataaagatgacggaaatcactcagatttcctagagaaacgtgattgtagagcaagaactcaaaacagggaaaatgccaagagctaaccaaggtggttacctggaaatttgggctttgaagccagttatttacattgaactacaaaagggatggaaaaaatactgatttaaggactaacaaccatcaaggagctaaatctggctacatcctgaatcagaatattagtaaaatcaatgagagaagtttaggagtccagtttggtcgtactacatcatgtctttctgataggaaattctttttttatttttatttttatttttttgagacagagttttgctcttgttgccaaggctggagtgcaatggtgcaatcttggctcactgcaacctccgcctcccaggttcaagcgattctcctgcctcagcctcccgagtagctgggattacaggcatgcgccaccacacccggctaattttgtatttttagttgagacagggtttctccatgttggtcaggctggtctcaaactcccgacctcaggtgatccaccggtcttggcctcccaaagtgttggggttacaggcgtgagccactgcgcccggcctctgataggaaattctttagtctggcattgcatcagagtgaaatctttttgtcaaaacacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccagcttggaatgagattcttctaagctgtgtctcagcaaacatttaacatctacaatgttctaggtgcttacagaagccttccctcaccaccttatgcagtacaccgcccttgccccagtcccacccttcaatcacctctatcacattaccatggtttatttctcttatagcactaatcactatttaaaattaaccagctgatttatttctttacatatttactgccctgaattagaatattagccacaaaagggcagagaccctttccgtcttattcaccattgtatccccagaagcttctggcaaatggtagatgtcaatagataataatcaaattgactaatacacaatttaagccactcctgcttcagacccagtaaatatactgttcctccttcaaacacttaaacttcattatcacaagctaataaagcaactaaataaaattgtgaaacataatttagtaatagacttctaaatatcccagaagtgtaaaatcttatatgtggaaatgttcattgagatactaggcattctagggatatcatggaagaaaaagacataatctctacctgaaagactgtaaaggtatagttaatgagagggagtgaagaagctgacctgtagacaaattacaatataataagtaatgctgtaatcaaatgataaacaaagggaagagtaaaaatttctacacgggagagccaggtttcaataaaaattttattctataaaagcttatataaaataatgatattcgagcatagacttggaaactaaaaagagaaaggacttccagccagaagtcacagcatgagaaacgggcatcatattaaatcttcctgatgtttttgatgaaaaagcaatggtaaatgagaaaggaaggaaggtggttagtaatttggttgtgacagaccttgattatagggctaatgagttaagatctggtttttaagtactggagaattacctcactctatttctgatacttccaaagaaactgcaaaggtgcctaaaatataaaaaataagtagataatgcagaaatctgttcacaatcagatattgcaagttcacctctagaatatgtactgaagaactgtgaacatgggaaataacttccagaaccaagcatattcagcatctggtggatgtcctttgcttttgcacagtgaaaataatgtttttgaggccgatttccaagtagaaaggaaagacaattaaattcctttcatactacactagacaagagaatgaaactatagtggaaaaatattgagatttttactcaaatcagctgcatcaacaattaaaattctaccaataccgtggacttcttcaggtagcaatgagaactccatcccaagatatggaccgaggatggaatgataattttcaaaaatatttgtaaggaggtttaggtgtcaaattgtgacttgaatttgatgaccttctaagcccttcctgatgttatgattctgttttaatttatatattgtcaaagactattcaaataaaaaacaccttctatgccaggtgctggaaacaaaaagataaacataacacagtctagtattttaaaatagtgctaaactctacaatgttatctctgattgttcatacataggcaggtgcatagctaagctgcttggcttatccagctatttgccgggatggtgggtcactgtggtcaccacacagaaatcaattctgtttctttgttgttcattccagtgccagctccaagatacacagtggaactggcttgtggttttggagccacagtcctgctagtggtgattctcattgttgtttaccatgtttactggctagagatggtcctattttaccgggctcattttggaacagatgaaaccattttaggtaagtaacagaaatttgacataaacctcttctactgtcatctttagaacatatgttgtaaaaaaaagaaaaaagaaaacatgttgatttgaaaaacctagattaactggaagatttaagcagattaactttaatttcaaccgttgctattagaaatctttccgaagattattattctattttcttggattaattagtgagtcggtctaaattaacaccctccaaatagaaatataatgcgagccacttacctacttaaaatttcccagtgaccacattagtaaaagtaaaaagaaacaagtaaaaataacgaattgactaaatatatttataatactattttttagcatgcaattaatattaaaaagctaatgagatattttagtgttttctttggtactaaaaatgttcaaaatgtaaaatgtattctactttatccttatagcacatctcaattcaaaccagccacatttcgagtgagcaatagactcgtgactcgtggctgctgtattggacagtgctgatccacactccttgtactcagatagagatctgtgaaccagcagcaacatatcacgtgtagcttattagaagaagaatcttagacctagcccctactgactcagaatctacatttaaaccatattcccaagtgattcatgtgtacgttaacatctgaaaagcacagctctagtgcaaatttgcttagtgaaaagaatagagcatttaaacatacaaattcataggtccaccccataaagattttaattcagtaggcttatggaagaaacacggaatcgatagtttttaatgagatgtgatttttctaattaagcaacttcgtgaaagattggtccattaaatctaattatatttttaattttagttcttttcagatataaataattcaggcagtttcacaaggttttgctcaatttgtaattttaagatattaatgagtgataggcttggacaggaagttgaaattttctctacagtgttaattgccagtacctatgatttaccttctggctttgttaatttacagttgaatgggacaaacctcactctttttccactgtaaagcaacctgtaagatgagagttgaggatatatcagataacattcaaaattacatcttcaaatagtcgttttgcgtggagacttgttgcaagtagaaaatcgcactggaatctgtcacataatgaaaatgtctaatatgcagaagttagatttaagaaaaatgtaatggtattgagaaactttcctaatttacattgtatctgtgttccttttgctagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaagtaggtatttcagaggagtacaaatgatgctaccttgaaaggcagacagaatcattagttttgcattatgggagagagtcatggcacagcatctttggatatttaatgtccgatgctctttgatgtaacagactcctctagaaataaaactacgttggaaatgtatactattcaactcagtttatggtattaaaatattttcccttgcaatctttcagagatgcatgtcagaaaagcatggaggcacagtggattagagctctgttaaagggccatagctgtaaacatcctgtttattcacatttagatttttcggtttaggctaatctacactggttggtctagaactgttttacaagactgagaatttttttttaaagcagttttattttggttttagaaagacagaggtttacttggttttactaaaagtgagtggcggaagagtgtgggtagaatttttccttatgtgattcactgataataattacagtattttcctgtggcatttgctcttttttttccccctcacttttcttttcaagcaaaatagtgctactcaaattccccttttccttgggtctatttcttcttcctgtcagcttatacatttgagggttactttaaaattttataatagccagtgtaactagaaggtttaaaaagaaaggaaatgcctaaattcttgaatgtgttaaaataaaagtacaactcctttttagatccgcacagtaacacacaaagtaatttttcattggtgtctttttaataaatatataagttacattcccaaacccactgttaaactttatcctgttgaaatgcttgtaatatatctaatcataagcaagacaaaccaattttactcctctaaaatcctgtctacattcatcatttaacagtttttttttaaatattgcatggataattgagatagacttgaaattttattctcattttgatttagttggatcagttattttatcttcccaatcatcaaccaaaagtccatcataagatgtttctttcagtataatttttccaggaagttatgacttaattatacagttaaaggataaattccactcattttaatacttaatttccccagtcatttattcacccatttatttgttcgtacagccattcaataaatacttatctaccacggaactgggtaagaccctccaataggggttgataattctttgaagaattcacattctgcataattactcttgcatcttgcatttgttagttagcttttgcttccttttttattctccctgccgctcttacccaatcttctttgactctgggtctcttgccatgcttgcacatgctcagcctccagtgccactgcttggaacacacaatcattcctggattctcccccaggctgtgcatgctagattttaatcacaaggctttccctactgtttctgaacctgtgaagattaaggggcaaaatgacttcataaaggaatatatcaagacatgatataagtttccacaattctagtaagttacctagagttggcaaccatctgaaacacaggtaaaggactatgcaatcctcgataagcaactgtgaggagatggattggttccaagaatttagtgacagaaactaatcagggcccttgacagcagaataaaattacatggcatttccagttttcctgctttttcttcttttttcgttgaagaaagcatttgcctgttagtgcaagtagacacatcatctagcagctgccgaaacacatagctttatagtaatggtcggagtttgaggagaaagatccagcgattaatttaggctccaggggagaaagaagtagaaagcccaccgaggatgtgttaccagccaaaatgccattcagttggctagattttgttaagcttctagtctaaggacatagtgatgttagagtcagagaggtatccaacaatagagagggactttcagaagatgaaggtctctaactttgttgtcctgtcctagcaaaagataaaattctatttttttgattatataacatatacctttttgagtgtccattggtactagagagtttatgcatggtgcatgggtttctttggtgaagaaagggctcatgagctgacgtggctagaccataagatgccacacactttaaagaaactgctttcagtataatgtgtctactccttgtgtctcaagtgttgtttttgaagatcaaggtcacaacactatactaccttttggcttcatgcctgtttggaattctttttagaaatatgtgtatatagtttctgttttccctgaagacagtggtatttaacaaagagagtttgcaggtataaggattaagttgttcacatttttgctggtaaaatgtttcacctcaattcttaggctggtaccctaagttccctacatttgctcctcaagcctcaatgcttttggggagtttttggccaacactaatccccatggttgttttctttcccagttgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaattttttttaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaattttattttgtgcatgtgttttatgtcatttggtcatttggtcatttcacatttggtcataagtgaaaacagaaagaatttattatattcacaaagaaatataataagttacattagttaagtgtctttctgagataaatctgagtaaaatgggaacttcttatcaagaacattttctttacatggaagtaaaagttacttaagtaaaatgaattgttccagaatactaggacatattttatgggtgtatatgtgtttatgtgtgtatgtgtatgtgtatgtgtatgtgtatgtgtgtatgcagagagacagaaagactgtcaaaaagatggaaagatacagagagacagagaaaaaggagagaaagattattttaatacaaaggaaaacaagcttattcctttttactcaacttggaacttaggtcgtttacaggaatatttttcatctaataggctttaacgcaaccacacggtagttgctttggaaatagataaaactaatgccatgactttagttaattgatgatcatttgaatcaaagatgcatttctgttacaaattttgaataaatcagtgattaatatttggaaacatattttattttcggttaataatacaagtccatagtgacagggatgcctttttgctttaaaaaaaaaaatccctggccaggcgcggtggctcacgctgtaatcccagcactttgggaggctgaagcggatggatcaagaggtcaggagatcgagaccatcctggccaacatggtgaaaccctgtctctattaaaatacaaaaaattagctgggcatagtggtgcacgcctgtagtcccagctactcgggaggctaaggcaggggaatcgcttgaacccgggaggcggagattgcagtgagctgagattgcaccactggactccagcctggcgacagagcgagacttcagaaaaaaaaaaaaaatcctatttgttcattttactgagccctgtaacatgctcagaattggttagcttagtaaaggttcttctactgaagaattaattttccttttgcaaaccagccccaaaagtgtaggcttaggatcaacggatcgaagttacaaggcaacagatttctgctcagttagaaaatagctgtaaagcagagttcgacactaatggaattcactatctttggaaatactaggcctgccattaccagaggtatataagcatttatttgatagattttcattgagattttgtatatgagttttttgcactggataagtggttttgagtctgaagttgtttccaaccctgaacgtgttaagtgacctactagaacatactggtgactctttggaagattcaacttcagcattttgcatatgatctacctggctgtgattaaccttccttaaactctcaagatttttttttccagtatatactgatgtcactagctctttaacgcaagtaaatacacagtatggtatgagagacgggtttagcaactagtctatcttatttctctgtttctactcaaggaatataaagtaaccttagtaatgagttaggagatggagtgttttagtagtaattttaatctacatctatttaaaactgaatagacagaacttttacacactattactcttataaatccacatagtaagatgatattttaaagttagcattaataattgatacagattcaataaacattagtccatatatgattttactattgtgttcactagacgttgagcaacagtaatttaatcaaagtgatttatgcaatgtgtactgtgtgctagaaattcacatgtaggcatctaatttgtttatcagccctacgagtttactttatcatatgcattttatagatggatgaactaggactcaaaagatattaagatacaaatagggataaatggagaaagcaatatttgaaaccacattcgtcttccaagttaaatatttccttttttctatacttcaagttttaatagagaaaatg

SEQ ID NO: 12056 - DNA, 17023 bp, Human
agtgcagggatggctccagtgagtagaacagtatatgcttgtagcaggtaagactggagccaagctgattaaaattcaaccccaaagaacacacaagtaataaatacatgaaaagatgcttatcttgactaatactcaaggaagtacaaattagaaccacattgaaatatcttagcctatcagattggcaaagatgaaaaagactgataatgtttactgttggtgaaggttacaggcattcttacattgttggtgagagcaaaagtctgtgcaacactttttatgtagggccatatctcagcatctatcaatattttaaaatgctaaccctaagaccccacaattctacccctagcaatttatcctacagtaggactcactctgttgtttgaagatccatgcccagaattattcacgaaattcacttaaaatagcatatatgcttgaacccaggagtctgaggctgcagcgagctatgatcatgtcactgcactccagcccagcctgggcgacagagcaagactctgtgtctaaagaaatgaaaataaaaataaataaaatagcatatacaggcaacaatccaaatgttcattgcagaaattatgattattattgtttttcttttagaggcagggtgtcactctgttgcccagactaatcttgacctcctgtgatcctcaagagatcctccggtctctgcttcccaaagttcttggattacaggtgtgaggcactgggcctagacattgcagggattattaaaccatggtgcatactaccattaaaggtatgaggtaggttttatatgctgacctagaaagatggtgcaacaccataggggaacaagaaggctgcaaagtggcagcacagcaggagtctttaagaaataggtatttgtttcagcttaagaagtgtctggctgggcgtggtggctcacacctgtaatcccagcacttagggaggcttaggtgggcggatcacttgaggttaggagttcaagaccagcccagtcaacacggtgaaaccccatctctactaaaaatacaaagaaattagctgggcttggtggcaggtggctgtaatcccagctactcaggagctgaggcaggagaatcatctgaacccgggaggccgaggttgcagtgagcctagatcgcaccactgcactccagcctgggtgacagagtaagactcggtcaaaaaaaaaaaaaaaaaagaccgggtgcgaggtggctctcgcctgtaatcccagcactttgggaggcctaggcaggaggatcacaaggtcaggagatcgagaccatcctggccaacatggtgaaaccccatctctactaaaatacaaaaattagccgggtgtgatggcacacgcctgtagtcccagctactcaggaggctgaggcaggggaatcgcttgaaaccaggaggtggaggctgcagtgagccgagatcacgccactgcactccagcctggcgacagagcaagactccatctcaaaaaagaaaagaaaacaaacaaacaaacaaaatccccaaaaagcaaaagtgtctgcatggacttgtgcctaactactcacagtggctacttcttgggggaggtgaaaggggaccctgttaaagaatttttcttctgtattgtttttcttcaactgagtctgcattaattttatatttaatactctccccacccctgatgctcacaggttgctttagctggtggaaggagaacctgcacctctggttttggcaaagtgtagaaggggacaagggcactgctctgcacctgcacaggttcttgcctcctggggtcagtttaatgaatctcagtggtgtttcttgggaagaacacagtggacactcacttgccagtcagtagacaaatcactgaagtccatgtctggcagttctcaatgtcatggggactgtaaggttgtcatgtctcacagttccctgacttagaagattagtggtgacagacacttctcagctctgctcgggagagcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggtgagtctgtgctttgggcttcccaacctctcaagtcagcatgaaattcagaaggcagagagggacatgtggccctccaactcggggcccagggagccactgtggcatttgagagcgccaccctagctttacctcctctggtgtcctggccttgtgtatctcttagagatggcaaaatttgcagccctgacctcaaggattacaaactaatttccagtcctgtaggggtcatgggttctgctgtggccagtgtggcactgagtttgtcaggcagaatttctaattatggaaggaactctgcttcctcagtgattgaactgacctttgtgggggtgcctttgtggggtgagaatgggcatacttgggcctcagttgtgatggccatggggtggagctgaggtctaggcccagggctgggaaagcttctaccaaccccgaggcatttgggtgttttagggcagaagaggagccaggaggatgggtatgccccactggagctgtgtgtggggcagcaggtgagggtgggattccagagggagggtcaacccagccaagcagaggaaggggaggagagggtttgttttggaaagaacatcaccctctcagtttcctggggtctggatagcctgttcttgtgatgagctggaggatgtgggccctgcttggatcctcctctcccctccctgcccccattttctcttcctgtgatttatgctgttctgggctcaccctcttcccagagctgtcacgctacagctgacaggcagggcaggcgttttaattattattaatttttttttgagacagagtttgagacagtatcaagagtgggtatcctctcagcgtgtcttcaagtagcatcccagagccccgctcctgggtacccacaacatgaacaccgtccagaagcaagggcagcctctgcaggtggggcgggggttggaaaacatttatcaaacggttgagttgggtgcaggggatgcaacatgatcaaacagggtcttgcctccaggagcctcatgtagggacaacgcacagtgatgaccttcaactgcagtggggcagcaaggctgtgggaggggtgttttgggcagagcaggcgacgtgggtacctcttcaccaagacagcaggaagagcacggacatcattttcccgtctcacctccagactcccaggggactgtgccaatatcctcactccagccctggcccatggccactgctcaacccttgggccctgtcagttcagggctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctgctcccctctgccctgggtatgtgcccttgtccacccaacacctctgcagtgccaagtccagccctgacttcttcctgagctgtggcccagcgttcccacaggcatttacctcacggatgcagcactgcccctcatcctcttctctgaaagtgtgtgggaaatgcttcttggtgccatctctctcccaccctgccttccctgcaccttctctatgaggtgtctgttgtctctgtacttgcctccagctggcctttcagaccccatccctcctgcctcctgcccatccctacccctgtcagcaccttacatactctgtgcccaacagcattggggattcccactgtgctgaaggaagtcctcatgtggtccagagagggagctggcccctgctcccatttccagcaccattttctggcacaggctccatgtccccaggctccagctgcttctggggtaccaaggtctgcatttcttcctcttcccccagcagacagaagaccttgctggacaggtgtccacttcaatagtaacttctgaggctgccagcctcctgaatggtccagaagaaccagacccttccccgcccccattaaaaaagacaaaatatggccaggcatgttggctcatgcctggcatcccagcactttgggaggccaaagcaggtgaatcacttgaggccaggagtacgagaccagcctgacaaacatggtgaaaccctgtgtctactaaaaatacaaaaattagccaggcgtggtgactcatgcttgtaaatgcttgtaatcccagctacttgggaggctgaagcaggaggatcacttgaactcgggaggcagaggttgcagtgagccgagatcacgccactgtgttccagcctgagcgacagagcgagactccgtctaaaaaaaaaaaatatatatatatatacacacatatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagaccaaagtgatcatgggctgaaggctatgtccacagatccaaggcgggataggctgtgctgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgcgagtaagggtgtatgcatctgccctgactgcctggccctgtggtcaaggatgggggaaggcagctctgcctgcagctccaccccatttataaagcactgtggtgccttctgctggggcatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaacttcccctcagatggccatacccccttgtcgctgtacccaactctccggtcctactttgtagctctcaggtgtcacatgtggatcctgccctaccatcccccttccctgtctagaaacgaggcctgctgagcttggagccatcccactccctgctctcaagccgtctgctcctgggttagcctgtggctggcctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggggttgtgcgggttccttaagggctgtagtctgtgtgcgtgtctggttttttcctcctccttatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgcccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtggctcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgcatctgcacctgtgtctgcttgggagtctctgtcacaggggaaggacaaggtgagggctgggcactaatgtctgtatgaggtgggtggagaactagggcatgtttgggggactgggttgtccgatgtcaagcctctagggaaaggtttggcccaaactgtgctggggcatgtcctctaggggtcagcctggacctcagtctctagtctccctacttttacctccctaccttcattccctggaccgactgtagtctcccttccttcactctcttgacgcctctccagatctgacttgcccgtgtaccacaggtcagagcccatcacttcccaggcctcccagtgcttccctggacagattctgggatcatttactggtgactgccctgctagggtgtcagctgtcagatcctccccaacccccgagctcagctctggcctgaagtacttaccgtgggctcctgatggtcactgtctccagggccaaggtctagaaccttcacctgcctcaccaacaacattctcaggatcgattgccactggtctgccccagagctgggacagggctccagcccctggctcctcttcaccaggtgagcatggagggccatgcccacctggacagggatgagggtgagttccccaggattgaagcagctatgccaggacagtgtagcagccccgtggtgctgacaaatgccctttccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacggtgagcagcagctataggtctggggcggggccgcttggcaagaacatcctggctgcttgggggtttggagcagggccttgcagcctgtgagtggcccagtgagtgttctcagtcccagccgagtgagatccagggctgggggcaggcttggcccttgggaggggagggcccatatggttactgcaggggcagggttttggcaggaaataaacatgcacggctgctagttggggcaggggctggcacttgagtcatgtgaaatgcacttcagtcataccaggaaggactccaataagatgctgggaaaagcttccagcagcagactgtgaaggaaagggaaagcaagatttagaaaccacctagtctaggtgcagaggccagaggaagtcattgctgtcctgtcccgcctggggcttttgtggaccagtctcccagtgaggtgcctggtctgagagggccttgaccattccccttgggagtctttcagaccccagtcttgtgtgttctgactgacacacccagacccatggggcttcagcctcacatggattcactctgttccagttaagctggacccgccctctgacttgcagagcaacatcagttctggccactgcatcctgacctggagcatcagtcctgccttggagccaatgaccacacttctcagctatgagctggccttcaagaagcaggaagaggcctgggaggtaacactttggctggctttccctgggggcctctctcctgggaacagcagtccagggtagactccccactctacatagggagatgtcaacttgtagtgatgagaagggaggaactagagcggggtgtgtgtgcacacacacatgctggcatgcagatgtgtatgctttatgtgtgtgtatgggagtagggtgagtgcgcctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcatatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaacctccaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttggcatgagccagtgaaagaagtggagatagagaaaagtggagagaattgcagggtctcatgaggggaaatagaagggacatgtgggtggatgagatatgagtggtgacccctgaggtggggaaatggggcacagccttgcggggaggttggcgaggtctatttgcacctgttgggttggagccccaggtgacatccttgtgggagggtcagtggatccttggcagcaagtctggtgctcagggagacactgggtggggtgggagccacagaccttctgctgatggcaaagacagggttcctggaggtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagcaggacatggggggcaggggttgcccagagctctggcctgcccaagatgttggctttcatgagggttggcggccagtatgggaggcttgtcagtgcttggagccttttttgtatattcagtgaatttcaatttatacgcgtatctcaaatggggaaaaattagctttattttccattgctgatttctttttgttctcaggtctctagttccattgttgattgaaaaaatgtaaatttctcatgacttatctctgtcccctctggtttgcagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccggatcacatgatggcaccacagctgaggagtgggctctgcacttcccccccttccacccatgttgggctcctacagcccaggcaccagtgagcaacttgggggttgcatcagcccctcccctccctgctgggctgttggttcatgccccctgggtgggaggagggggagagggagagctccagtgagtggtctctggtttttcccctcagactcctcactttgggcaaaggacaagaggcagtgagggcccctccctggggtctgggccaagctgaccactcttctccagaatcttccctccctgtccccttcacactgtggctccagcttactatgcagaaaaatccttttctctctcaatgaggagcctagttttcaagatttttgtccaaaaatataatttgaaccatgaaccgggcatctggctcttggcagagtctccctctttccccaaggtggtagatgtgactgtcaggagtctgggcagctgacgacaaggctgagcaggtcagattgtgactgtcccctggactgtcatcctgttgcgggcaccagctgttccctagagaactaggacacctgccacgggttatttagacccgcgggtgaggatctggtgccataggttggtctccagggagcactgcagtgatggagggtgttgtgtgtgtgatgcatgggatggaggctcctggtcccaccaagggaacagcttccttttggaggcgggggcctcctgtggccccacagaaggatccaggtctgctggccatagccgagtgctttgaaagtcaccagtcctgacagcgattcgtgtgtgtgtctgtgtgtgtgtgtgtgtgtgtttatgtgtctgtgtgtgttcgtgtgtgtgtctgtgtgtgtgtttgtgtgtgtatgtctgtgtgtgtgtgtttatgtgtgtgtgtctgtgtgtgtttaagtctgtgtgtgtttgtgtgtgtgtgtctctgtgtgtgtgtctgtatctgtgtgtgtttgtgtctgtgtgtgtttgtgtgtgtgtctgtgtgtgtttgtgtgtgtgtgtctgtgtgtgtgtttatgtgtctgtgtatgtttgtgtgtgtgtttgtgtgtgtgtgtttgtgtttatgtgtgtatgtctgtgtgtgtctgtgtgtctgtgtgtgtatgtgtctgtgtgtgtttatgtgtctgtgtgtgttcgtgtgtgtgtctgtgtgtgtgtgtttgtgtgtgtatgtctgtgtgtgtgtgtgtttatgtgtgtgtgtctgtgtgtgtttatgtctgtgtgtgtttgtgtgtgtgtgtctcgtgtgtgtgtgtctgtgtgtatctgtgtgtgtttgtgtgtgtgtgtgtctctgtgtgtgtgtgtgtttgtgtatgtttgtgtgtgtgtgtgtgtgtgttgggaatgcccagtctctgcagctgctgaaaggccctgaggcacatgctgtcaggagctggctctgtcctgggcagatatcaccatctgtacctcggttcaggctgccgtgggcaccaggccctgtgctgggggagtgctgaggagcctgaagggactcagggtcccgtgatgaggctgggctggcacatggaggaaagacagaatgtccaagacacaggcgctgcttggcctctgggtgtggacctcaggagggcttcctggaggaggagggatgctgggcttgccagaaaggaggcagctgctcccaggatgagttctgaacatgctacctgagcccttccctcctcccgtgctctgttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgttccaaagtgttgatggctgggagaaggggccagaggaggagtgaggggtggggtttgtccagccctgggctttccgggctctagagatagcatggtgtaggctcaatgacagttctggggacagcaagttggaggttcaggggcagcttcaggacagcaggatggaggctcagggacaattcctgggaggccagtgccctcgttcctccttgtcctcatcctcccacttgctccaggaaactgagagctgagcctggagcttccagacagtcagtgctgggggtgaccatccagcagtgatggtggcctgtgaagggtcctgcttctgtcctcagcctctcatggggtgggcttgtggaggagctgtggtctggagagagtggcagttggagcagaacgtgcctgcgtttgtttcctagggctgtcgtaacaaagtgccacaaaatggttagcttagaaccacagagatttgttgtctcacaattctgaagtccagaagttggaaataaagatgttggcagtgttcccaaccacatgttcttgggctcccatgaaacagaagttgatatgaggccaaggaagcttcccagacaagactttattaagtcttatgccccgaaagtttgggcagaagagagacggtgcaggaggaagaattcttggctgactccccaaggggaatgcattgtggtgtcttaaggagggtgacatacataatttatgagctacatgagtgtcattgcacatatggggtggagcgaagggtgctcagacgcatgctaacacatacgttgcatgatcagaaaatggcagataagcccctccctgggtgaggactttagtattatcataagaccagggtcattctcctggccttgtgcacaagcaggtgatggagtcaactcccgtcagtaagacttatggcgggatgctgcttatcttagtttatttcagacagttggcaaggtctggccagcgagtatggcacctggagggtggtgctgcaaggtctagtggtcagcgggcacgtatggaacaatacgttagtgggggtgggccgagtcccatttatactctctcagcagggccatgctccctctgaaggcactagggaaggattagtttcaggcctctcttcagcttctgttagtttcttggcttgtgacaccaaagctgtaatctttcttttgttttgtttttgtgacggagttttgctcttgttgcccaggctggagtgcaatggcacaatctcggctcactgcaacctcctcctcccaggttcaagcaattcttctgcctcagcctttggagtagctgtgattacaggcacctgctaccacgcctggctagtttttgtatttttagtagagacggtgtttcgctatgttggccaggctggtctcaaactcctgatatcaagtgatccgtctgtctctgcctcccaaagtgttgggattacaggcatgagccaccgtgcctggccaaagttccagtctttacagggatttttccttgtgtgcatttctgtgtccaaatttcccctttttaaaatcacaataatagtgaattaaggctggccctaacgatttaatcttaacttgatcatctgcaaagacactatttccatataaggtcacattcacagctactggggttaggacttcaacctagagggcctgacttctggcccaacacatcatggcccatcccagcatgccccatccccttcctgggtgccccaggcagatcacaggagggcctgactgctgggctttgggctgacattgggatc

SEQ ID NO: 12057 - DNA, 16002 bp, Human
gattgtcaaatgcatctgaggcatgcagaggaagtgctgggcacacagctagtgggaatacctcagcgtaagtggccaggagatgccaggaatctccactatttcccttccagtgtgccagcctctgggttttacaggcgcatgtaattgcagtacctctgtgcacatttccctactgcctagaatgactttcttgactatccatgatatataaaacacagataccgaattgttcccttacctcttcctctaggttcaagttaatatgttattggttgccttctataatatgttatctcattgcctttcccaacaagcctttgagataagtattaggtccattttatagacaaagagactgaggctcagcgagtaacttggccaacaagttgctcccactgctcaacagcaaatgagcggtgggaccaaaattcaagcctgtgtctgtttaacttcaagcctgtgaatgtactaaccggtgccctgtgccagctagtactttgctacagtcataacctagactgaagtgatagccatgcccctaaaactccatgctgtggtgacagcactgagcagtgtccaagaaggcttgacttctaggcctgtctctgccactcacaaactttataagggaataaagtacatagcaaggtccgcctagagttagtagcagttctgacaaagctgtaatttgtcaatattccgtcacccaacccaggaatgctcatttttaaggtatttgactgaaacagttgagcattgcccttcatatagtttaaaacagtggtttcagaaccactttcctccagaccatgggtgctctgcaaggtgaatggagttgtttcagaatgtttcaataatcatccctacctcattcgtaagtggcatgtaatttttgcaatcggaagattttcataaaccctggatactaacctagactggtttctatatcagatggtggcttatttaacataaaattatgcattttactatttcatggtggatatatcaatatgttgtggtcttttcccaatgaacactttgattttcaggggttctggaccctgaacatgggttaaaccagtggttctcaaggtgtggtcttagcgccagcagcatctgcttcccctggaaactttctagaaatgcatattctcaggccctcatgcctgctgaatcagacactctgggggtgggactcagccgtctgttgtagcagtgcttccaggttatcctgacagtcactcaaattttagaaccactaggttctctatatgggagagagtagtctttgaacttggaaaacaagagaagctaaacccctacagcaagggctggtgaccaggtcgttgccagaacctgaaagttcgcctctgtattaccgttcctgtccctaacccaagtccttcagttctgggtgctccagcacacactgctttgtgctgcagtgatacaaatgtatggctcatctccccagctggcggggaggcatttaacacactgacttaataaatatttattgagtaaaagtatttgctcctaggaagcgggatccaggtaagccctttttttctctctcaactgcttctagcccagtgctctttatgtagtaagcactaaataaacaactgctagatgttgatccagaaagtcacattccttctctaagctttaagtttctcatcttaaaaataagaggattgtatcagatggcttgccttaggtctctttcagctccagagccccaaataccctatggttctctatttagagatgttcttccccacagactgccatagaactcctgtaatttacttagtatttgcttgacagtatggagaagaaaggggagaatcaagattttatttaaaaaaaaagtagctagaatgtgtatatggttcacaaaggtaacaagaattattgacattctttcttctcttttttcttcctcttccttctcttttcctccttctcttccccctgcttctctcccttcttatagatgtgtcaccagcagttggtcatctcttggttttccctggtttttctggcatctcccctcgtggccatatgggaactgaagaaagatggtaaccagcctctcattattctctgtggaggccccacttctaagccaggactcttgggcagccactggtgggaaatcaaactgaaatgggcaaccatgcactgggtcctctagagaaagccatcactctgggaaaatgcaatgccatatctctcttttctactttgatggtatctatattgtttggttttcacattggatgacattggtacactatggtggggaaagacatatgatatatgatatggtggggaaagacatatgacatatgatattttccaatattactaaaaactgtttcacacaattaaaattccaaagtagaggatttgcaaagtataacaactgtgttcgtttctcattccaccacatgatactgccccctcagttggcactgtgatgacttacctctgaccaagcactttggaggaagcataggattcagactcacattgacttgggttcaagtcctaggtctgtcaatgactggttatgtgactttaagctgggtcacctctaatcctgaatttcctcaactgtaaactggatgttacaaagtggatgcctaccacgtgggttatttagtgggttaatgaatgcagaatacaactcgacagatagtaaagtgaaagtaaatgtcagctagtattactattttggttgtttaaaatatctttcatgattcaagagatactttttattatcccaatgatcagtaaaaattattagtagactaatagaatagttaatggtaaaataaggagttctgcccatccttctagtatctcacactcagtaaatgtgcattctgaccgttggctgtacctgaaagaccctcagatttttatcactgaagccaacatcataatgttggcgattactatctttaattgtataataataatagttaatgtttattgagtgcactgtctcacttaattctcacaagagccatatgaagtagagactgtctgtatcccattttacagatgttggaaactgaggccagagagattaagtaacttgcccaatgtcacatacctggtaagggtggaacagggacttgatcccaattctgtcttgcttcaaagctggtgcacttaaatttgtgaaaacgtttttacaaggacatgaagtaattttttcccaggtctttggagagctgaataagaggaaatggacataaattaaggatgaaaatatttcagctgatgatcagaaataatcttttgatattctagaaagtaccatcttgaaatgggtacctgaaagaaatctgggaccactcctctcttctcaagaattttaggaagacagaatccagccaccccttctccatgagaatttgagagatttagacactctcttaagtaaaggcaaaggcctgagccaggggtatatggcagatcccttccaaccctgggattgttagcgagctcaggaaccttggtcctggcatatttgaccccttagtgacttctgatttggtaaaccacagaaattccagaaaatcagtgtgagaaactctccgaggtgtgacttaggagggcagacgatgcagtgaggctaagtgccaggttcttgatgctcctcttcagctttcctcctgcagctgttttccctgctgttgagcaaacatcttctagggcttccgagcctcagttgggacaggaaagtaaccatgctcttcaggtgtcagggggacaaaaaaaaaaccaagaaaaagccaaaagtgccacatggttttacatcagcacagctaatcatttccccagagttggaccccaaatgcttttgacctcttatttttgttatccattcagtccttataatccaattgatgtaaagtgaaaactttatattctacaatgctttacatccagaggccaataacgagaaccaccatttataaagcatgtaagggcactgtgtatgagcttatataatccacatatccaccttctaaagcaagggctaatatttttctcattttaaagatgatgacactgaggcttacagtagttgaatgtcttgccaaaggccacaagactggagcaagggctagagctgcttctaaatccaggcctctgccactccaaaatgcaggctctcaaccactgtgactcataaacttgagcaggcatcagcaccatctggagagcttaagaaccatataactaaatccatcccaaggtttctgattcagcagctgagaatttgcatttctgatctattccaaggtgatgctgctgatggtgtttcatcgatcatgctttgggaactactacattaaacaattctattcaattaataatttatgcatggattaaaaaaatgaatgaagctttgctatgacacactctgaaatactatactaagccattcctcaaaggccagtttagacactagcattaggcatcccttgcaaagcccaagagacaaaaggtctgagctgtagcccttgtacttctgacttgctgtgaccatgcttagatcgttggcctcagtacgcttcttcattaaatgggaagactaagctctactggactgcttcataagagtgtaagatagctaaaaataataataataataataataatgcagagagaatgaaaatctccactggtgatttaaaacagagggaacgaaatccttaaatatccatggaaaattgttaagagagtttctctgtacagttggctgactcctcagtctataagtaacgataactaacaccgaatttactgtgtggcagacactgtgctaagtactttacgtgctttttttttttttcatttaatcctcagtcaaatgtaaggcagatactgttattattatcattttacagatgaggaaactgaggctcatgataatgaaataccttgttccaaatcccccagctggttagtggagacaggatgacagtcttggttcgttgttctcgacaccctgagcttttaaccactatgttactctgctgaatattgtgccctgccgtattctctatgaaactgaaattgtgctggaagtttctctcccccagacctttggcaaagagtcttgtgctgtttgcagtttttggtatattaaggtgtttccaatctgctaaataatcaaaggttactattaaaggcagccttccagtcaatgagtcgatggcagctataaaactctttgtttctcttttccatgaccttgagcccaagcagggtctcatgccttgagatcatctcagcaagcatttgccaaatacttgttgtaaacaaggttgtgtttaggcaatggggatgcccgaagggttaataaaacacagtcccagagttcctggagcttacagcctggttctccactttatgtgcattccagtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaaggtaattctatacccttggatagtatcaattttctctttcgctcataagagttaaaaacaacaacaacaacaaattgaaaagccaagtcatggtgagtgtaatgaattaacatcaagtctcttattgatgttaattgatgttaacctccattttcctttgctttcctggaccctttgggttatcaaccatcaaaatctcatattaagggagtttcatgatcagtctgaatgcttagcctcatgttttctttaaataatggtgatattatttaatggctaatggaaattaaccgatagtgtatcactctgcactggggtgatagccttcaaaaaatgaatgcctctgccaggcatgttaggtgtgtagtgtactctgcagaatcaacaccccactgggatactcccaatccttatggagctacccaagaggcaacgcatggaagaacttcaccctgtaccatctggtgatctgtgattcatcacaatcaaaacctttctgcaaaaaactcctaaatattgaatttttgtttttttcaaatccagaacccaaaaataagacctttctaagatgcgaggccaagaattattctggacgtttcacctgctggtggctgacgacaatcagtactgatttgacattcagtgtcaaaagcagcagagggtgagtgaaactgctctggtttctcagcatttttctagaactatttcattaagaaattaagggcaacctctcagtgacctatcagttaatgataatgggaaaagcaaagtcaaacccgtgttttttcaaccgcccttccttgtctacattgaagaaagaacatggagattttagccgattgcttgaataaatgtatgtgttggggcaggatattattgggaactgagaatagtctctgctgtgtttgaacccactcatccaaattgcctggccatgcttcctgaagcctcatagcaccaaagaaagggataaacggagaattcaaagctacaaatgacttgctgaaattgcaccttgagtcaaaaataaaaacaagagctccagggcgtagatcttaggggccctgaagcagactccaaaactcgatgaggcctcccgaaattttcccagggccacctcaactccttttacttctgctgacaccactaatctgaagttcgctgttggtccaatgcacctggactttccgtaagaaagcaacttccataaatacaagacctatgtgttaacccccatgtggcttactttaatcatcaccgaagcaaaccccaggtgatcatcctgactttaccattatttcactgagtaaattaagcattggggtctcactttttcatctttaaaaggaaaatgcttactaaagaaatgtttctccaagtgcataaagacataatcagcagaggaatggttaaataaaacatggtacactatactcttgcttaatgtgcagtcattgaagtggataacccaacccatatgttttgtcatggagagctccccataatatgttcagaggggaaaaggatggttacataatcatatgtatacaatttgatcctagttcataaaaataaaatctatatgtataagtaaaatatatatagtggatatatataatgtagagatgtatataacatggattatatatataatgtgtgtatacatatgtgtgtgtgtgtgtgtgtatatatatatatatatatataaaatgtgtatacaattatcttgaatattcattgaaaaagttctggccaggcacagtggctcacacctgaaatcctaactctttgggaggctgagacagaatgattgcttgaggccaggagttcaagaccagcctaggcaacacagtgagaccccatctcagaaaatattaaaaataaaaaaattaggtgggtgtggtggcacacacctgtagtcccagctacttgggaggcagagggaggggatcacttgagcctaggagtttgaggctacagtggggtctgattccaccacttcactccagcctgggtggcagagcaaaaccctgtctcttaaaaaaaaaaagagagagagagagagaaagaaaaagaaaaaggaaggtctggaaggatacaacaagctattattagtacttaaacctgtggagagcagttaaggatgaaggagacatacacttctttcctttatatggatctttatcatctttacttttataattagtgtgtactgatttgtgtattgattttataattaaaatgggaaaaaatgaatttaagtttttaacaagggggtttaataatcagagattctagatctaaaacaaacaaaaacttccatattcatttagtccagagacatgtaagtgctcttgaatttaagctttttctcctggggagggcagtttcttaccctctgggtagaaatcagcccagttggagaaactgtgtcctcagacaacagttgaggccttacctgccttactggctacaatcactaggaactctctccccaatgtgtaacacaggctaatttctgtctttgacttcagctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcagtgagttttggatgattatatgtgctccataaggaaagatactatttgtcacgtgttcacaatgccccatgcactgtggggtaggtggttgacaagcatcatctcttttattctgcatccaaaaacaaaatacgatgtagatactgttatctgcattttaaggaagaggaaattgagtcttagaaaagttaagcaacttgccccagatctcagatcttacagctagccgttcaaatccagatccactccactacagctgctctttactgcactttgattcagctgccagatagtttccatgatgaatcccagagcctaatcaagcataatattcatattcagaaccagggcttccttactaatggcaattattcccaaccaatccttccttagcatttgaaaagggacttctttcttagaatataaacccttccaaaatggacatctttttttttaattggcagatagggatttcaccataagtcatttcctttactatttattcattgaccaggcagcatgataaagtgtaatagaaccagagaacttgcttcaaaacttatggagggtttgtacttggtgggtggggtctagttcacatagggtggccaaggaaggcctctctgaggaggtgacatttagctgacaccaaaaggaaagatgtcagttgtgttaagagcagagggaagcatatgtgcgaagcacctgctaggagccgtgatctttgtgtggagcagtgccaggcctacagagcccaaccacacaccctagcatgtctctgcctcctcttatctagaagacctaattgaggaaggagtctttgtgaaactcactgctgtatccttcatgcacagtccagtggctggaacataatgggcgctcagtattcatggaataaacaagcaaattgagcatagagacaattgactgtaactgctccaagacatgtccgcaccaaaagctatgaaaagacaaaagaaagggcagtaaatagaaaatctatcatctcatccccagggagaggctcagcttagttccatgttcagtgcaaagtgagggattagcacagacagggtggtccttcaatgcatggcccataaccattaaagcagaggtcttctcactgtgcggtcccatctgattgttcagtgatgaggattctgagcatctctcagatcctgcaatacatgtggatctgagatgtggccattgataatgactgccttcccgaggcaccagcgtgagcacctgcggcagaggtgcctcacatttgccagccaggtgctcacagaagttaagtaactatccagtggactcacagctgatcaaaggtgcaagtgagatcataagccaaaaccactgaactccaaagccttattaggaaaataaagcatgtttatcctcttccacagtcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaaggtaagaagtgattcaggtgcagtatattccttggtcagttttacggaggcccaccataaagtgagaagatgaatgatgataataacaatgacatccatgtatcacttaacaacagggatacattctgagaaattcatctttaggcagctatatcattgtgcaaacatatatggtgtacccacacaaacctagatggtatagcctactacgcttctaggctttatggtatagcctattgctcctaggctgcaaacctgtacagcatgttcctgtactgaatactgtaggcaattacaacacaatggtttgtatatctaaacagaaaagatatagcaaaaatacaatattataacaatataggaccactggtcatatatgtgatccttctttgactgaaatgttattatgtgatgcataattacttttcttagcacttttctatgtgtctagagctgtgccaagggttttccatgtttatttcacttaatctacaaaattaacgcaacaaaggtagctgatgttattcttgtttttttacccccttttttgtggaaaagaggctttccttttttccagaaactgtggcaaggtaaagtaaagctgtagctgatgcaggaattttgtgtaggtgttagcagcactgccctcactacgtgctcattggacagtagcccaaccccaagaaaaggatggttggtagccagtagtattatcatcatttcacaagtgattgaagactcagagaggttaagtgactttaccaaggtcacccagctaggaaatgacataaccaagacataaactcaatctgccagacagaaaggccatgcacctaaccactccactacctctgatgttggtcattgatcttggcactcagaattagtcctgatagaggagacctgggctccagaagcctaaaattgttgtttcaactgagtgcatgtaatgaatgatagaacaggcaagagatatcgcccccaaaatggatagctcctggctgttccagatattataaaattattttactaaacagaatgtctacacttatagaggctaagatattggcttcccagcttcctcgccttacagcagaattcctttgcctgttgcaaggttccagaggcccttttgtaccgccccagactcctttcaccccacttttaaaatcactggacaaagccctaattcagcatagcatttagcatgtggtagaaattcagtgagctagttactctctgggaaaataattaggtagggaggctatcctggaatagatatttacctaaatattattttacatcttggcaagtactttccctatttaagatctgtatgactaataggtgatattgagtgcttcctatgtgctaaagacttgctaagagtttaacgtgatttttaccttgaactataattctatgaagtaggcattattgttatccctatttataagtgaggaaacagacacagagaacctaagacattttcctgaagttacacagctattaagtagcagtgccagaatttgaaggcaagttttctgatgaaatgatcaggatatggtatttctcaatatctcagggatggctagagcaaatctgtctctctctcaccatcagctcaggactgggtgagtggccatggggtcttgaggcaaggcaattgtgctagaaagatgaaagctgggccaaacgatttctccctcaagggcttacaaagtacaaaagctgcacctacatgtggagtgtctgccagtaggtggtgcaagttctatgcacacccctgtgaattgcaagcacagtgccctaagaccaagatgggcttgttttgggagagtatgcattgcagaaacaggctcagcttaccctgtgactatgttgccaaggggtcttcacagctttccttctcttttgcagaaagatagagtcttcacggacaagacctcagccacgttcatctgccgcaaaaatgccagcattagcgtgcgggcccaggaccgctactatagctcatcttggagcgaatgggcatctgtgccctgcagttaggtgagcaggccctcaaaggccagcccaggcctgcactctcagtgcacctggatgcagggatatgattgggggctgtgttggagaggaaagggggatggagtggccagcacccagttgccagaatcagaaacatacatttattcactaacagatatttatttggtgcctttgttatgtaggacactgtgctggccacagggatattgcaggaaagaaaacagaccggggttctggcctcctaaagagaaaggcaaagaaaagagagaggtagccaggaggcagagcatggaggacttgcaagcttgcaggactcagaatcttgttctgggggccccgggccctgaaacccactgaagggttttcagcaaggaagtaacacaatcagatattattttaagaaaaccctcaagaaagcctctggcaagcatggtgccagccaaattccaggccacataaggaaggcctgggccttctggcatgaaatccctgaaacccagttgcccaggatcatatgttgtgagaaataagaagagacattgctgttacaatgtcaccccacatcaacttttggcattctcttccaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccatgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatcatattttgggcattctcagctgatttgagtactctgcttgcaagtctaccaggggtgcattttttcccctatcatttaagcattgccctttcttgaagtgatcccattccaaattttgcagagttgctctttccccttatagtatttccaaagtcagtgtcttcctgagctcaggggatgtccctgtaatctgacaaggaaggatcctttgcaagggcactgaactgcattgtgccttttttaggggtggaagctctcacttattccaccctctatcctggaatcgactctactggtatcccaagaatcatgaaataaaactctaacctggtacagccatggacatctcagctcttaggtccagctctagtatttattgagagtttgccgtatatatggacatgtgctagccctcagggttgggaagtttcaaaaagccttgcattgtgtctcccaaacagtgcccactcctaacactgcttataaggcaggatgaaaagttaacttcactatcattacacgctaaaatgttcaggatatatggtagcctggggtgagaatgaaaaagaaggatctgtgtaacccagcaccatccaggaagactcatcagagaagagagggtgccaactttgggctaaagaatgggcagggcctgcaaattccccttggtgcttcccatggaaggaggagatggtgggatcagagggaatgcagtccaatttcctgctatcccaaaaatccaagtgtgcacattcaggcttccttgcaatggcagggtaattataataggggtgtttgtttacattcctgattttcagtgtcccctggagccctatgccactctgctcctggcctggaggaatggtgggtggcttctgtcattctttgccaacctttggagcatatggtcccgtgttataagcccacacttgacagcatatggttgttaataacaagtgtttgtccccctacagggtctttcatctgcagttaccaaagtacttaacggacatttaatgaacaacactaaccagatttttaaaaaataaataactaatcacatttcataagcactgagaactgggacctttccccaaatttctggccagcctggggcagaggtgagatgttctggctcccaccatgcccagtgcttttgcgacatgacctcttagcattcgattaatttcagtgcatgcaatgcagagtttttcttctttaaagatagtctccaggactgtcctttttattgtaaatctagccactacaaaatgtactaaatgtctaagccaaagatcttaggactgggaatcagaggagcagactccagtcccaactatggttacataacagacttgtgaccttgagcagggtgttggaaacagcctgctggttttccaatcaatactcattcccaactgttttctccccgatgccctcttcagctctaaatgttggtaagtttagcgaccactttttcagccacctttgttgcccagcaaagccaaaacactgagttctggccaatgagatataagaaaattctgctgggagggttgctgagaagctttggcttttctgatgaaagacagagccatgtctagcatcaccctttccttccatcctcctctcttgagcagaaaaaaatctcgagaagcttcagaggacaccttgtgcccagtatgaaagccatcatgcaaaaactcaagctagagacttcaggctaggcgctgtggctcatgcctgtaatcccagcactttgggagactgaggtgggcagatcacctaaggtcaggagttcaagaccagcctggtcaacatggtgaaaccccgtctctaccaaaaaagtacaaacattagctgggcatggtggtacactcctataatcccagctacttgggaggctgaggcaggagaatcacttgaacttaggaggcagagtttgcagtaagcagagatcacacaattgcactccagcctgggcaacagagtgagacttt

SEQ ID NO: 12058 - DNA, 6938 bp, Human
atggccggtgctggagcggcacgtgcgcgcctcggcccctcggccgctcccgcccctcgccggtgcgcaccggcgctcggggagccgctggcccgggtgtccagccggcccttgccctgcctggcgctcggaccgccacctttgccgccccctcgccagcctccgcagcttccagactggccggtctgcgcgcccacccctgcctcccggaccggccaccgccggaggccgcggaggagggcccggccgcgcagatcccgcttatcgggcccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgggcggggctccgggagttgcacagaccaaggtagttccccgctccttcccccatcacggagaccctgtgggagatgccgtgggccctctactacagattaggaaacaggcccgtagaggggtcacacggccaagtagcggcactccaggcactgggggccctcgaggggaaggggcagacttctgggagtcagagccagcagctgggctgggaagcttcgagtgtggacagagagggtgggaatgacgttccctgtgggaagagagggtgggcaagcctgggatgcctctgagcgggaatccagcatgccttgtgaggagggtcacaagcacacccttgtgaggaggttgagccccatcgaggacaggacggagggagcctgagcaggcagagagggggcctggggaggcgctggttcggggaggaagtgggtaggggagaaatcttgacatcaacacccaacaggcaaatgccgtggcctctgctgtgggggtttctggaggacttctaggaaaacgagggaagagcaggaaaaggcgacatggctgcaggggccaagcccaggagccgccctccacagcactcattctgcagaagggaaatttgaggcccccagacggcaggggttgatcctgcagagactggtgagcaaaggggatcaccccaagccccagtggcactaggaacacttacaatctctgacctggactaaggctgccagcctggcccagttaagagtttcccagaaggatggcccatacactttaaattaaaggggccagacacgtgcacactacttccagccactctggaagctgaggtggggggatcgcttgagtctgggagttggaggccagcctaggcaggcaacatagtgagaccccatctccaaaaaaacaaaacaaaacaaaacaaaaaaacaccaaaaaagctcccagaaagacctctgaatctttctggatctctcagtggagacctggaaatctgaactttgacaatccctctcacagtggggccaaggaggaattaggcaagccaaaagaagtgaactttactcttctattgcctgtttgaattttgtatccaagcaagtgttacttaagtaatttaagagactggttcatcgaaaaaataaaactccccaaattcccatagctggtagactgtggtcacagccacagtgcactaagactatctgctcagcacttctggtgacccaaaagggtctgaggacaggagctcagagttgggtcagctgtccaggtactcagggttgtcacaggcaaaactgctggaactcagggcagcattgcaaatgccacgccgctctcagggccccttgcctgccgctggaattaaacccacccagatcttggaaactctgccctggacccttctcaataagtccatgagaaatcaaactctttcctttatgcgacactggattttccacaaagtaaaatcaagatgagtaaagatgtggtttctagatagtgcctgaaaaagcagagaccatggtgtcaggcgtcaccacttgggcctataaaagctgccacaagacgccaaggccacaagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggtgagtgtcggctagccagggtcctagctatgagggctccagggtgggtgattcccaagatgaggtcatgagcaggctgggcctggtcctaagatgcctgtaggtcaggaaaaatctccatggaccaaggcccggcccagccatgagggagagaggagctgggctggggggctcagcactgtggatggacctatggaggtgtctggcagactccccagggactacctgctctcctggcctggccttgtctgccactgccagctcctactcagccattcctgaacagaggacagcagagaagggccagcaccctcccagaaccatgtggcatttgccaactggattttgaccataacaatgcagccattctccccagcaccatcataggcccgcccttacaggaggattcgttagtagagtccgctccttgccccactagtaacagctcacatgtctgagcactgcttacaccaggcctggtgcacgtgctttatgtgtcatttcatcactgccagccacctcaagaggcaggtacgatgaacccattctgctaaggttcagtgaggttaagtgacagaggctggattcaagccaggcctggccaacaccagagtgtccatgctcctaactgcagtgttccctcaccatcagaaggcagggcatttaatacaccagatccccaccgcctcccatctgatttgtcttggtcaacagtggcccaggccactcctacttcactcgtccccaccctggcccttcccgcaggcccctgtcctcctgccctgactatggcaagccttgcatgcagcttgtcccttactagtggtgtcaatttttttctctcagctccaagaccctaaacagtgggacctcacccctatgcctgctgttcaaagcagaaaacgaagctcaggaatgctgaggggctgccaggcctgcctctgtgccacaccagggatgcttgtggggcctgtgctggggcagacctggcctgggctgccagggcaggcccacaacccctgccagcactctgctcactgtcactttgctcccacaggctccgctctgcaatggcagcatggtatggagcatcaacctgacagctggcatggtaaggacctttgggtgcagggaggatggggcagaggctccaggccttgggcttatcttctctgagcctcccttccatggctggggttccaagcaagcttcaagtgctctcctccctcccgccataatctggccccttcccgcccaccacccagactcacctgcgccaggcatctcagccccatcttcctgcagactcacaaaaggcagctgcccaagcagggcctgacccctcggtgtcccctccccacagtactgtgcagccctggaatccctgatcaacgtgtcaggctgcagtgccatcgagaagacccagaggatgctgagcggattctgcccgcacaaggtctcagctggggtaaggcatcccccaccctctcacacccaccctgcaccccctcctgccaaccctgggctcgctgaagggaagctggctgaatatccatggtgtgtgtccacccaggggtggggccattgtggcagcagggacgtggccttcgggatttacaggatctgggctcaagggctcctaactcctacctgggcctcaatttccacatctgtacagtagaggtactaacagtacccacctcatggggacttccgtgaggactgaatgagacagtccctggaaagcccctggtttgtgcgagtcgtcccggcctctggcgttctactcacgtgctgacctctttgtcctgcagcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagataggcctgattgtatttgtctttcattttggcctttggggacactggtctgtggtctgaagactctgaggagctcttcgggaggctggtgggttggaggaggggactgggatggattacagcgagggtagggtgcagtgacctgggctgaatgcaagctagctcccgagggtggggacatggcctgaaggaagccccaccttctgtctgctgcaccagcaaggacggagaggcttgggccagactgtcagggttcaaggagggcatcaggagcagacggagacccaggaagtctcacaatcacatctcctgaggactggccagctgtgtctggcaccacccacacatccatgtctccctcacaacccaggaggccgatgagaactgtgaggctcagaaagcgtgggcggtttgcctaaggtcacgtagctacttcctcactggggtcctggggcctcagagcctcatctgaggtaaaggagcaaagttgggattggggtccaaaattcactttaactccaaagcccacacacttaaccaccctgcctatttctgtccaaatgtcacctgtcctgaatggagtttttccccctgtacaactgtcatcaacctgttcgggccctctcactgacaggcaggtccctacctatatttgaggggcagcccattgcatttctggacagctctcgccattagggtgcacacacgcaccacctctgtgaacagggctctggctaggccactcctcagcagctcttgttgcttccccatggccctggtcagcagctggagtgcagagaccagcgggccttaccaagccacagctccaggccatgcccgtcagcaacacttttcactgtgactctctgggaggtgcccagggcagagggtgactccaggatgggatgcctttgcagtgggtgatggtcttcaagaaccagtctcaaacttgtagtgacaggcaggtgccctccctggggagcccagagccctatgggaacaccacagtgatgctcagaagtccctgaaggcagccgccctcgactgctcatggctgtgtcattcacgcaacagcagaggacgtggcagggagttcgccagggggctgatgatggtggccagctactccagaaccactcactttccccagggagaggcgacggaagaaggcaaacctgacagtgcagggggcaggggacacttggcctagaggagagaagactgtgggggtgaagagggtgatggtgcaagagctgggtctccagcaggctgtcccgggcaggagacaggaccggctctctggtgccaagcctattaagtcctgccacgtttgctgaggaaatacctgcgggggaccaccccacagcagacacctgggctagtgacaaccaagacaccacatgcactcaagatttagcccctgaaagaactctgtagaaacaacagagggtcgggttgggggagctgtatgtcctccctcgggagggcctcccctctggaggtgagcagtggctgcttccgcaaaggacgagagagtcttggaagccaggggaggtgggtgggagtcagggtctcggcattcttctccatccagagcctagggtttaaggctggaaggatatttacggagggtaatgactttgtaaacaagacctagaaatctatctcccagtagcatcatctttgacccatgtcctctctgcccagccaaagtattgccctgcctatccagaaagatggaaacccttccagtgaaattccacgtgactccctcaagaacaaagactggaattgaggctgatgtggggcaaggttcctcgggatcctccaaggccgtgctctgagccacacattcaggacagcctgcgaggcaggtgcacagtgcggatggccgtcccgggccccactaggggtctgcagctcgccacttcctcagccaccgccgagctcctgtccctcacaccttccaggctgctccccaggaagggggacctgtggtcact

SEQ ID NO: 12059 - DNA, 11647 bp, Human
agtttttgttttaaagcattttttatagtgtcctgttgccttcacagggtcactgtggtcaacttatcagaccacaaagatgcaaacttcctttccctaatctcatcctgaattttccagtggatgtgtcaggttctcaggggaaggacaagcatctatttgctgtaccaagaaaggatcccacgactcaggggtcacttgttttctcttattcttgctcagaaggtcttggtccctgtagcaagtccccacttccatttgtcacttaaagtaccccaaaacccacctttccattccagagtgtcattgccctccactttgcttaacactcagttaggttccttcctcagtttctcctacctcctttcctctcctagctcctgacccacctctatctggtagacagttttgcccattcctgctggtatcctgggaaccaggtttggcattggtcacagcactcagattgcaatgcgccagaatgggattaacccatgcatttcctctacgggagggaggtagagtgactggcaagtcgaatgttgcatgggtgtgtctatttatagcctgcaaaatggggtgctgccctggagggagagctggggtgaaggaaatgacacgcctgggagagtaacttacttctgcaggagctttagggagatgaaggaagaagcctcctgggccagagttttggatggaaaatgaacacccagtcaagtctctaggactatacgtggggcggggactagttgtgcgcgagagttaagtaggggccttaccaaggagcatgggacctgggctccccaaccctttggctagccccatggcgttgatcagccctgagctaattcctccatgctgcccagaacctctctgggccaagccctggggactcagagatgacagcaatgcttccattgcggaactcccatacgcgggccacagggaggctctggaggcggcctgaggcaagagtgctaggagggatcagagctagcccacccctaccctcactcagccgtctgggcttctctgaaccccttctcctcctctgttccctaaagccagccagggggagtcccagggaggcagaccgaaaaggggtggggtgtcatcctggtcactattagaccctgcaacggcgaccttgaaaactactcagcgtctgttgcccgagtggagcatagtgctttacaatctcttcccatcacagcaaaccatcaaggtagggctactattattttatggttgaaaaacagaggtcctgcgtcccttgggggctgtgccagcagcggccaagttgggatttcccctggtccagcagccccagacagcacacggggcagggtaggctttctgccttcttcacttccccagggcaggtgagtgacctggagggagggggtcacccctaaaaacaggggtagtgctaggactgaaaccctcccttcttgatatcccactggcaagcttgaggagccaggctgccagtcgggagattcggcccagtgttcccactggagagggcggcaagtgcccgggcgatcccctcacctgcgttcgggagatatacccccgcccccgccccgccaggagggtgaaaagatggccccaggagccagccggctgggacaaggcggagtgagaggacaggctggggccaggggcgctgggctgtcccgggcagccctcctccgggcaagccggagcaggggtggattgggagcgctcggggcgggcccgcggtggccccggggcggtggcgcccggccggagagggtggggcggagcagccgccctgtacttccccttcgccgctagctctacaacagcctgatttccccgaaatgacggcacgcagccggccaatgggcgcccgcgcggctgtccgggggcggggccggccagggctggggaatcccgctaagtgtttggattgctcggtggcgccgctgccctggcagagctcgccactccttagtcgaggcaagacgtgcgcccgagccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagaggtgagtacgcctttgaggcgcggggcaccggcggcgtcgaataaaaggcgcgcggggcaccaggaagtggggggtcgaaagctccaggctggagactcgccggcgcgcggcgttgcccgggcctccgcgcgggctccggggggcgccggaggagctgcgagccgcgggccgcggcgcggggagggcgggacgcggcgtggaccgcccacccggacgaggctgccggcgcccggcagctttcgcagatctgcgtgcgcgcagccgccaggggcctgtaggtggcccgctatgttcgtcccgcgcatccacacgccgtgccggggaccgagtgtcagcccacgcgtgggcgcccagtgctcccggctttcggcggtcccagctccgcgcccaggcgacaggttttgggctccctgtgctggtggcaagggctggcttactgcccaggtggctggagggaatcgtgacctacggagactgcgggaagaggcgccacaggtgttccttgggccacttctccagaggaggggaaaccgggccggaagggttagcgtcctggtcttagcgttgtgggcgctgtggctgtcaggaaggcgtagaatggattcaggggggcgggagggggctgttcagggtgacggctagccctttgctagctagtggttacaactcaagtcaagggaatttcttcttggcatcaagcaaaagaagtccctcccttcccaaaggatttgaattttgagcgaaaagttctgaaattagggtatctgtgcattttgtctcttttcctgcatatgaatcctgaagccatcacttgcatgcctgtctcctccagagactggctgggaggggctgaaggaaggggcaaaagcatttttgcctaagatgctgaaaaaatttggagagcagttttattccagcgcagctcccctccgcactgagtgtagtacctagcagctggctgaggtgaggggagggtaactaagtgacctcgggtggggcaggtcactgcccaggtactgttcaacagattccagactggagcctctgtgttctctttacagccaacatgcccatcactcggatgcgcatgagaccctggctagagatgcagattaattccaaccaaatcccggggctcatctggattaataaagtgagtgtaactctttgggttttcctgccactgttttaacccatgtacttctggagggaccaaagcttcagatgcagctcaaaaagggaagtgataacgggacaagcaggtgtttctcccagtgggtcctgcatgcagggagtgtgcacggcccagcctgggcctcacttgcatgactcctgccttcttcccttcttgaggtagggcacccacctgaaggcacttccagtttccagcagcaagactttccagcatctgcagagctggagttctgctctcctctaagcgagacccttacaaacatacacagcactctgcagggctccaatcgaacaaatagaagactgagaagtggatgctgctgggcagaaacgtgcctggcttagcagaggacaaacgagttaatcttgcaccagtcactctggcccaagaagcctatagctggtgcacttggggcaacatagaccctatagacttagtagcaatgatagtattcataataatagctaatgcttactgaacactccctgtgtgcctggcacctgctaagtatgttatttacattgtgtcatttaatcctcgcagtagtcctgtgggttagatcttactaatgtcatcattttcagataagtaaacagaggcactgagaggtagatcataagatcacacaaaaagtgatgaagccaagatttgaacttgaacggtctgactcagaaatctttactgttaaccataagtgatataataacagtaagaccttagacttcatatttgtcactgtgtccctacacatcctctggtttttaatcctcaaaattttgttggatatgttttctcatttccgagaagagaaaactgaggggcaaagagatacagtgacaatgccagggttacacagtgttcaccatccaagtctagcccagagctccctcagtggtatgaccaggaccccctgtgtaagagcccatgctcccaggtgtcctgaggagtcctttctaatggaagaagttcttacttccatgtgggtgcttacaagccagagagaaacatcccagagcttcaaaaccagggctttgggggagggtgccctgtgtgggtcctagcacatgtgtaacaggcagagggaggtctttgtgagctaataatgctgcagctcatccaaactaggtgtccctcctgagagatccagagtggtctgtttaagccagcctcaagatgggtgtccaagccagatgtcaggggaaaaaaggggaagtcagccttttctcagacctgtctggctgggcaggcctgggtctcagactcagccccaaagtctgtggtctctgacctgacacagccttatgtgtatgtgtgtattgttcaggaggagatgatcttccagatcccatggaagcatgctgccaagcatggctgggacatcaacaaggatgcctgtttgttccggagctgggccattcacacaggtgtgtgcctgggactcaggcctaggaagcccagggtagagacaagaggaggcactcacgttaacacagaggctcttcactggggtccctgagctccctgagacaacatgcagaattactgggaagaggggctggtggcagacttgtgtttctggagaagagagtcgatcatctcagcaaattctcaaagggaaaagccaagatcttagaaagtgtgtggcttcagggggtttgtggctagatgaaagttctccctggcaaaagcatctgtgaaaagcagctgtaagccagggcactgaaagagacccaggtctgcctttttcttcgtgttgaccaaggcccttggtccaagcctcatgtggttggtggcctcctttatccttgagagatggagctctaggcccatctcagaacagtcagcccacccatttagtaactgttctctgctgcccagtctgtgcccactctaccctctggctgctgatagcccaaggaggaagactgggcatagtctgagacacagatagtacactttggggatatggggactctagtgcttctggctgggcccttcactgaggcccgctagatgtgtttaagccaagcctgggcatttgagaaggcccagggcctaggacctgcagagtgtcaccgggagtacctgctggtttgaccactgtggctctctggtagcataagaggtcaggggtaccttgccttcctccttcaggccaggggcagctgaggatccctacccatggccctgacgatcctcttttttctcctgccctctaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaaggtatccaaggactctgggtccttgggaagccctcagggagggagggtagaaggaggtcagctggggctggagagcctgcaccaaggctgacagcccgtctgccccacagaaagaaagtcgaagtccagccgagatgctaagagcaaggccaagaggaaggtgagtgtggtcctaagcagccaggcctttggtcacctgtgggccagggtgagcagtggaagaaatgctaaggtgggcctgggcctaagctgctttctccctcgacagtcatgtggggattccagccctgataccttctctgatggactcagcagctccactctgcctgatgaccacagcagctacacagttccaggctacatgcaggacttggaggtggagcaggccctgactccaggtgagctggtccaggtctggcaggagaccccacaggtcagtgggatgactctttctcttggaggcatggtgctggcacatggtggcccattagtgcaggctgcagggttggtcggagggcgctcgatgtcttgcaaactaagaaagcacacaaccttgacctgtggcttctgctgttccccagcactgtcgccatgtgctgtcagcagcactctccccgactggcacatcccagtggaagttgtgccggacagcaccagtgatctgtacaacttccaggtgtcacccatgccctccacctctgaaggttggtgctcctggggcctggcctgcctgcttgactgtctgggtcctgtgaagggcttcctgagagagaaaagatgatcagaactccacctggcactgaattgattgagttgggcattgcccagtcttagccaccatagggggaggcaagcgacggggacactaggaaggcagttcagagtgggctgcagtacagtgggggctggtgagaggagggaagggggccaggggctgcattttggggtgctggttctccttcctcctctgtagcccagcatctgagggtgaggaaggaagtagggtaggggtgggaagcggcgtggcttcagggtttgagaggctgagtcaccaggccagggtcctgttctggaatctctatggcagataggtccaccgggagggtgtgtgtgtgtgtgtgtgtgtcagagagacagagagacagagaaagggcagggggatctggtgggctggaactggaactgcagggtgagtgtggctgactgccagccaacctctctgctttccccatccacagctacaacagatgaggatgaggaagggaaattacctgaggacatcatgaaggtaaagccccttcctacctgggcactcttgaagtgaccgtttctcagtgaggagagagaaccagtgaagcttccaaatcagaggatgggtagctgctgttgtcacctggctgcttgcattgtcccacaagtgccacattcacgtggcttgactggtgggaaagccaccatgggaagggaaggcaggtgggaggcctggcctctgacaggccgtcctgaagcaagccttggggcatcagacagctctgtgagtcaggcactatcagcgatgggtccctggcctgcatcctctgccccaacatgccccagccctgctagttcgggaaatgcacatcaggcttcaataatcagcctttaggatccgttaatatgatgatggctttatagaaaaagttagcaaattatcctccaggtttttttttctgcttcagttttgaaagtgaatatagtttttgcagccgggggcagtggctcatgcctgtaatcccagcactttggaaggcgaaggtgggtggatcacctgaggtcaggagtttgagaccagcctgactaacatggtgaaacccatctctaccaaaaatataaaaattagctgggcctggtggcgcatgcctgtaatcccagctactctgaaggctgaggcaggagaatcgcttgaacctgagaggcggaggttgcagtgagctgagattgtgtcattgcactccagcctgggcaacaagagcaaaactccatttcaaaaaaaagtttttgcagtagttgtacgccagctgttccattagcccaaaaaattgagacatggatgtcgttccttatctctagcttttctagtcatcttttcttgatttattatgctaacctttgttttaagccacattccctcttactatgtccttacacagttgagagggaagtcgtggagatgctataccagagagtgggtgtgagaggggtgggaaaatgaattgaggaccagtgccaacatgcatttctgcctcctccctcccgggcccttgtcctgactgcagtgcacttctgcatcctatctgagattgtgaaaatggccaagggtgtgatactggctgagaggagctggctcattgagggcagggccacagggtgagtctgcactggaagggagttgatagcctcttgctcttctgtccccagctcttggagcagtcggagtggcagccaacaaacgtggatgggaaggggtacctactcaatgaacctggagtccagcccacctctgtctatggagactttagctgtaaggaggagccagaaattgacagcccagggggtaagaaggccctggatccttatggcttcttagatgagggagaaccacgtagggatggagaaagcttgggggcagggccagggagcagggcggtaaagcatctggggtactgacacattgtgaattagctacggctgccatgccttaaggtttgcctgaagctgagtggatgtttactgctgtgctgggaagagcagaggccatgtctatggccttcaggggtagggggaagcacacctgatgccaccgtcccctaccctcatacaaccttcttcacatcttctaggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcacctgaggtcaggagttcgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcaccaaaaaaaaaaaaaaaaaaaaaacctttcatttggccgggcatggtggcttatgcctgtaatcctggcactttgggaggccaaggtgggcagatcacctgaggtcaggagtttgagaccagcctggccaacatggtgaaacctcatctctactaaaaatacaaaaattaggccgggcacggtggctcacgcctgtaatcccagcactttgggaggcagaggcgggcggatcacgaggtcaggagatcaagaccatcctggctaacacggtgaaaccccgtctctactaaaaatataaaaaattagccgggcctagtggcgggtgcctgtagtcccagctactcgggaggctgaggcaggagaatggcatgaaccccggaggcagagcttgcagtgagccgagattgcaccactgcactacagcctgggcgacagagcgagactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtcacatgtggtcagtggttaccatattgaacagtgcaggtagatactggactgggggcagatctgagggagaggggtttgagtagtgggaggacactggggataggggcttggggctatttacctgccattttgagtagtttgctattttagcagccaacaataactattggtgctgaataccagccctgcagtgtagcatgagacaggtccatgcacacatgcattaggaaaacaccttcatgaagcaggattctgcctgggctgatgcacacaacctctatggagggtaaacagtgtttctgaagaccgtagtttgggaacccctgacatatgacaatgcccccttagataagctcaagttacaggaatgtctgagggtggaaggtgtggatatgtgcttttcctgtctccctcttcagtgtctggccatggggcataaacactacccagcagtaggtaggctggccaagagaagccagcttgcatcaccagcatcatctagggaatggaatcatggcagtaa

SEQ ID NO: 12060 - DNA, 106929 bp, Human
ttaaccttccatatttcctgctctgaatgtggtgtccctcacaactgcaactaggcaggagagcaccctggaaggggttctcaaactactttgtctcaggaacactttatcctcttaaaattaatgtgaggcaggagtttgttctttgtttctaaaagttttgcctggctctggaaaatcgtagctcctgacttattctgcacttcatgacagtgtaatgttaatttgtccagttctgagaacaaaaaccaagaaggatgcatgttatttccccccacccccagagataaaacacaaattcctgtctcacattaaaggaagtgtcctgcctcccaaacacaggtctgttccaaacacttactcacatttcagtgagtcagaaggaaacagacagatattcatctccctgaaacctggctgacttccttcaaaaagtctgtaaggagcgtcaaaatcgtgtcaccggttagtgagcagccacctaagagctctcaggtgatagccggagttttagtaagcaggtgagtaccccagacaattcagaaaaaaatgccttcaggtgtttgtcaaggtgagtaagtgcagccagtaagtgactgataagaaaacaggaaagagcctgggactatataatttgggttcaaagggtattagtcataagccatcagcagcaacatctgatgcataccaatttaatactttaacaatgtgacacatcagccctatctatagtaaagagaagagcttgatttttatgaattattaagtccttcccaccttgagccactttgcttcctagaggcagtatctcaggcatcccattcagctcatagtagcattccatgaagatctggaatgatgacaataatgatgattattagactcataactccttaagcttgatttatgaaaacagttggttccttcacaaaagtagtcactggaagaattctggtttcagcaatgtgctggaaatttgtggccaaacttttggataaaacataagattcagacaagaaaaattaatatcctatttcttaggtttttaactaaaaatctcggatatagaatgttctctttccagatgtgagactgaaataatggaagaaaatggtcacagtctatgtcacggtgtaatgtagacagggagagtcacaagtgcatgtatgggctctcagccttttctctggccttgaagttaatctcctaaactcagtcattaaatcagctcttaattatctcggaggagaggaagtaatgatgatttctctctctctgtctctctgtcacacacacacacacacacacagctcttgcagcaggtattgcttaaatatcaccttggataatcataacttgtgagcagatcttctttcctgatgagttagtttctaacctggtcattctgcgcttatttttgtccctttctccacccacttaggaaaaacagagaaagggacgcaccgcgcagcccctaggcactgtggtttagggctagtgccctcggcacccgctgccaggagccgggcgctgccaagggctgcggaggggccacgttctcccggggactggggcatctcctgcgtgctggcgacaggctgcgggggcggagtggtgccagggcgggcgctcgcccgtcggatatgcccacccgtcccgtccagggcaggaaagcctgccagggcgccatccccatccccaccgcctccaggctgccggggctgggccgctgtacgggagccaaggtgcggtgccccgcgtgtggacgagccgaggtgcagcccgcggggccgcagggccggggtggggcggggcgcggcgggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggtaagcggggatttcgctctgcatcggctgcaggagggacccgcgcggcttcctggggctcgctggagggattgggcggaactagggagcgagctccgtgtgttccctcggattccacgtggactcgggctcccagccaccaggacctgcttggaaagagatacttcttcgttcccttcctgctatcccaggccttgcgtccccattaggcgcgtctcgccctgtctgttaagcaccctccaaagtcatctcagtgagtgctttgttttaggtacacacacgcacacacacacacacacacacacacacacacagacacgcacgcactcaagcatggacagtgtggggatccgcgggtgtcctggagaccgcgagtcctgcagcccaacttcccctggctcagacaggtgccgcgcctgccagagaccagggaaatccggaatccattgctgatggcggcctgcagctccccagcgcggtccttgctggctttgcagaagcctgcgagccccaaaatgcttatttttcaacccaaggatgtgaataatgcctctatttcttacttgaggacgaagcgctgtgtttcttcccggggggacttggaataaaccaagcgccacttaaatacttggcagaggggaattcttccttcctttctgccttcctcttattgttgtaacattgtctattcgacgaatgtaaacttaggctaggaaaagttcttttcacttctggatcctagatgccgcaatgagagaataagccggagcagccgctctaactgtagtgctgtggcagtggggcccgcccacctcctgagttcttttacactaagaggaggaaataaggctggggtggagagcttttgtgggaccatcgcctgagtactttttccctgaccattaggcagagctagagtgtggtcaaatttaagaattttagtttatttggagggagaaggagacacgtttgtataatgtagtttgaacagcgatcaaaacaaaacaaaaaagttgtctctgattttaaagtgtgtgtgtggttttttttttttttttacaaagaagataaatatttcctaagctgtcctcctttgagactgacattcagccacttgctattctttattgtggaggaatgaatcctagtccacgtcaacctggtggcattttctccaggtcagagataagagagaaatagcaccactgtccccagcccgagcagagaatgggcatcttaggttttctgtctcacctgtattgggtgcttcagatactttctccgggaaccagatgagttgttttgaggggccaccaaccctaatctacggatttcaggtaaagttgtacttgacattgaaaatgagtctctggaatacaactagagctaatagaaatataaacccaagcttttcatctctctgtaattacccagtattaaaataagctgtggaaacataacatcattttcttatctttgaaatgttgaggcttgttatgtaaagagcagtgagaaattctttaatggaatgtaacgctgcaaggcatgaagtcaggaacagagacttaacctggagttaataaggacacctcagggcaagcaagcagagatgatcgaaaataacatctgcaaaagttttgtgcatttattccctcctcctactccagccatttgtatactcaaggaacaggttttctcttaatttaagatcctcataagaaagctctctcatttgtgatatcacttgaggttcctggagaagcagcatcgttttttggtaccatgagtatcccaggttaacatgaataagtgaaatctctagctcagtagtatctaaaattttgtatggcattaccctatctgtataaaatttctcattcactatcattacacacacacacacacataactgttataaaattatagtatgtacaattgcatcatatcacatacaaaaattcaaatttaaaagctatgtatgtgacagagcttcattatgatgatcttaaattaagagaaaacctgttccttgagtatacaatatgccgtgttatgtatatacaattgtatatacatatatatacctgttaatatgtataaaacacatgtgtgtttagacatcttgtatcatctctagcatacatgcaaaccactttaaaaacatatcaccttcaaatcttattttaacacttacattcaaatttgctttccagaaaccttttcacaggtgcttaagaagaaaatgtactcatagtttagtcctatgtttatcacctttcagtgctcatttctaagtgcttaataccatgaaaatggtaaatgggcagtctgaggatgaaaaagagagaacataagaggcctagataatctataaactaaatataggccattagcagaaggcaaatgtaattttgaaatgaaggccatcacgtattttctccagtatgttcacaggtcaaggatagtccttccacccaggttctagaccacatcttttcttactatccctgaaaccctgccccagcactcatccctcttcagtgcacgtcttcaaattctctccctaatgtaacttcccctcagtctgtaaatattctaatttttcttattgtaaaaaaaatatttcttttgatatttaatttcctcctgaaacatcctgtacttctggcttctgttctcttcctgtttttctcctcctttcctcgctgctctcccgtcatctccttcacaggctctttccttgttggtgtttgcagagtttcatcctgaatcctcctcttcattctgcagattgtctctgggcccattccctgcgcaggtccctatctccagccagcctccccttctgagttccagatcagtatttccatcagccaccaaatttctccagctagacagtctgtaagtaagccagattcaacatttccaaaactgaatttaatacgtgtcctccagaattttctcctctattggctaccattgtttaatggcagtattattatcacacaaacatgaaagccaggaatttgtccccatgttttcaacctcacagccactctccaaattctcttggctctcctcccatccatgcaactcctgccacccagtcagtccctcatcttatgtctgtatgtaacttttaaactggattttcttttcttatctctccaacccattctcttcattttcactaatgatatctttctaagacacttatatgtttccaattactgctttgtttcaaatgttagtggctccccatctcaggtagggtaaagtgccaatttcttggcatgtcataaaaaggtacattctacctatccaatcttttctttactgtatgctttcctgaacacaaatacacattcacacacacacaccacacacatgcccacacatgtacacactctaaagccatctatatacaccattctttgttatgactacacctgatcataccatatttagtgtgaaaatattttccaaatactccctttgccttcattgcattgttgctttcaccccttttcactcatctctttgcaactgaccattatccaatgctagaagggtcaatcccaagcaaaattataaagtagagaacttttacttttgcaacaaaaaggaaagcttgaggtaacctacctttgctgggtcccaccctaaaccacctctctggtctcatcctcagccccttaatgggacttaggccgccctctgataaagtaactttgctcccctatggcttagcagttatacctgcccaacctcagctaagctttgctctcttaatactaggtcctgagccactgtttgacttaaatttatggactggggtttaggattcagtatttacaatggctcatatatttctgatgtatggtctggtttggaagtgattgcttaaatatcatcactgcctccccactttcctaagattaaaattccagtgttacctaccccttaccaccttgtgggatgatcaccaagacaggtagatttcaacatcaagagttagcggctgtgagcggctgtgtcagttaaattccttccgaagtggatgatgactactccctgtcttcatgtgctgacagccctggagatattaaaaggtagaagcttgttaatgtaaagagatgagcttctcatgatgtaattttagacattcagcaaaataaagacacatgttcagtcaatgtgtataaagtcaagaatttcaggaagaatggggaaaatatttggggccaaaagtgtccaggcatcacataaattctaccactaaagccataagtcttgactaccaacactgctcagcttgggatattagtaaaagatttagcacagcataaaacaagagaaaccatgaaagatcaccgctctgattggcaagtgaaagaaatggaaggtgggtggagttctttttttccagttgttcagtgaccaatcatttaccagcagaacatacagaagagtggctccctacaggggagaatcctagcactgcaaatcatgagacaatagactctgtgtatgacagtgattcctatgccccttcaggtgatccatagaggctttattgatctggctacagtgaatttcataaaactaatacttgataatattcttataaggtatctactttatgtaaggctgtgtgttaggctcaaggtggaatcagagaaaacttaaaacatggctgagagaggttggagtttatttggaaaaaaatccaaacatggggaaaggaaattgtctcagccctgaagcatacttaaccaatttcagccccttgtcatcttcctttctagcagaagtccatttattgagttaccatcctcttctgcatagctaaaaaattgaggtgatgctgaagggtgattaggctggtcccaggcatctgggctgtgtctgatttagccatgggcatgtaatgcaaggttgaccaatgagatctgctgggtgacttatgggaaaagaattttcattcctaagagagatatttgttaaagaaaatattgtcaagtttatatgtgaaatttggaacaactacagccatcttgcaactgcgatgtcaactagcttaaggataaagctagtatattggagttagccttatggaaagaaatggactttgatgttgtctttgaacttctgaattattggaatttaagactatagtatgtcttggtgtctttaaaattttcatataatttaaaacttggttatatcattttctataacttagagagctgtaacatcagtttccatagcataatagatgtcatgtgttcacaattaatgagtggtacagataacatgttgaattcagaggatggagagatatcattgtgatacattgaagtgtctagcctcctgagatgtcttcatggaaacaggtaagaatcattacaatttagatctgccatgaagaacctcagagatcctggagtacagtttctaccttttaaaatggatgtaagtgatactagaaaagcaagcaacataactagcaataggactcatctcctagttcctggggcagatgtttaggttcttgaatagaatactgacgcaatgaaaacagaaggtccttatgcccacaatgtggtattcaagttgttcccagagagtgaaagctgagttgcagccaccagaccttgaagggccttgtaagtcatgatatagagcaggggttttatcctgagaacagtagaaaggtcttgaagggccttgagcaggggagtgacatgatcagatgaggagagtgggttggatggaggccaggtggaaagcaccaagatcatttaagaaagaatatgtttgggttttagttttagtttaggagaccagttgtgagatgatggtggtaaaaactcagatagtggcagtagggaaagagactggaggatttattggaaaggcattaaagaagaagagtgaacaggatttgatgattgatttactatggaggtggagagagagggagaagataaggctgatgcttaggtttctgacatggacaagtcagttgattttgtgccattcactgagataagcagtgctgaaggagagcaagttggaggaaaaagatgatcagttcaggtcaacagattgagtttgagacatctggatgtacacctggatgtatatgtctaattagcaaatagttatatgtagtggcgttaggaacaggcaggaaagtaagatggggatagagatttaggagtcattggcacctagagaataactgaagataggacattaacaagatgagtcaggcaaagggactagaagagggctttggccatggctcaaggaactgctttagagggtcaggtgaggaagaggaaatgtgaagggagagagtaggaacagctggagaagtagaaagacaactgcaagaactggggtagcacagaactatttggagaaggaagaggtagtgaatagggtcaacttcttcaaagaagtcaagcaagttgatagtcttgaagggcagtctacatggagtgaaaaaagagaaatcagaacagagcggccagaggagtaatggaagatgaggaaatgtagagagtgtgagaaagtttggtatgatagtaaaagggaggagagagtagcaagagaggtaaaatgggagcagctgcctttaagcaaacatgggaaaggcttgcataaaaattattataaggagattttttatttctgttacttatggtgctgcatggtacacttgtaatgttttaaaattgcattgaggtatatgtatgtggcagagattcattgcacaagagaaactgagggaaggggaggagctttgatgactatacaaaggatattatcagagagaaaggagaggaagagagttaggtgtccagcaccagtaacagctctggcagaaaggagcccctgcttagaagctgcaggttatcatgggaaggtaggcaaagcagaccctgggctatgaaatagagaggatattaactaatcagggaaaggtgtgaagttgatccaggtatgcaaagagggaaagaaagcagaggtatggaaaaaggtacctcccatcctccagagtggctgcttagattgatgagcccatgtatacattttggtttcaaacatcttttcacactaatgcagttatgattaataagctgtttttagggcatgtaatatataacactccaattccagtggcagaattaatatcagtgcgttagtcagatttcctaaaaaccaaacaagttcttttagaaatatagatttatgtttctccagttaagccttcaattccccttatttctatctagtttaataaagatccccaaaataatcttgttagaaataacagtctcatatatcacagagaaatagtgttgtctctgaaagattttgctagtaaaatgtgaaagctgtttgccctgtaacttagtgttgttttcaaagcatttcaaaacattttcattgaatcataaattagaaaagaagttgatgtctattcttaattttgttagtcataattaaagtgcttatattcaagtgttttatccagtctatgcctgctaactcttgaacacgtaatttacattttagaaccagtataaacttgaactgcatatttggctaatgttttcagctccatagactgttgggacagttaatgattttcaaatatattttacttcctttgagagacttgtctgttctgttgcccaaataggtaacagaaactttgcaattctgtcagcaaagattcctgcattattatcttgttctgaaaaggtgactgaaattcttccatttattaaagtgtctagagacagtttttgctacagaagccatatataactcctgaccactgaaaggctttctgtataaaaatgaagttaatgtttaaacagagcaatggaaataaaagagtgttcaaaaaatggaaataaaacacagcaatggaaataaaagaatcactgtattgtcagtgcaagagattacttcattgtgttttgaaaggcgagcaaagctattgcaccgatggacgccttgaacattggcagttgtcattctcccggattcatttgaaggtggcctttgtttgtctttgtgcaggcctgatctcatttccatggataccatgtagaaatgcagactgaacacaagctggcttcgggtcagttcagtcagacaactctattccaaattgtttaccagttgccttcgagtcctttagccaacagcttcttagatgcttgttagaatagagaccccaaaccatcctggatttcataacctcttctaaaccatattctgaatgctggtgcataaaaatagatatttcaaaataattgacttagtgttctatggtggaggaggggaaggaaaaacttagccttggaaattggggcacttttatgtaatctttattattttttcagtataaaaatttaataaatagccctaatgagaaaatctaatgccacattgaaaaatgattaaaaatttatggaagtagtcatggtaattaagaaatgcctttattattacacagtatttaatttttgcccctcaaataatctgcctttaatatattagtgtcattttattattttttttgctatggttcaagtgagctatcaccttaactctttttaaaagtgaagtcccagaccgagtgcagtggctcatgcctataatcccagcactttgggaggctgaggtcaggagttcaagaccagcttggccaacatggtgaaaccctgtctctactaaaaatacaaaaaaattagccaggtgtggtggcaggttcctgtaatcccagctactcgagaggctgaggcaggagaattgcttgaacctgggaggcggaggttgcagtgagccaagattggtgccactgcacttcagcctaggtgacagagccagacgctgtctcaaaaaagaaacccaaaaaacaaacaaacaaaaaaggcagagtcccatgagctcctgccttttttcatgtcctctctctctttctggaatactctttagccccagcctccattctgtgcatcgtttaaatcttaatttcactgaggttcatgcaccctaggaaccctgccaatcttctaattcaatttaggtatcactcctcacttggacccttccatagcaatgttacattctatttcaataaccctttcagaacttggctatagttcttactgactgcaagctgagaagacaggcccatatcatcttcacttgtatcaagggttcttggcaccattttattcaatgagtgatgaatctatgagccatgtatgacagctactgtaaggggattaaagacacactttctgaatgaaggccaagctgaaaaatttctacttctttccaattagtatatgcaaaaataattctatttgtaagtgtatctgaatttgctaaaatattcctttagttgataaatttgttttcacttctttgacagagtttgtttgcttttaaaatgtttttcctttctcataacatgtctaactaggatagctctgttgacaagtaacaagatgaatgaaagtattaggacagtacagatatcattttttccccaaacccttttctgttccccttttctgttctcataaagcaacaccataatttatcttcagcttgactctctctcccaccgaatacattctttaagattaccttctgtcctatttatcattgtatttcaggagcctggctcatagtaagcactcagaaaatgatgtattaaaaaagaaaaaaaatcaaaattcaaatacagtaaattttaaaacttttatttattgtaaaatgtaacatacatgtagacaaatgcataaaaggtaaatgtacagctttttagggcttgggtttcattttactctacttagaattagtaattttgtttgttactatttcacggatgctgccacaagacatgaaacttctgggtaagagacaaaggtctttattactcattgcacagcaagtaacttgatcagcatatctgtgttgataccctttgcccaccaagacacagaggggcaacacagagggcccagatagatgcctaaacatgcagtaagttgcattacagaaaaggaacactgagcatggtgaatctgctgttttgtagcaagtcagaaagcctgttctttgtcccacagggagatgttacctcattcttcaaagatgctcactgcaaagacatccctgagaaatgctatggtaaacagtcatcagggtcttgcatctcaggcatactcagcagatatgtaggtgtgttagatctccatggaagcatgtctcccaacacagcttaacacataattttttaaaatgttgtgtaagcacaactcagataaaaaaataaaaataaaagatttccaggatcccagaagtcccctatatgttcttttccaatcacaaatccatttctctagtcttatttttttggcaataatttccttgctttcatttatactcctactagttaaatataccatctacactcaagggtttaattttgctagattttaagtatacacacacacaattatacaatacatattattttgtttttgaattttttaacattgcaattgtgagattaatctatatgttgcacatagatatagttcttttgttttcaccactgtacagtaaatagtatagtatttttatcacacagttcttcatcaccagattgctaagagattttttaaagtgacaattgagtattaattttataaatatttttctgcatctattggttattacataaatttttcttctttattaatgtggaaaattacattgattgatattaaaatatgatgaaaacctggtatttgtggtataaacccaagttgatccacatgttctttttataggttgctggattttgtttagaatttttgtattcatgttcatgagtgtgattatcctataattctttatgtttcttactctctctactgtattgtccctccatatgtctgcctacacttcattctggttagtttcttttatcctatattactgtttactaatttttgtttcaacagtgtgtattctggagttaaaacattcattgagttcttaatgatggttattatatttctcagtttatgagtttctatttggttcttttctaaatttctttgctaagatgtttaagtttagcttgtccccttcacaacttttgtaaagttagtgctggttcccatttatgttgctttctttcccctggtgcctgcttatcttagctagacgttatattagaaaaaattatttgacaaaattgtttgaggcttgggtgatatttttctacataaagcattttcttttttttctttttctttttgtttttttttttttttttttttcttgatgaagtccagctctgttgtccaggctggagtgcagtgatgcaatcttggctcactgcaacttccaactcccgggttcaagcgattctcctgcctcagattcctgagtagctggtaatacaggtgtgtaccaccatgctgggctaatttttgtagttttagtagagatggggcttcaccatgttggccaggctggtctcgaactcctgatctcaagtggtccacccacctcagcctcccaaagtgctggaattacaggtgtgagccaccacacccagcaataaagcattttcatttgcttctattgagacaataccctagaagttttgcagtggcagtgtgatgaccaatgaggtttatctgaggtgcgattattgctaattgaagcagtgccctggaggtactagaattccttatcagtttcatacaatttcagggcttgattttttataggttacccagacaattcattcaagggctgctttacttatggttcacatgtcatgtaaggagcagtggttttgagcataaactctattcctgggatttatcagataccccacttttgacaggtcttggatttcacttttcagatcctttttaggattggcaaatcgctttcttcactgtcctctagcaagacaaaaagtgattcaactccccagcactttggaaagccaaggcagaaggattgtttgaggccaggaatttgaacctagactggtcaatatagcgagactctgtttctacaaaagaaaaatttaaaaaattagccaggaatcgtgctgcatgcctgtagtcccagctacgccggaggatgaggcaagaggatcatttgagcctaagaggtcaaggctgtagcaaacctggatgacagaacaaggccctttctaaaaaaaaaaaaaaaaaaaaaagtgatccaactgtctgcctgagtcatttctctgaacttctttcttcaccccatcttcttagcaatttgatgctttagaagacatcttaaatatcttgttttatatttcttgcaatttttcagtgatcttcagtgggagagttggttaaaataacaaagtcttttattgccaaaggagaaaatctggagtagtgttttagagtccccttttaaaaaaatattgatttttaattttccaaattctcctcatactatttattgatgtggcattttaactgatagaaaattagattttttcaaaatagattaaaacaatattcaatattggttagtattctaaaattttaattttatagtataaaacatttttgaccaataaattcaactcactttttaatatatatctgtatatttgcttgtattaattactcccttttctttaactgtgaagtaaatgtgtccattgaaatactaaacttgattaataattttatcttgtggattttctttataaagttgaatatttaaatatctttagagaaaaatgacacatactaaaataattaacagaaaaaatatttatatttcttttgatatttacatgtgattatatgaatataatcttttcatagatatactcactatatgcaaatgaatactgcacttttatcacttaatatattttgtatatacttttccatgtgagttttatatttataactttaatgcatcctgccatgccatggttaactattgtcccattgttggatatttaggttgtttcctgtgggatattttgccccccactgtaaataatgtggctataaacatcattgtacaagaagttttttcttttcgttttacttttggatcatttccaaaaggggcattactatgtcaaagagtgtgtgtgttttttagctcttgttgcatatggaacagtgtagccatctgtaatgtggaatttaccaatttcatcagcattagattttcatttacttcttgaagtttgatggatataaagtggtgctccatatttatttccattctttttattcatgagggtgcattttttcaagttacgatttaaaaatgcctatcttttgaaaaaaaatatttttagattagggtattctagaaatttgagctagaagaaacctcaagatatcatctagttcagtgtcctgctttattcttatgataaccagccttgaagtgactaaagaccatgactccaacctgaacagaacactccagccagtatagtgtccatcattttaagctacccattggggctccctctcaaaatctctttgacaaactgccctttgtcttttattccccacaggctgattacaatccattttcacttgaggcatggcaatcttctagttaaaatttccacacttccatgggtcagaaccctttaagggagagggaagacattctctctgccagagcacttgactgtgagtaactgaatctgtagactgttctggttaccccttgacatgtaaccagtcaccccaaaatttagtgatatgaaaccacaacctcacttattatctctcatggtgtcttgggtcagggctttgagaatggcttggctggaccatctcactcgaagtctctcacatactgttagagggaggcagctctccctcttcctgtggtatcctcaagcctctccacatggtgccctctgagtaagttgacttcttgcatggtgggtagggcaccaaaggcaaccatcccaaaagaaactggcagaatggatgggcttttataaccttggctcagaaatcacataactgcatctattcatcaaagcaatcacaaagtctcacctagattcagggggaggagacttaagattccacctatggatggggagtgtcaaaagatttccagacatatttttaaacaaagtagtaacttaataaacttaatggtcctcgaccattcattgttttctttttctttttcttttttagagacagagtctcacgacgtttgcccaggctggtcttgaactcctcagctcaagcgatctgccctcctcagcctcccgaagtgctgggattacaaacttttgagagaccatgcgaggccccatttgttgtttagaccagtgtttgggcatggatattattgacaattggggccagataattttttttgaagtagtaaggtaggctgggggtgtctggtctgtgcattgtaggatattgatcatcagccctgtcctccacccactagatgttaatagcaatacactactccagctgccctagagtgacaaccaaaaatatgcccagacattactaaatgtcctctgagggataaaattacatccagttgagcaccactgcactaaatgaacatatattaagcacatttaatgttcatggcaacataaaagagaactccaactctggagagtaagttaaatcccatcatttttctgagtaactttagataagccataggcaaacaattccctaccttgttgggtcattgggaagatcgaaggggattataagtgaaaaagtatttttcatattgtaaaagcatatggaacattatttaaaaaaaaatcagtacacttggtatgcatccatttttatcatcattcatttatttaagggaccttcttaagggacttttatggagtgcctattgtatacccacagagtgtcaggcctggggcactggaggattgaggcagccagcccccttccagaagctcttctttccatttctagcatcacctggacaggagaatagtagcacctagatccttagtgactgtaaagtttgacacttaaagcaaggactttctaagaaaattgcatctttctttttttaataaaagtaaggggaaatgttatgccactgcattccaaaagcagttgtaagggtccttttgtgcttttggtttttgctctaatgttttgtttaaggactagagccataaaccaaacattgcagaacttaaatctttacacagtgtgtggtcatttccaaaaggcctacaacttctaagtttagttgctttgtttgtttttttttttttttttttttttttggagggggaggagaggactttctacttgcattactgtcctttcaacatgaagacaatgctattggaaaatgagatttcctgtggtgatgtatgtgttcaaaagatctaatgtgacctatgatcatttcccgttgccatacacattctgagtaatgatgagatacactttagagtttgaagtctatttgcttaggttcagagtcagggtctgagtaaccccacttcctgtttgtgtgacttcctggagggtccatggaaggataatattttcttggcttttgtggtgtgcttctcgtgtgtgtcagcaaaatgcagcaacgtgtcatcctcctaaccattagacagcaattttcagaaatgtgaatataaatttgctcaggatatactttttatgttagagatgaaagtgggggccaggtgggcagatcactggaggtgaggagtttgagaccagcctggccaatgtggtgaaaccccatctgtactaaaaatacaaaaattagccaagcattgtagcaggtgcctgtaatcccagctaacaggaggctgaggtaggagaattgctggaacccgggaggtggaggttgcaatgagccaagattgcaccactgcactccagcctgggcaacagagcgagactctgtgtcaaaaaaaaaaaaaaagatgaaagtgggataataaattgctatgccttattaaatttctcaagaagtgtgcccccctcagtagtgtataatgatactaatcgtaaaaacaaaaaaaatctactaagtacttaccatttgttagacactgggttgagagttttatatgcattgtctgaccacaatgaggtaaacatatacatgatatctattttacagatgggaaaggaatggcttatacaaaacaaggaacttgctcaaggtcacagtactattcaaacctcagaggccaagctcttaggcactgcgatatactactggctttgctcagtaaatggacctttcagcttaaaaaatgctgtacatcacaaactaacacagaaacagaaaaccaaacacagcatgttctcactcgtaagtggaagctgaacaatgacaagacatggaccccgggaggggaacaacacacactggggcctgtcggtgggggcgaggggagagagagcatcaggataagtagctaatgcatgctgggcttaatacctaggtgatggattgataggtgcagcaaaccaccatggcacacgtttacctatggaacacaaacctgcacattctgcacatgtatcccagaacttaaaataaaaagttacagttgtgaaattttttaaaaatggtgtacatctcttaatggtattagcatacttctgccatgccatcaccccgtaatatagtcagtcttctttttagggttctcctatagctagattcttgaaaaagttaaatgttctgtcaaattctaaatagaaaatacaatgtgtttatttgcatgaacatatgtgtatataggtatgtatattttaaattaatctgtcttttaattcattgatgtatatacctgcacagtagcctgcattcaagaggatttattagttaattaaactgttctttattaatctcctattatatccgtaacttattgttaggtggaaaggtgaagcaatcagtgtttattcagtaattattattgaaccacgaccatgtgcaaggtattattctaagtgctggggaatatatcagtgaacaaaatagacacagcccctctctgttagggtcaaaggcatatttattataaaacaagtgaagccgaagtttcaggggccctccctgtgcacttcccttcctctgttttcacagtgccagatattttcattcaacatgcaaaaggttaaggtcaccgtctcttttctatcctaacacaacatatttcaacaacaaaaacataaaaaaaaattcattaatcaacttcatcaattcagaggttctggattaatcactataaaacaaagcatgaggtgccttgaaatgctgtagctcctatgcagacttagaaaacagtcctaaacatgtgcatggcatcacaaacagggaggtgtgaaagtgaaaggagcttttcctaactacgaataatgataattttaaaaattcaatgtagcatgctagaagaaaaaatgaattctcttgttctctttagagaataggacttaataaaattgctgtcatgtgaagaggtgatatagagcagagccccaaactaggaaaaaacgagttgcataagtgtgtcaggcaatcagttggatttccaggaagtacactacagtaagagctgccaatagtgagcatcaaagaagttggaagaaaggtatgcacaggctaggatggtcagaaaagaccctaaccaaaatttatagagaagtggcttgtgaacagggtataataaaagaaatactaacttcagttatgtctgttttttccatatattgcctcaagatatgtgagacatatcctgctaatgagcaagttaggtgacaggcactgacttgctaaatacacacaaaatatgctattttgagagagagaaacggggagagagagagaaaaaaaaaagagaaagtttatcctttcacatagaagcaatttaggaagaagtggagaagtagaaagtgacttcatgagatggtatttctagtaactcttgggccaacacactttcttctgtatttcactgtcttcctctcagccactgagagacggcaagtctaccagatggtggcttaccctccagcaatcttatgaaaaagagagaatctattgagttgttaagaagcactaagtcataataaatggacattagaggcaattgcaatgggcttttggagatgttcctggcctgaagattgaatttttgaaatgtgaaagggcctccaaatgatctaaacacatgccacagtactccaggacttgatgcagttacaaaacaaaatgaaaacaactttggattgttttcacacaaaatataaaccttaaatgatacaactggaattattgtatatctgtccttatatttatatctgtgcataaatgtatggacagaattatcttcaaaacctgaaatagtaaattggaattttctggtgtaatatactttctccttgtattagtcagctcgggttatcataacaaaatatcacagactaggtggcttaaacaagagagacatattttctcacagttctggaggttaaaagttcaagatcaaggctctctcaggttggtgttggtttctactgaggactctcatcccggcttatagatgggcactttctcaccatgtcctcacatcacctttccctatgtgggtactgagagagaaagatctctggtgtctcttcttcttgtagggacatcagtcatactagattagggcttcactcttaggacctcatttgaccttaaccacttcattaaaggctctgtctccaaatacaatcacattgagggttagggtttgaatacaggaattttgagagacacaattcagtttgtaacaccccctttggcttaatggtttaaggggtttatttctggtcatggaagtgacgctcatgtatttctttgatatgaacacaaagtaagtgtcaaacatatgatatatggacacactgtaaaaaacaaatagccgcaaatcatgaagcaggatattatcgccagatgtcagctagagtctctctctctgcctcttaaaattgagataagatttattcaaatccctattccattcttataagaaaatgcagtgccctctcaagatttccgtgaactcccaggagatgtgcattttcattgacttgggccctcacttcctgactgcagagtgtttattctccactctgccaggtctggtatttgattttgaccctaggtacagtcaatacattagcctgatactgtctcatggatgctacaagatgccatgacatgcatgagtcagagaaggactttattactcacagcacagcaggcagcacgagtatgagcatgtgtctatcagttcccctttccccactctagtctcatagtgttacatgaaggggcccagacagacacctgcacacagtggggtgcaagacaggaaagaaacaatgagcttggtggacctgctgctttatagcaagcagtcagcaagccttctctttgacctgggggaagagattatctcacccctcaatattattcatcataaacacaatgctaagaaatggcccaggtaaatagtagtcagggccttgcattcttgatatacccattgtattaagttgaatggtagtctcccccaaatatgtctctattctaatccccaacacctatgagtattaccttatctggaaagagggtttctgtagattgccttgaggagactgatggtaaaaacatgaaggctcaagctacttctggtgagggctcagaaggaaaccaggaatatgctgttggaaactgcagaaaatgtcctcattatacagcggcagaatatttgacctaattgggtcttattgttgttcagaaagcatacaacttttaagtgaggaacttggatatttagctgagcaaattttcaagcaaaatattcaaggtgtagcctgtttttacctgctagatatagtaaattgtgagaggaaagagataatttgaaggatcaccacttgatgatctggcaaattctcagcctatctagattgattatatattttatatatatatgctgagtgttatggactgaatgtttgtgtctctccaaaatgcatgtgttgaaatgcaatccccagtgtgatggcatttggagattgagtctttggaacataattaggtcatgtggatagagctgtcttcctgccttgtgaggatgcaacaagaagtcagcagcctgaaacttggaagaaggctctcaccagaacttgaccatgctgcacaatgattttagacttccatctccagaactgttaagaaataaacttctgttgttggccacccagtctatggtactttgttataacaggcggaatgaagacactcatattaggagtttcactgttagaaaagcatcctctgaaagcaaagggtgtggctagacatccttttgtggaaaagattaggtatgtggttgccagatcctctcaaccatctcagcaacaatcaaaatagtgatgaggttatccaggaaagatttcctgtggagagctcttttgtttagtggcatgaatcctgcattacctacataagaaacctgcaaatttttaaaaaaatgttatctcagcagaagcattgccatctttgactgaaggtgatagagaggcagaggccagaggagctgttgagagcccagaggcctatggttgacagcccagagaacagaggctcgaacaacagaggattattctcaggccttgaaatctaattgaaaatttcctgctaggtattaaatttgtttaaggttggtgacccttttactccttccaattgctgccttttgaaatgggagtgtctatcagatgcctgccccaccattatattttggaagcaaataacctattttctaggctcacaggcttagagatggagaggaattttgccccaggacagatcatgcctggcatctcactcacaccaaatttagatgatgagatttgggacttttgagctgacaatatttagatgagatttcgagctcagagttaattctgtaatgggttgagccatttggaaatgttgagataccttaaagaatgtattttgcatgtggcatgaatgtgaattttggggggccaggtgacagagtatagtgactcccaaaaagatatgtccatgtcttaatcactggaaccagtaattggaaaaggggtctttacagatgtggtggttaaggatcttgagatgaaaacatcctggattatctgggtgagagctaaatccaatgacaaatgtttttgtaagagtggggcagagggagatttgacacatgtaaaggggaggaggagatgtgaccacagacatagagattggagtgatgcagacacaagttaaggaatgctcacagccccaagaagatagaagaaacaagaaatggattcttctctggagcctgcagagggagcagagccctgccaacaccttgattttggacttctgaccttcagaactgtgagagaataaacttctgctgttttaaaccacaacgtttatggtaatttgttacagcagccagagaaaactaatgtatccattaagacatatagaggggccagagacccatagaggactgtctttcccagctgactaatcctgtagttgttcctttattttgcctaaaaggttgaattttcttccttaactttcccacaaaatcattcatacaatacctttgtgtgtgcaatgagcttttgccaaggtgtggtgagatcagaggcaagccaattacagcaatacaaacagactaaagtactgttaggcatccctgttgctgcaggtttccaacccaccgctatgttgctggtcatcctttctttccctcttgtcattgttcctgcctccctcaaagtcctattcagcttcctccttagtggccctgcctctttattactgatgccctgaaagttttatctgcacctcagtttatcaaggatttttctacacaaagatagtttctctctaaaatataagtataaaatattttccccattaaataataaatgattgcatcagagtaatagtgtttaaaaagaactttgagagattcattgtagtgatggtgaatatgtgagtgggggggagtgaggggagtggtaataaggaaggaaggtaggatgggaccaagaaaacccggactcagaaggatgttggaattagaaccagtcagagctagagaagcaaggtcctcaaggctgagaatatgttctcatgcatccagacatcaaagttacaaagtggaagaatttgccaacttaaaatgtaagtaatgagtgtatttgaaaacaaatttgtcatcactgattttagcaaaatctgtgtaaattaagtacaaagaaattgtcatggttataaaaaaaatccttgggagcagtaaagggttatttatatgtaaaatatcattatagtcttaggaagttgagcacagcctggctttcattctgcaccacagactagagtggagattccctcaggatgaggactgtattttaaatttcattgatgattaacactttctacagggtgggaaaatattctcctactgtacactcttgctgagaatttgtaaggtttgtggatgcatttggatttatttggataaaaaaggatgagtttgttcctaatacacatgagatagatttggttttctgttcctggcaccagatagcaacattatatccaaatggtggcttggattgactggaaagtttcaaataacattaaaaaaattaatttctatttttatttttggagaaggaagaaatgattctgtcttaagcatcagcatttattgctttctattatttttatttttaaacaataccattgttgggctacctttggtgggcatttaggttgactccatgtctttgctattgtgaacagcactgcaatgaacataggcatgcatgtgtctttatggtaaaacaatttatagtcctttgggtgtatacctaataatgggattgctgggtcaaatgataattgtgttttaagttctttgagaagtcaccaaactgctttccacaatggtagaactaatttacgttcccaccagcagtttataagtgatcccttttctctacaacctcaccagcatgttatttttttactttttattaatagccttgctgactggtatgagatgatatctcactgtggctttgacttgtatttctctaaagatcaatggtgtggagcattttttcatatacttgttggccacatgtatttcttcttttgaaagcattggttaatttcctttgcccactttttaatggggttgtttggttttttgctggtaaatttgcttaagttccataccgattctggacatttaatctttttcagatgcatagttttcgaatattctctcccactccataggttgtctgtttactctgttgatagtttattttgctgtacagaagctttttagtttaattaggtctcacttgtcaattttgttttgttataactgcttttggcatctttatcatgaaatccttgccagagccaatgtttggaatggtatttccttgattattttccaggttttatactttcaggttttgcatttaagtccttaaatctatcttgagttgatttttgtgtatggtgtaaggaaggggtccattatcaatcttctgcctgtgactagccagttatcccaacaccatttagtaaatgggcagtcctttccctatttctttcttttttttttttttgtcaactttgtcgaagatcagatggttgtcagtgtaaaactttatttctggggctctctattctgtgccattcatctatgtgtccatttttgtaccagtaccatgttgttttcattactgtagccttgtagtatagtttgaagttggataatatgatgcctctaactttgttctctttgcttagattgtttttgctatttaggctctttttgattccatatgaattagaattagttttttctaattctgtgaagaatgtcattaatagtttgataggaatagcattgaatctataaattggattgggaagtatggccattttaacaatattgattcttcctagccacaagcatgaaatgtttttccatttgtttgtatcatctaggatttatttcagaagtgttttatcagtctctgtagagatctttcacttccctggttatctgtactcctaggtattttattctttttgtggcttttgtgaatgggattattttcttgttttggccctcagcttggacgttattggtgtataggaatgctactgatttttgtatgtcaatcttgtatcctgaaactttgttgaagttgcttatcaaatctaggagctttgagcagagactatggcattttctaggtatagaatcatatcatctgcaaacaaatagtttgacttcctctttttctatttggatgcctttatttctttctcttgtttgattgctttggctgtgactaccagtaatatgataaataggactggtgagggtcagcatcctcgtcttgttctggttctctaagggaatgcttcccacttttgcccattcagtatgatgttggctgtgggtttgtcatagatggttcttattactttgaggtatgtttcttcagtgcctaatttgttgagggtatttaacttgaaaggatgttgaattttatcgaaaggtttttctgcatctattcagatgatcatgtggtttttgtttttagttctgtttatgtgatgaatcacatttattgattggcatttgttgcaccaacttgcatccgagggataaaacctacttgatcatggtggattagctttttgatgtgctgctggatttggcttactggtactttattgaggaattttgcatctatgttcatcagggatgttggcctgaagttttcttttttattgtgtctctaccaggatttggtattagaataatgctggcttcatagaatgagttaggaaggagtccctcctcctcaattttttggaataattttagtaggaatggtaccagctcttctttatacatctggtaaaattcagctatgaattcgtctggtcctgggctttttctggttggtaagctttttattactcattcaatttcaaaatgcattattggtttatccagtttcagtttctttgtggttcaatattcagaggttgtatgtttccaggaatttatctatttcttctaggttttctaatttgtgtgcatagaggtgttcataatggactctaagggtttttagtatttctatgaggttgctgacaatatcccctttgtcatttctgattgtgtctattttaattgcctctctttttctttattagtctagctagcagtctatctatcttgtctattcttcaaaaaaaaagaactcctgaatttgttgatcttttttatgggtttttgtacctcaatttcattcagttcttctctgattttggttatatgttgctttctgctagctttggagttggtttgttcttgttgttctagctcccattggtgtgatattaggttgttaatttgagatctttctaactttttcatgtgtatgtttagcactatcaactttcctcttaacattgcttttgctgtgtcccagagattctcatgttgtatctttgctttcattagtttcaaagaatttcttgacttctgccttaatttcgttgtttacccaaaagtcattcaggagcaggatgtttactttagatgcaattatttggttttgagcaatcttctcagtattgatttctatttttattgtgctgtggtccaagactgtggttggtatgattttttttttaatttgctgagaattgttttatggctgattgtgtggtcagtgttagagtatgtaccttgtgcagatgagaagaatgtgtattctattgttttggtgtagaaagttcttagatgtctattaggtccatttgatcaagtgtcaatcaggtcctaaatatctttgttagttttctgcctcaatgatctgtctaatactgtcagtggggtgttgaagttgcccattattattgtgtggttatctaagtctttgtaggtctctaaggacttgttttatgaatctgggtgcccctattttgggtgcatacgtatttagggtagttaggtcttctgttgaattgaactctttacatgatataatgcccttctttgtcctttctgattgttgttggtttaaagtcaattttgtctgaaattagaatagcagcctctgcttttttcacttctcgtttgcttgatagatttttctccaactctttgcctttgagcctatgggtgtcatcacatgtgagaaggttctcttgaagacagcatacactcgggtcttgcttctttctccaacttgccactctgtgccttttaattagggcattcaggccatttatactcaaggttaacattgatttgtgcggatttgatcctatcatcaagttagctgattgttatacagacttgattgtgtagttgctttatagtgtcaatggtctatgtacttaagtgtgtttttgtggtagctgctaacagtctttcctttccatatctagcacccccttaaggacctcctgtaagggagaggtctggtggtaactaattcccttagcatttgcttatctgaaaagatcttatttctccttcacttatgaagcttaatttggctggaaatgaaattcttggttggaattgcttttgcttaagaattctgaatataggcctcaaatctcttctggcttgtagtatttctgcttataaggttcgttgttagcctgatggggttccctttataggtgacctagcccttctttctggctgcctttaacatttgttctctattttcgactttggagaatccgatgactatgtgttttggggatgatcatcttgtctggtatcctgcaggggttctctgcatttcccgaatttaaatgttggcgtctgcaatgaggttggggaaattttcacggatgatatcctcaaatatgttttccaagttgctttctttctttccctttctttcagggataccaatgaatcataaatttggtctctttacataatcccatatttcttggaggttttgttcattcttttttattcttttttctttatttttgactgagttaatttggagaactggtctttgagctctgacattttttcatcagcttggtctattctgctgttaatacttgtgattgtattatgaaattcttgaagtgagtatttcagctgtatcagatgaatatttctttcttgaaatagtcattttgtctttcagctcctgtattattttgttgtattcctgagattccttggattgggttttgactttttctcctgaaccttgatgatcttcatttctattcatattgtgaattctagttctgtcatttcagccacttcagcctgggtaagaaccattgctggggaactagtgctgttgtttggaagtaaggagacattctggctttatgagttgtcagagttcatgggctgtttctttgtcatccgtgtgggctgatattccttcagtctttgaaattgctactttttggatgggttgttttttgcttttatcttctttgatgcacttggaggatgtgattgtggtgtttagtgaactggcattgtctctgtaagattatagggagcaaaggctcagccctgcactcctaggcttcatactctaactctgaggaactggcattgggcccccccgctttgttctctggtctttcaaggttaggcatctgctgcactggaggggccaaagtgttcatgctctatattgtccacaacactccgatgggggaatgccagccaaagctctttgttggggtggtggcagcaggatccatcgtcacttttatgtgacagcagctgtggcagcatggccgtgtgcccatgtgtcagctggggtggggctccagaaggagcagggtggcagcaacctgctggcggtgcatggtagcagtacagcaggggcagggcaccagtggggatgaggttgccagtattcctgtgtgcattcatgccagcatagcaggctgcccacacatcagctgggggtatggtaggatgagcatgcactggcaggggaggagagacaaggtcttctggcatgtgtgggccagcaaagcagtgttggggggatgtggaggggtgtgaggcatgggtaagcgcatgctggcaaaatgctggggagaggctgcggttggggaggctgtggctgggggaggctgcaggtaaaccattatgcatcggtaggggctgttctgctggagccctctgatggccaggcatggtctgtcagtgcaggagctctgatgaggtgccctaggaagcactctggttgggcatctgaagctgctctgcaagaggccatggtcaggctggagctccaggaaaggccagcagacaggagatgctcagataggactggccccatcccacgggcaagactgccctgctctgtccgggtccaacagtcaccctaaggctaaagtctcctataggagcacggcaggccttgagggatgggcgttcttggccatattctgctgttgttaaatcctctgggctccccactggctggagtctgcctttgccacctctctaagcagctgtctttgtgtcagctcaggtgtccgtgggggtcgtgagttccgctgctaggatgctggaggtccatggcaggagcaggccactcctcacctgttcaactgaccccagaagttgctggggaccaggaaggattcctggtgctgggcagcctcgtgtagggctcctagctttctcccccttcagcccagcatccgtgtcctccctcatccactctcaatgccttccctgcaaagacctgttcagagtgtgtgccagccttcccaatgtcctggtttctcggtcggagaggtttcttcgggctgcctctagtcagccatcttggctcccgtcttggtatagtttttgagtaacacaaagaggattatagaaagcatataaaatatttgtagaaattacatttattcttgaagaggtcatgtctaaaattagtgaaatactctttaaaacattttgttttttaggctgggcacggtggctcacgcctgtaaattccagcactttgggaggccgaggcacgtgggtctcctgaggtcaggaattcgagaccagcttgaccaatatgatgaaaccctatctctactaaaaatacaaaaattagcagggcgtggtggtacacgcctgtaatcccagctactcaggaggctgagatatgagaattgcttgaacccgggaggcggaggttgcagtgagcggagatcgtgccattgctctccagcctgggtaacagagcgagactccagtctcaaaataaataaataaataaataaataaataaacgtcaaataaataaataaaacattttgttttttaaatgaaaataaagggtactttaaaaaaataattttaaaataagttgaattatttaaaaatgattcaatgatttattgaaccacaaaggataaaagaagtaattcatataaataagcaaactcattaattttttatcttgagcaaaatatataaattagttacccacggtcacctgtgacctaaaaatattaaatggaaaatttcaaaagtaaataagtcataagtttaaaattgtgtatcgttccgagtagtgtgacaaaatctcactccatcctgcccaggatgtgaatcgtccctttgtccagcaggctgtctgaggcccctgcccattagtcatgtaggagccatcttggttatcagatcaacagtcatggtattgcagggcttgtgtctgagtcacccttatttatttatttagagatggaatcttgctctgtggtccaggctgcagtgcagtggcatgatctcggctcactccaacttccacctcctgggttcaagcaattctcctgcctcaccctgccatgtagctgggagtacaggcatgtgccaccatgcccagctattttttgtatttttagtagagatgtggtttccccatcttggccaggctggtcttgaactccttacctcaggtgatctgtccacctcggcctcccaaagtactgggattacaggcgtgagccaccatgcctggccaagtcatccttattttacttcataatggccccaaagtgcaagagtagtaatgctggcatattattataattgttctgttttattattagttgttgtttttaatctcttgttgtgtctaattttataagttagatgttattataggtatgtatatatagaaaaaacagtatataccatatagggtttggtattacctattgttttaggcatctactggagggatgggaggatcttagaacacattccctgaggataagagagaattaatgtaattctcattcctgcactaagaacaatgtttaccacatcataaatactcaataagtttattgagtgaacaaaaaataaataggaaaataaaatctgtttattaactgtgtgtataaattcattagttttgtattatggacagttttgaatagagagagaaaaaacatagaatcatggagaaaatatcacaagttatcatacagatatgaacaagtttatacaagacttattacaaacatagagttccatggaattgaagtgttattatgtgaccatttgagttactgagatgaaagacatttataaccattgcacttttaagtctataggcataaatgtagggatcccattcttaggacatgcctagcaaatgaaagtaagagtcaaatgcaacccaatgggccagagtttcctttatatattgtaaattatatatttgtgcatgtgacaataagattacacactgcaaatgatgttgaaataaaatagctcatgcttatagtccttctagtccagggtaggagaagcaattttctttcttcattattttatcctgattcttatttttattttattttattattattattattttttttttggtgaggtggagtttcactctgtcacccaggctggagtgcagtggctcgatcttggctcactgcaacctccgccttccgggctcaagtgattaacctgcctcagcctcccgagtagctgggactacaggtatgtgccaccatgtccggctaattttttttttttttttttgtatttttagtagagacggggtttcactatgttggccaggctggtctcaaacttctgacctcaggtgatccacccaccttggcctcccaaagtggtgggattataggcatgagccaccgtgccggcctttttatcttgattcttatacactaaaggaaaatttaaaagcagctacattacactcacaattgtactgtttgttgtgttactattcacatatattttacctttttcttctattctgaatattatttttgttattttattttcgttaagcactgtcatcttcttcacaattgctgtttttttaatggcaggataaaactctgtctagtttatatgctaccatttgcatattcacgcccctaatcttggacattcagataattttaatggtggttattaagaactaatttttttagattgctagaaattattaaagctatttaatatgtataaagtgtgttttcttaggccacctaagactgagagatgacataaaatacaaaatttttattagcaaaatagaatttctgtggcccagccacctacttacacacacagagagcctaagtgcctaaacactgttttctcattcttccggagtagataacattctcccagactctagagcatggttctcctggaaacctttgctgcccctaattgtgtcccctgtgtcctgatcactattgcaccacggcccctgccctcggcatgctctagttgctcactatcctctgccctcttccctgtcaatccttctgcagctactgaggaccagtccctcaggcatgggagaaatgtgctccaccttcttaaagtaatgacactctgtgctcacagttagagataggccttacagttcttatgtttttgttcaatatttaatggagacattgttccccctagaagtgcagtatgcatcttcaggaatgggccaaattgcaatctgagaggctgtgtcaaaaccacacctctattcccaagtccacctcttgcttttggcctttgctctcttctcttaacctgaatttcttcctatgtatgtccctgggcacgttttgcaaatgagtcccttctatgaaaaacccatccctgcccctggcccttcagtatatatagatatgctcaaatttgcattgaccacaaaagttagacccttttattttgccaccctttactacaaaatgcatcctttagttctgacactgatatcatagacatcaataaacttcccttgccaaatttttgtggttgaatataaaatgacatgttttgttttatacattatttacgctcttgttgttaaaagactttttcctttctgagtttcactgcattttttttttttgggggacagggtcttactttgttgcccaggctgaagtacagtggcacaatcacagttcactgcagccttgaactcctgggctcaaatgatcctcctgtcttagacggccattgagattacacgtgtgagctgccatgctcaggctttgctacatttttagaacaaaagtaggttaactatatcaaatccccaatcatatgtttctcttttgaattataacttaaaattatgctccagaagaaagtaggagaataaatttcatatttactaaaattaattcttaaattattgtttccaaaaaaattatttcagagatggtcaggaatcctcaggaaaggagatcctgtaaatttttgtttgtttgatttagagacagagtctctgtcacccagtctgcagtgcagtggtgccatcatggctcactgcagcctggacctcctgaactcaagcaatactctcatctcagcctcccaagtagctggaactacaggcatgcaccaccatgcccacctaattgtctattttttgtagagatgaggtctcattgtgctgccaaggacggtcttgcactcctggattcaagctatcctcctgcctcagactctaagaaaaataagaaatctacatgagttaacttatgcttgactatctggtttacttatggatattaaaatggcaaccagcctgttataatctaggatgaaacagtatcccctttttattgtgaaaatagaggaaactagttagccctgcatgagataaaatgtatttggtgtaagctttcgtgagatttactggaatactttggcctggttactgtcaacacgtgtctgacaaggtcacctttgttaaatatgttgagtttgcgatgctattattgcctttccaggcattcacatgaggacaaagaaggaagatttatactctgggtgataataggctcctggcaaagcccaagtcagttgaagactcactgcatctaatagagaactggaaatgtatagattaatgaagcaacctatgactttctgtgccagacttttcaccattgccgtactcttctctttcacaccctatgcctacgtttaacatgatgttcccggtgcctgggatgaactttgccttcctctttatgtagtgaattccaacttgtcctccaagatccagattaattgccatctcctctgtgaaacctttgaacttagatttaccctcttctcaatactgagctcaaggttctttttaccactctttattttaacacttatacattttgatgccattttttttagtaaaattaccataatggaaatgcaaagagaacagggagattttagttttatttatttgcagtatcctcaggaccttaaaaaacgcctggtacaaaggagctgtataaacatatgttgaatgatccattttttaagtatgtatagacacatgggcatggtttggaggaaggaaacaagatgaaccaaatatggttcttattatccatatgattcagttgaactatgaggacagacatcagaagatataggcactgggattgcaaagaagaaatacatgttgaattagacagaatacttccattaattttttatgagctatttagatatcatatgccaagtgtgaaatgatgacagagatctgaattgtaaatacatattaagagaaaaagtatagagaattgagattgtccagatttatcaaaagaggcaggatataaagggaaagatttaagtagctgaaaagagatttagtatcaatggaatgaagggatggtgataaagaaggtcatgctttgtgaggaaaaatgagcagatcatttatgaatagaaattctggacaataaagttgagagatgagccaaacctagactcagagtgggtgacattgcgcaagaaagacatttagccttcatgagtttcagtttccttatttgtaatttgttaataatagcttggttttgctgttccacaggattgttgtggcactcaaatgagtcaggatgattctgacataggcagacataagcattaagaaacagtaagatgcgagttggaataaacattataatttaaatagaggaaaaatactggaaggaaatacatctgaattaactgaacttacagtagaaagaaaagattatgaatgatttttcccttgagttttctctatattccaaatcattattgaagaacatatagtaattaaaatgcattttattaaaaaaaaatcctaggtgctgagaaagtaagagtgaataaaagaaacaaggtttgacttctcaaggagcttacattttagtaggcacagacaaaagaatatggctatataagataattttggataattgctctagtagtgatacagtgatgaagaagggtgctgctgctacacagagggccaagggagagcagagacctatttgagcaaagtcctacatgccgtattaggtgaggatgttataggcagtggaacaggcagctgcaaagcgcataagcagaatgagctgcatgtgttcaaaaaacagaaggaaagtgagtgtggctggaacacagggagggaggacgagagtggtcggaagtgaagtcagaaagatacaccagggctcaatcatgaaggacctttgaatttacagtgaggacattggattttattctcagttcaatggcaagacataagttaataatatatatctatgcatatatagtaacacatatatgcctatatatgtgaattgctgtataattgaactgctaaatgataaaatgaactccatcataatttcctgccattaaatgatctgcccaggtctaattaatgggggaaaatgaggtcgttttatgtacagtcacgtgtcctttccagaattaggtattttaaaagtgaaagcagtttggcatcatctctccacgctaatatgttagatgattgataacatattcaaatagcatttattgagctctccacaatggggtgaagataaatgttggttgaaaacaccaggtattttgcatgccaattctggatctctgcttaatttgctgttattttcttttgcatttttttattattcaaaaataaaaaggagcaatggagcatatgaaaaatagatgttaaggagaaaatttgcagatgttaagctttgcagattttgctatagagtatttcagaatgagtatttgtgtttctcttcatggcagcacattatttgtaagaaataaaaagctgaattccttgtgtggacaaatccctgatacagtgattttggcacttacagagggacgttaactacttaaagtccccgttgcttcatcattgacttcattatcattttggagcactctacagaatctgctccctgaaatgcagaggcgcaatggaagagcaagcctttttcttccggcctttcagtgcctaaaacaatagacatatgaaataccatgcacttgcaatgctgcctagaaagtaggacatttctttgtgaaagcacatgttaatggaactttgatgtcaattttaaagagtccattctgtcttcagtgtctgcgaaggtaaatattgatcttaagcaacatgaggcatattcccatctccagagagagcattaatatccacacaaccttctttctgtaggatgaagaactggcagcattaatgctgtcagtgtcatacagagaaacatgatttgccttattcctttccttcattccctttccatcagaaataagaattttcaaaaaaaataaaataaaatctatcaaggctttatatgccttggtctttgttctgttttttgaaatgattagcatttctcaatcattcagaaagaagcatcaaaaacaaaacacttttgacagttcccactggaataaaaaagatatgacaccaatccctacattttcatcctcaaaaatgataatgatcacttctgaaagaaaatgataacaattttcaaggagctgtgattttctatctcctttgatgtagtcatcaatgccttttcgacagatgtttcatatagagtccatgtcaagatgttcaaggtgattcagaataaatagatgatacccttcagcccttgcccttgggtggcttagagtcttgttgttttgggaaggacaaatataactcaaattacttaagaatacttagagataatttagttgttttaagtcttgtgttcaaattttgtcttcatcctttcctctttccagctgtgagatatacttgtcccctggaacctcaaaattctctgcaaaacaaagataatattagtaactatcttctagcatttccatgaagattagtaagataatgaattatgcatatatagtatttagcttggtgccgggcctccaaataagtacttaaaaagcagtagttattttttctgggtaaacgttgataagtaataattattaggtcaagcaagttttcttaaaaatggcctttgagaattatacgacacacttatattcatgaattgtaaatatgtgctatttcatatttttcttaataggcattttaaattgttgtttggcctacaatgttggtctcccagaagcaaaaatattttccggtccttcaagtgaacagtttggctatgcagtgcagcagtttataaatccaaaaggcaactggtaagaatattctcttctttattatttcagtaaaaatacaaaataaatttcatatttgacttcaattgctttttcaaattggtgcctgactgtactataaatgggtggccctcaaatatccttaaatgaacaatctttctttgagagttgacaactgcagactgatcattaatgggatggtataatggttcatttttaaaaacctggatagaaagttttctctaaatattcaaaagcaaatttataataccagttttgaccattaatacataggtaggtagattgatagaatgatagatttgtcttcatttctgatcatgtaaactgatattcattgaactttgtaaatcattacctagttattaatgctatctctggaccatttctaaatggtagaattgtttcctacatttttttctttagcaaggttttgtctacttgcttcattctaagttaggcttttgccctccttgtggtgaagggtcctcacaaatatcaatgcaaaatgtacaaaggtggctttctctagcatattaacaccttttgtttttgccccaaagtgctcccagtttttacatgctatgtgatggttacattttcaaaccatggcttttctacccaggtgaaaaacaaccacctcaatggagatggaaatctagttcccataatactaatgcaagtgaacccagagaaatgaggtaatttgaaagttgtatttgggaagaagcgctgtagctcctattctgccagagttcatgcccactggtggacacaggtcctgccatggggaccttatctccttgttgcagcaggaggctccaaccatccccactcaccctggaacttcagattctgaatctccactctctagagctcttttcagtgattaaatgggctgttgttggcttatcaaataagaaccgtaatgtatggccaagtgcagtggctcacgcttgtaatcccagcactttgggaggctgaggtgggaggatcacttgagcctaagagttagagaccacctgggcaacacagtgagacctcatctctattaaaaacctgaaaatcagctggatatggaggtgcatgcctgcagtcccagctactcaggaagccgagctgggaggttggcttgagcccaggagtttgaggctgcagtgacctatgttggcaccgctgcactccagcctgagtgactgagtaagatcctgtctcaaaaaaaaaagaggaaaaaaccgtaactgtaattcataagcctttttttctgtgtgaacttccatttgatactctaaacaattgaattcaaagaaaggttcaggatcacatgttggggcatgcctgtctatttgatgaggaaacaaaatgaaatcatcccctgagagggcagcatttctcagcaggcatcttggaggatgtaaatcgtgagctgggttttaagtagtgaggatgaagaggctggagatgagtgttaactaatgtgaggagacttagaaaacaatgcatgtagatacagtttgtcaattgtctagaaggataagaacatctggttggaaaccaaagattggcaattattgtaaccatttgggatacgagagagagttgcatgtctaacaattatcaaatgatgctttgataatcataaagtggtgaggaggctagaaagacaatatggtcggtatattttgaccttggaatctagcagatgaagtagctaatgacccacagttttaaatattcagccctaattttttccctcagactgctatattaaacaattcattcaacatctccactttaatgcccagtagacataccaaactgaactgggagaacacaagtatctgattttctgcacaagctaatgaggccaaaaatctttgacttgtcttctttctcctcccctatatcttatccatgagccagtcctgttaatcctatcaccaaaataccaattatacctggccgttcctcactgtctctcctgatgccaccctgatggaagccaacaccagctcttacaggcactgctgcagcagcttctccacctgccttcagcttcccttcctgccagctttattctgctgtctttgctctagccagtgtgaactgttaaaaacatggctcggccaggaacggtggctcatacctgtaattccagcactttgggaggccaaggcgggtggatcacttgaggccaggatttcaagaccagcctggtcaacatggcgaaaccccatctctactaaaaacacaaaaatcagccaggtgtggtggcgggcgcctgtaatcccagctactccagagtctgaggcaggagaatcgcttgaacctgggaggcagaggttgcagtgagccaagatcaagccactgcactctagcttgggtgacagagtgagactccatctcaaaaaacaaacaaaaaacacagctcattccctagattaaaattccttaaaggatgctctgcgattgggtgtcagcctctctcctattatcatcttttacaccttctcctctgctttctatgctccaagaactaagtcttttgtctgttccttgaacatgcctagctcattcctgttgcaaagcttttgcaaattattttctcctgcctggaagagtcttccctaagatcatcactcaaatggttttcatctttcagtctcagctcaaatgtttcttcctcatagacctttcagagcaaccctatctatatagcactcgactgctctctgagtcactccagccttacaggtggatttattttctaatgattagtactatcttaaatgatctatacttgtttatatgctcattatctgtctcctgccactgtctctgagttcagggacactgttttgttgactgctgcattctccacacccagagtgatatctggcactgagtaaaggatcaacaattatttgttaaatgactaaatggaagtcccaattctaaatgattcatcccaagtgctatacaaagtgagctatagtagactgacttaagatgtttgagctgaaagggagcttcagatgaactccactgttctagttcatagacatggcctagctgaggacatctggcaccgagtttgaagcaattcttttaagtaacagctttcctggacagagtaaatctaagagccaccatcagtaatagacattattgaaggtgataagcctttcaaggattgtaaggggctcaaccactggccatgctgctggttggaagttgaacaagacgaaaagggacacagagttgagaggatcccaccaggcagagttctgggaacatgagaggcagccatatctcctttctctgtccaggattacctctaagtatccaagacattgttgaaagacaagtatatttgtagtttatagtgagatcctagtgctggtaagaccagggacactggacatttctaaatcctgcctggaccttctcatgacatccctgaatgatgtataaacacaggacaataggtctgggaagcaaggcaccactctattattggctgggccagggctttgaactccagtatagagctttctggcaaggtgtagcactgagattaggctcaaggcctaaccaccagatgatacaagcataccccaccatgcaagaggaagagacagcacctgtctgacctgaagggctgaaccatatggaattcagaagcaggaaggacagagaacaaaagttggccaagcaagtctgtctgggtccttttgttgatctggtcttatgaagcaaagaaacaagagaggcaaaaccatgggcatgattttctaaactacatgaggtgcaaaaaatgcaaaacatagttgttggccttaaggagtgtaaaatagagtcagtgaggaagatttatatgcagaataggcaactttgaataatatagaagacatcagtcagtgtaaaccccttgcagttaatggtgtttgttttctttcagtgtcactagctataataacttaagagctcattttcttttcccaaggcctgggtcattagagagacaaggttttctcatgacctctgtcatttgcccagccctgccaaggtaccttgccacagagggcagggctgtggccaggatccaggtgaatgggttatcccattacagtgctagagtgggccatgttaggacaagcagtcttcacgactctcaggctcaaggaaaattatatgaaacttggaacccagaattgcctgtttgttttgacagtgggccctgtgcccttctctactcttaatttatgacagttgcataggcattatggaagtagcagatgtgggaaggactgtttaaacattgactttccttctgatactaatcaagttagttttggacacagaaattggtatgaccatgaattattcctttagcaaattgcgagttctttttccatggatttatcatgtaatacatgcacacacacacaactttgttttctttattcccttactgcttattctgaagctgtcattttggtatctttttcctctgcttactttgactttctttgtaatctttctatctaagtcctgacttcactcctttccctcagacaactcactgaaggctctagtctgagtattcttaaatcacactctgttatttttaaagtacaattttagctctgtcatgtgtgccatgttttctaagaatttatgggcatatttacatcaggatctaccagattttaacaaaataatcttaactcttttgctagtttcatttatgagactttcattgcactatgaacttcaactctagaaacagtggtgacatggctttgataattctggagcctttttaacagtctcaagtgagcgggataattttaaaacaagctgacctcccaagtagagtacctgggcagccctctggctgtaagtaaggctgtggtctgttctcttttcggtgtaggcggagggccatcccgcttcagagccctcacttcacacacaggatgttccaatgtggatgatgcaattcttatcacaaacaatctacaaaggattgagatatgtttaaaatcatttcctggagtttgtggtgatatgcactctttctgtttgtctaatctgaaggcctgttgcaagaacaatctgagctcattatgtgactcaaaaaccagagagaactgcaatctctctgtgtgatgaggactgactgggaattagggtatttccagttgtagaaatgtctttcattctaacaaggactagtgcattctttttccttaaagagagaggagaaatagaaagaacaagtgtcatagcaaaaaataaaaataaaaaaaatccacctatatatgagcttatagttttaactttttaattgagaaaaactttaataaagctctacatgtgttatgaatatagcattgtcatccacagatgtgcctataggagaactttaaataaaaaaaaaagtttaattctataacagacatcaaagattatgtcacgtgatactttgataataacaccacctggtatttattgagtactctttccttgccaaacatgtaatacccataattactctaggagctttgcaaaattattaccccctttacaaatgagaggagtgtgactcagaaatgttaagtaattaacctaagattacagagctgataattaataaagataggggaagctaatgcaaaatgagacaaaatgttccaaacgtacatatttttgtaagtatccaagaaggagagtgacaggatgtagttggcatttataaataatatttaaattttattttaacataaactttatgaagtaagagaaactttcagaatcttgaatgaaaaattctgttagagaatttccaatgttagcatcattggctttaccatcagctgtttcctgggcaaagatgatagttaccatccatcttttcatcctatcatagacaggaatttcttgtatgaatatactcaggagccggagcacaagggttttaccctcagcttccccaccactccctgggtgactttgggaaagtcacacaacttctctggagcagaaagtatgccatccttatcaaactggaatgttatgagcaccttgtgtgagaataaaagtaaagcacttcagggctgggctcggtggctcatgcctgtaattccagcactttgggaggccaaggcgggcggatcacttgaggtcaggagttcgagaccagtctggctaacatggtgaaaccccatctctaccaaaaccataaaaaattagcagggcgtggtggcaggcacctgtaatcccagctccttgggaggctgaggcaggagaatcacttgaacctgggaggcagatgttgcagtgagctgagatcataccactgcagtctagccttggcaacagagggagattccatctcaaaaaaaaaactgggtcctccctacctcttcctatcccctcaaccaattctcatctgtcatggatgagcttccatgcatattggattagcttcatgaagtccatttcttcttcttggccaagaatgctattctattccaatcctctttccaaaataatcatgtctttgtcttttatgatatagccttttaaatattagccaattatcatcctttatatctctttcaaagataaaagtctcttaccattaggttgtcctggcagtgccatttaacatgccaacttcatttattcacagagtttgcttatatcttatttaattaaattaattaattaattaattaatttgagacagagtctcagtctgtcaccaaggctggaatgcagtggctcaattttggctcactgcaacctctgcctcctgggttcaagtgattctcatgcctcagcctcctgaatagctggaattataggcatgtgccaccatactaggctaatttttttttttttttttgagacggagtctcactcttttgcccaggatggagtgcagtagggcaatctcggctcactgcaagctccgcctcctgggttcatgccattctcctccctcagcctcccaagtagctgaaactacaagcgcccaccaccatgcctggctaattttttatatttttagtagacacgaggtttcaccgtgttggccaggctgatctcgaactcctggcctcaagtgatcccatctcagcctcccaaagtgctgggattacaggcgtgagccaccgagcctggccctccttttattttaaattcataacataaatattccttttcttcttccattcaattttattttttactcataacttagtccagtgtttgattctataaagacattagaaatccaactgtaatatattcttacacttttattttaactttaaatacttactgttaaaaattttataaatacttattatgctattgctgtacaattaagccatcctcagcactattaatacaggtatccaaagtggcatgtctcatctcaacaatgacaaccccccaagaggcggaggttgcagtgagccaagatcacgtcactgcactccagccggggcaacagtgagactccaactcaaaaaaaaaaaaaatctatagtaggaaggacactttaaatatctcctgatttgcttcttcgttccttcactctggatacaagtttgtgtgtgcacctacaaacacatgaatacatacacacccattgtttgtgacttgcacgtgggagagatatgttgctccagaatgtctgctgtgctttaatgatctataaaaatcctccatgcctcaccaacaagtcttataattttaagctttcctctgtggtaatgtgtgaatatctgtttctggaataaagttcatttacaaaggtgactgggacttacacacacaccttcctagtatctagttgtctaagacatttacatccatctaactccatctaaagaaggatctggggaatgctaagtggcacaagtggcaactatttattaacttgctgtgccccatatgatgggaaagcaaacagtgcttctctagaagagttctaagggaacttaatatggtaaaaagaaccagcaattttgagcaaaagggcaggggtgcagatatataggttttgctttcacttagacccttgaagtcagtttctttaaatgaaaacataaatagttatacacttgacctcacagagtgtttataaggatcaaaggagataatgcacataaaaaatgctttatgagctataaagcagtttacaaatgttgctattccagtttttatcattgatgaaacaaccatctgccaaagcacctagttgaaaggtactagctcatgagctttgatttgcaaaatgtgatggtcttaaaattatccccctctctccctccaatagccaagaacaggaatttgtatcatcacaaggctttagggttagtattttagcttttgattttaaattcaagaaaactgcatgtcggatgagaggaagtaacataattagtttttattgattatatttcttctagtgccaaagccaatttctggaatttttatgagacagaacagtaagcttaagatgttttagcaatagtgaagtcagtggactctttatcgtgaaacggaaagatgctgaggatctagccatcccgctaactgaggagacaatgtggaagcctaagaagtctgaggcagcataatgaggcctaaatactaaaattgcctttcaatatatgccaaagaatttaactattaaatttatgatagcagtatttccaaataaaacctaaaaaatgaaatgactctttttacctgtcttccttcttcccagagacgggcagccttcacgggtgaattctttccatcacaaattcattttatgtttaccagcagaaagcaggtaccatttagagctcaccaagcaccttgtgttgtccgtggcctggaactaaacaatataagaaacaatatttatatttatatactatagacttggaaaatttttacgtgcatgtagatacaataagtttctaatccaaagtaaaatatccccttggatggctcatagacctctcaaacttaaaatatctcacagtgaactcttgagctccccctatcgcaaaatcttgctctactgacagcatcccctttaatctgatggtagtgactagtttcttttagcttctcagccaaacacctttaggctgtctttgactcgtattcattcattcattcattcattcattcattcattgaaagaccaactcctcaagaagtcctgctgcccctaccatcacactctatctaaaacaagaccacctcttaccactttcccttctgccagccctgtatgagcactccatcatctgttgcctggatgattgcagttgtcttctaagtactttacatgactcacctgtgcttcaatacaatgattcccaacagtgtggccttcaaaattcttctacaatatgtcagatcacatcatgctgtactcaaaaccctccaatggcattctcatttccctcagctggaaagctgaggccttctattaatcattacgtacaagtcactacatgatctatcattaccagtaggactaccatctccttccactatccccctcactcattctgttccagccacagggcttttgcatttgctgttcccgcagcctagactattctgccactagagtcttaaggtttactctttaaccttcttcaagtttttacttaaatattaccttctcagtgaggccttccctgaccattccgatgaagattatactgctctccaccccacactcctaactccagcctgcttatttttctcccaaagcactgatcactaccactatatggtttacttacttattacatttactgtctattttctcccactagaatgtaagctcctcaggctagaaacttttttactgatttattcactagtatatcctcagtacctagaatgaggtctggtacataataggtctggccaccacgtatagactcacagattgtatactgcacaaggcctggacacaccattcaaggaatggtgtcccctggggttgtgtaccatttcagtccccaagagcccaataaacatttgttataaaattgaataaaacaaaatgttttgccctactattttaagtacatctctgtcagtaatctctggtaaaatctctagtattgaagaaaacacttggagaatttacagactcacagaccaaaggaagatatttataacagcccctagattgtgggtttaaaactgtcctacctacaccaccataaatactgcttgctaactaaacaaagtattttgaattccactggaggtaggcaaattggctgtgttttgaaagtctacataatcactattttcccacaagataattgaacagtaagtgttatttaaagtagtcttggaagaattcccagtttcactggaggaaaagaaaagtttatatcttgggattttgttttgttttgagaatcagcacacatgcctgttcatgcaactcttttgtctggttgggattaaattaaatccattacttcaaagaggtttcgccatacttcaacaggtatactcaccaacatatccaatttcccaccttggtaacagtttctcttggtgtgtctcttcctgcacgtaaaatttcatagagaaatataacagcctccctcatcttcctgtctgattaatttaagaatgccacaattttcttggaatagcctcttggtgatgtcctagcctcttcttatgagggtgagttgtcaggaactaggatttcaccgaggccttagggtgtgaatgaggaggagagtctgctggaaatgtttctaataaagaaggtaagcaaaggtcagtgacttctctgtagtcaccaacatgacctgtagcctacttattaatgtggttcacaatatttaagaaatgagtcatatatgatgaggaaacccttgttcttcaagagttaccaaagtggtctggttttccactattttctattgccttgtgttaagagtttaagatagcataatactgtcagagatgtatttgcatgtatcttttagggaatttcaagtgcttccacatccttcttgttaagtgccacacaactgcacagatgcttacttttctcttctttctgattaaattagaagagctgcagttttcacagaggtggtcatgatgttatgacccctcctgtgctgcaaggttatcaaatcctgaattcttagaaaaggtggtaggaggtgacagggagagtgtccagggagtgcttagttgagagaaaaaaaccaaacagtcttctcaggaagaaaatagctagttgttgcagctttgctaccagaggctctgataaaaaaaaaaaaaaacagttaaattttagatcagacacacttctctgttgtttctcagcaagcctctctcgggctgtggtgaggatggttggaaatgtgcataatagaatcacctgaatttggtatttgcatttggtattgtctgaacataccctgttcctacctgtcattgggtttgtatttggtgttgtctgaacatgccttgttcctacctgccattgagaacagtgtagcctaggccccacagtatggatgtaccctcccaggacagctgtgcttcgtgtccagtctgcagccccttcatatatcacacagccacacaccccttcacataagtgtggcctgactccctgtgtctggtttctaatccatgctagttctagaacccacctcatctgctaagatcattttcccaatctgggccctctgccaggacttcctgcagctaagaggaaggacactagcctaagcgttaagaacctgggcttccgcacttggttttcactagccatgggaacatgagcaagtcactcatcaatctgtgtctcagtgattccatctgtaaaatgaagtgtaaaatggggataagatcatccccggtggccaggcacagtggctcacaccagtaatcccagtgttttaggaggccaaggagggtggatcacttgaagtcaggagttccagaccagcctggccaacatgatgaaatgccatctctattaaaaaagtgcaaaagatagctgggcatagtggtacatgtctataatcccagctattcaggaggctgaggcaggagaattacttgaacccaggaagtggaggttacagtgagccaagatcatgccactgcactccagcctgagtgacaaaagacgagaccatctcaaaaataataataataatttctggcttcttctgcagatgaaattagataatctttggaaaggcttacacatagtaccagatgttgtaaaatttactataattaataggaattaattaatgaatgccaaggggcagagccacacttcctatgatagttccttgctataaggtgctattttgttctctacatttactccatagtaagcttttgtttgagaaaaaaaatgccagtttggtgcgtagtagatacgcagaggctgagaaaggaacagatgacacaataacacaatggtaacagaatgtataatgcttccctctcaacttggttgatttgttttttttacatttacttggaccaaacaagcaaaaatacatgctccccagaagaacagaaataaggattttctttgggaggtggaggcgggcggatcacctgacgttaggaggttgagaccagcctggcaaacatggcaaaatcccctactaaaaatacaaaaattagccaggtgtggtggcgcgggcctgtagtcttagctacttgggaggctgaggcaggagagtcgcttaaacccgggaggtggaggttgcagtgaaccaagatggtgccactgcactctagcctaggcaacagagtgagactccatctcaaaaaaaaaaaaaaaaaaaaaaaaagtaaggattttctgcttaacttttccttaatcaggaaactcttttttaaatgatagcatagaatcatccattcatttgcttgttcatttgctgttgttttttttaactcatttgttcaacaagtggttattcattgctacaggcacagaattcctagccctcatgtacctttcctctctagtgagggatttagtcagtaggaaggcagctatggggcaatatgattttttttaatgggatgtggaaaggtcagaggctatgtaggtacttagggttacctcgagttaaaagagccgggggacttcctagaggaagtggtgtcaaacaggagatcaaactaatgagtagacattgccaggcaagaaacagcatgtatgaaggtttagaagcaacagagactctaatttgaaggagaagctaaattcgatatgactgaaatgtgatttcaggaagacacatagaaaaagccagggttagagaagaaagagtcagattctttcctttttacactttaagatatgtccagcatgcaaaaatcagagttaatgctgtgtaatactactatgaaatgaagacctgtacagatggagaaaatcaaggctctggaagacaattttcttggtaccgactctataagattcctaatttcttctgagctatcatgaatttgaaagacatcagatatgctcaaacacgcgttccaattctgcactggttccctcccttcattaaagtggctattgggacttactaacatccaacattcagatttctatctttttcaaaagccttaacctatctgcctggtattattgtaaacctaactatggtaatattttaaaaggtaaattatggtaaattattagctcataagaagaaaaaatctttcaactctaacgttaaggctgactgaattaaagtgtgctagagtgttctatcttagtttgagaataattttataagatgaacgaggagagaacttattaatgaactattaactttcaaaataatctgcattttcctttttccctaagtgttcatgctattctgtctgctaatacttcaggttaaaaccttcatcctttggtgtccatttttgtaaccttggaccattttaatgttttttctactggtaaactagatcatatattccaggtcatttggatttttattttacttgtcacatatatctagttttactagatttagaagacagcagtctgctttaatccttttgtatctaccgtacctcaacatggggcatatgttgtttaaatgataattataaaatatatatacagaaggctcatgaaataattttagtttctttgatattttaacccttcccaatactgacatgaaaaaaaatggaagcaaatatgcttccgtattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaaccgaaggaaggatgtaaacaccaatctcatcctgtattctagatatatgcactttgttacacataaagatagcttgtaatgtatttgttctgtatttttgctaagtatcctctcataaagacagttagcataaagccactaagataagatatctgctctctaaatgagtcaacatatgaaaatgcttagggcatagaaagcactcagcaaaggctagttgttgttcttggtttaaatttggtttcattctttagagctgtgctgaacaatacgtagccacgagccacatgtgactactgagcacttgaaatgctacttttccatattgagatgtgctctaagtgtaaaatctacactgaagttcaaagacttaggaaaaatgaatgtcaaatatctcattactaattttgatattgcatgctagtttggatatattgagttaaataaaatatatttttaaaattaatttcacctgttgctttttatgttcttaatgtagctggctactagaaaatttgaaattatatatgtggctaatattcgtagcttgcattatatttctattggacagcattgctttagagagactttctagggtgtgtggcaatgcagcagtgttacagacattgatcaaagctctttatcagctaagcagaaaggcagcaggtcaaatcatagctgaacaaatataaactgttcacattgaaatttaaatgtgtttttcactgtttgtgatcaggtttatctttaagaaactatacttaacactttgtgtctaataaaaaaaatgtgtttctaggttactggttggttcaccctggagtggctttcctgagaaccgaatgggagatgtgtataaatgtcctgttgacctatccactgccacatgtgaaaaactaaatttgcaaagtaagtttaaatttacttgcaaggcatgtgatttgtcttagactcaactgaaaaataacatcagaacaatcattgttctgtcttaaagaaatacagacagcttttttttgcccttatgtctttagtaatatggggcacaatcatatccaaatttccaaaacagtttggagacttgacttaacaagatgcgtggaaaatgtgctatctcctggaccatttacctatagaccatggactggtttccatcaacatttagaataattttgatgattacttgcagaatcaaggctatccttgaatccgaggctatccatatttctttctctcctctttgcaaaataaaccattaagtttggaaacatcagtacaagggctgagtttggaggcaccaaaaacactctgtgtttcttgttatgtctaaatgatggcattctaataaaacaaatccacaatttggaattatttgctgttttaattatccccatctcagatgcctcctattaatgccaaaaatttactaaaggttcaagggtagacagctaaatgagtgacatttccatgtaatatgctgatacaagtaaaaagtcactcaatttgatcatcattacatcatcagcagcagcagcctaaaaaaacagccctgaggaatcacggagttcctctgaagaattgaggcatgaattagaaaagagtgttgtgaaaatcaagggaaagaagagtttcaaaaatagtgattaagacttggaaacaagggaagtggtgtttcttgcatatctctgtagacctaatatctagaataatttatggcacataatagggctcaataaacatattttcagtgaagtagaaggaatatcagtagtgtcaaatgctacagaagttgaaggggatgaggactgagtaaatgtcttcagcttatttaagcaggttgtgggtgatctagatcagtgatctccaaattttttgaacactcagtatatatatatatatatttctaataacacaaatatatacatttggagtgagtgttcaaagctttattatatagtccaaaaattttagtatatcacccctaacatttcatatcacccttaacttctgaacactcattcttaatgtatatatttttattatttttaaagctatatacatgtactggcctatcttctcaataataccttcacataaaaataaattttaaagaataacaacatgcccatagaagttctattattttctgtcttcactctaacagatcatattttgtgtaacttactcacctagaggataaatccaccagtgttatggggagaaaatagataacaaagaatttaggagtgtgtcagtagtgaatgtacaaggagtgaaagttgacctccatttccagaagttcagcagtgaagggggagctgggaaaaacaattctatgggatagcagtgtgagaagatttttctagtaaacaagagatgatactttttgtagggaacatggaggcagcagtaaaaagggatgatttgtccaggatagagttaactgattaaaattaatgtcatttgtacctgagaaatagagtcttaaaaagagttcttccttctctaagacacaaaggaaggagagaaaaattaggagttctaagaatgatctttacacaatgattagagaaactgagattaccctggaagtctgattcatcttctctgcagtagtcgttattcactgagtgatgggatctgagttgaggttggaggcttgaaaagaaggggtgaacttggctgggcatggtgtctcacgcctgtaatcctagcactttgggaggccgaggtgggtagatagcctgagctcaggagttcaagaccaacctgggcaacatggtgaaaccccatctctactaaaatacaaaaaattatccaggtgtggtggtgtgcacctgtattcccagctacttgggaggctgaggcaggagaattgctagaacccgggaggcagaggttgcagtgagccaagatcgctccactgcactccagcctggatgacagagtgagactctgtctcaaaaaaaaaaaaaaaaaaaaaaaaaaaaaaaaagaaaggtgaacttttacaacagtcaccctgggaaataagggaaggaatccaattaagaataagtgacagaggcaatgatagcttggcagagatgagaaacatgactgaatgatggtattactaaagagaattgcaatgttcgataactcaagaatggatacagtggttgatgccctaggtcagtggaagacaggaggtggagagatttatttagtatattatatgactcgtctaatttccttttaacattcacccactattgctttgagccagattctatcatagggcattctttgataacacttcaaggatatttttactgacccagaaaaaaaaaaaggcattagatagagctactgtgactttcaaaagagaggcaaaaatgatgtcctcaaatgtgttttgttttgctagaatattgtaaaaaaaatcataattaaacatctataagtcataccctctccagagcccactccttactgtcttatgctctgcagcctcacacattaatgtgcgttaccagatcactgaaagcatcgcgtttccccacacttcattatataactcaagtacctatattgatgacactaaattcaatgctacatgcaaacatgggtgtgcctgttttcttttaatatctttaagtaaacgaggaatttttaatcacttttaaaaattgttttccctttgaaagcttcaacaagcattccaaatgttactgagatgaaaaccaacatgagcctcggcttgatcctcaccaggaacatgggaactggaggttttctcgtgagtgtttactttacaaatcattattcctctcaagaaagtacatagacagtagtgtcttctcaccatccctcccaatctgaggatttagatgtttagaacttgctttttgataaattatgctatttatttggctatccaatgttgaatattcaaaataatgttgatgtgtagactttttaggatattcagcaaaaccactgctactgaatgttttgaagaaaagggaacaaaaagaaccctgattctttgcccttggaaagtgtgctgagtatttgttgataacagcagaatcccaaatctcatttctacttcctgtaggatcattcaagatagtttcaaagctaaaaagtatttttggtttttaatcatttcctgtaattgttgagtaatctggtgttatctgaggcatggagcagtctctcatgtcagtgctcactttcatttagttacaaaaagagtaaaaagacatcactaatcagtgaaatagaatgccttatttaacaagtgcttttggaacaattaattgattaatatttacatatccaaatacactgtcaagtgaattgaaagttaatataaaaaaactagaaaaaaatggaaattttctgaaggatggaaaaatttctgagtttagagctaatagaaaaaataatataggaaattgttgaaaggatttgactatataaaaaaagggaaaaacatcacacaccaaaaaaaaagtttgaagacaaaaacacaatcttatttgaaatttccattgactcatataggtatgtgtatgtatgtataaccctgttaaaattgtcttagagaggttgggcgcggtggctcatggctgtaatcccagcactgtgggaggctgaggcaggtggatcacatgtggtcaggatttcgagaccagcctggccaacatggtgaaaccccatctctcctaaaaatgcaaaaatcagccaggagtggtggcacacacctgtaatcccagctactcgggaggctgaggcaggagaatcactgggacccaggaggcaaaagttgcatgcactgagccgagatcgtgccactgcactccagcctaagcgacagagtgagactctgtctcaaaaaaaaaaaaaaaaaaaaagaaaaaaaagtcttagacagcataattcaactttacactagttttatctgaaccattggcacgctttcttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgcataaatgaatattgcaatggatctttatggtttatgatattccaaggtctttacaataaggttgctttaatctttttgttttttgattttaaagttgcaaaaatttaaaaaaagaacatactgatatttagagattacagaatgtgcctcaaaatttttaatctataactccagataaagtaaaaaatgaaaggtaaaaagcaagagaatttgagagattaattagcagtccaggtagcaagcagagaggcagaaagagagagaggaggagaaagaaaaaaagaaaaaacccaaagtttcctttacatacttagaaggtcaaaatcataagatactcttaagaattatgtggaaaagactgacaatcatcacatttttttgaaacttcttaagttctgggcttaaagtaggaatgtagttctggcacttacaattggcatattttaatttcaacttcttaatgctgttttccattgcttttaaaacaaaaaaaaattttgaatacttcatgagttctttttcaaagtgattttaaaaaaagcttaggaatggggatatagaaaccaataattagtatctgttatttggtaaactaaccaaagacattaataatgactttcttctaattaattggcaaaataaatcagttttatagggagaaaactatgccttgttcattgcacatgaaatatggccaaagctgcttcccctttgacagttaaactgggtcaaataagttttcttttatttttccaattacttcttgcaagcccatactcttctgttcagttttataactgattcacaactttacataacgttaaattctgtaggcattttttaggatcttaattagatttctcttttgcacttgtctcctttttcatgtatcaattttaaagttatttaatctaatgtttcttgtgtcatttaatcatgatttaatcaggagtttttggcattcaaggactcctgaaaaggagagaattgggattgcattaatggagatattaaggattggagcaggtataatgtgagcaagaagacaagtgccattcagcgttagtgactgcagttaattgggaagtggccaaagttaaaaactggtagtcagtgaacctcatttgtgtttgcttagcatatggagtaattttgaactgaattttcacacaacatttgccctctcgactctcttttacaaattagggaatctggcaacacaacctatttcatacccgtgggcaggcagaaaacatagtggtctgtacataggcatgggttcttcattcaccatgatgtctatacctgaccccaagccctcttcaagcgttactgccattaggtttatggtttctgctgagcagtatgaatggaaggaactgcagaaaactaatgttcagcaagaacaatgataatgatgctagctaacaatattatatggcatttgctatttacctggcattgttcttagtgttttgtatctatagacccatttaatctttacaacaatcttaaaagatagaatgtgtggttatcctcattttacagatgaatcacctgaggcccaggtaaatgagagacaaaaagtgaacctgcatgcattctcctccttggtgttctctggaaggaaagcacctgttttatctagcttgttgggagacctcataggctcctcccttcactgacacctgctcccaacagtctcagcactcctcctcccgcaaggcttgccactgggcacagagcacctgccaccttctccatcacttctgctttccccgaaggcattactgactcattggttttgagttgacaattattagtatcttagaaaagagtagagatgatttctgagctccataatggagaggtagaaggtttgcatttttcatgtgtttccattgattgttttctcatttctttgaagacatgtggtcctctgtgggcacagcaatgtgggaatcagtattacacaacgggtgtgtgttctgacatcagtcctgattttcagctctcagccagcttctcacctgcaactcagcgtaagttattaatgtgcagatggtctgagcaatgccttacagttaaaggagggggaaaaggttatcaactagtggcacccaaaccctccttaagtctcatttttatatggctgtgaaatatgacttacctgtggaaatctgcttctttcctcttttcctgtgtagcctgcccttccctcatagatgttgtggttgtgtgtgatgaatcaaatagtatttatccttgggatgcagtaaagaattttttggaaaaatttgtacaaggcctggatataggccccacaaagacacaggtatggctaacagaaatgcataactaacttatggctttctttctgaaaaaaatattgttagctatgaagtcttaatttttgtatttgccaaatccccattttaaatgcatttgatggtagtttttaaagttaattgaaacttttactacattgggttattctacctatggctttgcccagtgctggtcttttgaccttagagttctatttctgacacaagcattaaaggtatgggacataacttttttttttttttttaagaccaagtcttgctcttgtcacctaggctggagtgcaatggcacgatttaggctcactgcaacctctgcctcctgggttcaagcgattcttttgcctcagcctcccgagtggctggtattacaggctcctgccaccacacccagctaatttttgtatttttagtagaaacaggatttcaccatgttggccaggctggccttgaactcctgacctcaggtgatccacctgcctcagcctcccaaagtgctgggattacaggcatgagccaccatgcccggccaggatataacattttaatcttcctttagtttcctgtctttcccttctaacccatgagttacattttaaaattcaatatgtatttttatgtccatttggaccaataattaatttcttttgtttattccttgctggtaaaacaattattgaattctgaaatttgtataaataagtcactaagcatagttccagcatttatgataatattttatagttatttatcatattccagtttagcttgcccttttgcctacagaaaaggtcttttcaataattttatatagttctttatattttaagaagtctttaatttgcttttacatcttcttgaggtaggcacctaaagctcaatagtattattttaaagttcagtttctggttttggattttttttttcctttctgattgaatctgccatttcctgagccattctggttgtagcagtatactgaaccagtgtcaacccggaccagttcactgttaccagtgtatgctcatggattgcatcttatactctaatgtccaacatctaatacaaattgttgacatatttttccctaaatgctttccagctatctttattgaaatttgcttctctgctttcctgttcactattataacatgttgttatatgtttctcccattgaaattgcttttcagtaccaagagtatctcaatacccacagaagctttggaaatttccctgtgggcattttccaggacattccgctaaataaaactacatatagcactggtttccagaaagcaccactcttaaagccccttataagttttcatatgtatctccttatttcctctgtttctaaatgagttaccctcataatgtgactaattttatttaagtctcctatatagaattcacagtcttcctcttttgtgtcttcctaccacagtgcatctgattcctctctagaagtggtttaactcaatctcttttcttacagcctaaatttgaccttcctgtaagttctaacctaccacatttctttaaatcttttttcttctttttcacacagaagtcctggggctctgtcgtgggattactaccatcttcctctcgtattggactttgaaattctcagttattttttattctttcctccctctcaagtcttacatccctagagaaaggggtccaggaatattatatttctcactatcttcccagtgcctagctcactgctcccttggcaaaacacagcagatggaactcagaaatccagtcctcaccgcttccacctccttacatactgacctgtatttcagagagcctcttattgccattcagagatccctcactgccactcctgttctggaaagcccatctcctaggcttagaggatgatctcaatgcctgcaaacaaggacattaacagaagggtgtgaccttattgatctctaggattagggaatgctcccaaacatcttgttcagaaattctttcaaataagatgctctccagtggcattttctctgaaagccagaaactccctgccccatatgcacatatagcatcttctttccagtgttgttgaagcccataatagaggaaattcagcacaataaatagacctcaattgactacgctgattaggagcacattggtttttgttgtattcaattctaattatttattacacagttaccatcctttgatgagatgttactcttcatctgtgattgcttatagttgttcgcgagcttctgtccattggtaattagaaagtttatttatatcaagtttaatcttcctgttaaaaacagtgttctaatagtcatccatattaaaatattatatggcagtattaaaaactacaaatattactcttgggaatcaaatcatacactgtagcacatcatctttcttggcaatagtactgctgttgtacactgatggcctctaacagagaagaaatcattccattgaaagaaaagtaactatcaagaacaaagttggaagtgatgccttaaagctaccggcccatgtctaaatgtacttttgatttttattttattggttaagtagaaattatttttaatgtaatgacagcccattaataaatgtctcctctgttgaaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaaggtaagttttggtgctaataggccaatgttttcataatgtaaaacattatatttatgtaataaatatgaaaaagtaaggaaaagacaaagaaaaataatatacctggtacctaatttaaatcagaactaataaagaaaaaaacatcagagcattctatgtcttgaatactttgagaaggcagctgggaaagttaaatctttgattttaggatatttataagatatcacatgatatttaaatgaatttatgtgaagtaaatgaaatgagaagaccttagattaaaacagtaggaaatggggcaatctgtcataatttgttaatattcatcagagattcagacaaattgagctcatggatcacttggtgcaaattaacaaagaccacagaatcttaaacatacgagtttaagtttattatgcttattacaatcagtgggaaatgtgaaattataactatacaggactctcttgattcttatctcaatttctctattttctcagatccactgacctttcttttcactctattttttattttatttttattatactttaagttctgggatacatgtgcagaacgtgcaggttcattacatagtatacacatgccatggtgatttgctgcacccatcaacccatatctacattaggtacttctcctaatgctatccctctcctagtcccccaccccttgacaggccccagtgtgtgatgttcccctccctgtgtcctcattgttcaatgtgctctcattgttcagctcccacttatgagtgagaacatgcagtgtttggttttctgttcctatgtaagtttgctgagaatgatggtttccagctccatccatgtccctgcaaaccagataccttcacaaaaatgctaaacacactccggttgttaaacaaattaatgagaacaacaagcttgccttcccttaaacctattctctctctttgtcttgtgcattccttctttttaccaccataattctttttgaaaaaagcaactctattccctccctctacttccttgaaacttacagttctgccactagataagcatgaccctcttcatcccccaaccctgtggtcccaccttaaacctcatcctttctggctcctctgaacatttgataatgatgaacatacgctgctattcctaaccaagttgccatgacaccacaaacttctcgaactcctgccaaattcttttgcctcttcactagctccttttcctattttttcttcactaaacagagccctctcttctttactgctcttctcctgtagggattctatccactgtcatggcatcagcagcagcactgttgggttatctcattgctatgttgtcagccctacactctctcccaaaactcacactggcatctagctgatgatgaatatttttatttggagtgttggctcacttaccaaattcaatctgtcccacactggccttattcttttccctaccactcctcatgaacttgccattttgattcatgccactgtctcttgcctagtcagtcgaactaaaaatttggtttcctttattctttccactcttccttatgtcacacatctggtcagtggccacatcctgtcatttctatttctgcatttcccattttatctgtcttctttttctgtgtgtgtatttcagttgctacttccgtcaactggtgacaatcccaaatgtctcaaaagcagattccccacaagagaagatatgattggtttggttcatcattactgtctctattcagggacaataaaggttttttgggccaggccatctcataagctgctggccagtcaataggtcagctgccattaggtgaagcgccctttctggacacagcaaactggactaaaaggacaaagaagttgagatgaaaaatggctttcctggagttagaaactgcaacggcccggttttcagcagggaaggtgggagtagcatttttccctggaaggagcctggggccctggcgagctttgttctccaggacaatggccactgtccattgaggaaggacttgcctggctttcatcatgtttcaaaactttggttttctcccttgggccattgtctatctccctcttcccactatttcccaagctaacaggttttagtctgcccagtgctaggagaatcacccaacattttactcatccctcctagaatgtaattgcctgtctctctctctctgtctgtctctcatctctttctttaaaacattgaagataatctgaaattatttcagtaattgttgccatgttttcattcacctcatttcattcaatgcctacagttgcagtttattgttttaagcactgcgggtaattaaaactaaatgagacacagtttctgtcctcaaaaaccttagaatcatacatgaaatttacagtgtatcataaagagaatgtgacactcagaaaggatctgatgtggatagtgtaattcaaatttggccgaaaaatgcagaatattttctatgtttctatagtctacattatagaatacaaaaaagattttaggaaataaaatgatatgctcagttttataataaactgaaactcatatgtttaagattctgtggcctttgttaatttgcaccaagttatccatgagctcaatttgtctgaatctctgatgaatattaacaaattatgacagattgccccatttcctactgttttaatctaaggtcttctcatttcatttacttcatataaattcatttaaacatcatgtaatatcttataaacatcctaaaatcaaagatttaactttcccgactgccttcttaaagtattcaagacatagaatgctctgatttttttctttatttgatactatctattaaaatttgaattgtgtgtatcctgtgtcccaataattttactgctaagattttatcccatttgaaaaagtatgccaagatatatacacagggatatttattacagccttacttgtaaaactcaaaatgtcctaagcatccaataatggggaaccggttaaataaaccagtcttccttcatatggtcctccaaataaaatattatgcagacatttaaaaaaagaatgagaccttcatgtatatacatgtgctgatatggaaaggtctccatcaaagtaaaaaacaactgtttagaatatgccctcatttgatgcaaaggcataagaatgatacagtggactctggggactcaggggggaaatggtgggaagcgggtgagggataaaagactacaaattggattcagtgtattctgctcaggtgatgggtgcaaatctcacaaaccaccactaaagaacttatttatatgaccaaataccacctgttccccaaaaacctatggaaataaaacattttttaaaaaagaatatgccctcatttgagtaaaagtttaaggggtagactatgcctgtacctatattacatctaaataaaacattttctagaaggaaatgcaagaaactgataatggtgcttacctgtggagaggggtttagtgtcacatttggtttatacctttccaaatactttgatttttttttaactgtggatatctattacttttaaaaaaataagtattgataaagtaaacacaagactaatgcataaaatttataacagaaatatctttgctttattaattcatactgattaattcaactttcttagaagaaaagaattctaaggaatactgggataaatacatgcacacatatacacacatatgccctgacacacaagacattgtttttaatgtcaagcaagacttccatttgtatatgtttctctacaagctacaaatggaacattaaatatgtcctcagaattaatatggagttacaatagattgtgtttaaagaagctagtttcatgtttctattttaaaccagaggttctcatattaacttcatattttgatagcaagtctttatttaattttatctgccacagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagtaagtggcttttcttttcacttgtcttgccgctattgggtaaatctttctttatagcatcacttctcaaggctgcactttcccattggctgttcatagttgaatataaaagaaagttcttactctatctctgcttcttgatgattttcaatcctgtctactaaataaagggttatggaaatgttgcttgatttacttttccagagggaatattgtgttcaaaataggctagaatgtactcatagggaaaatgtacagcagtaatgactgcacattctcttcctctattttcaaggttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtaaaaaaaataacctcctttcaagaattttcttcaaaatgtttaaataattgtttattatcacatatttgctttactaatgttaacttgtataccatgtataaaaagagctactacaatcagtaagagaaatggatgaaaaacatgaataaatagtttataaatgataaaatacaaatgactgataaacataagaaaatattcccaatttacaaagtatatttctaaatactttcagtaagtatttaaaaacataaattaaaccgacaatatgttttgcctaaaagatgacacagaataataatgtttaatcctggagagattatcaggaagcaaagaagctcatacactgttgataggatgataaattgttatgacttttgggggacaatgtatgaatatctatctattagaatcataaatagttttacctttttacactgtgttatgtaagttctaaaattcttgaatttgtttacagtaagcatatatatttttaaaattagaaaaatacagcaaagatttttaatagttcagtttttgaggaagcattttatttataggacctaaaataatttacttaggtggccttggaaaatctagttagtgcagaaagatcacgtgttcaggagctcactgtgtgggggactagcacacacttcacagttggttaaaagaaaaaaaaaacacacatcacccaaatcctagttcttgatggttaacccgaataactctttgcaataaagaccatatgttattggaaacctatgtatcaggtacagccttagagtctggggctaaaggaattgcataaattattcattcatatactcaaatcttgatttgattatccattggaattacccaaaaagcattattgcttcttcagtatcccatggtgcttcaaagttgtttaaataaccatttaaatccagcataccctgagataacacaaaatcactaggctatccacactgataattgtatttgtttgtagtggaatgaatgagaacaattgcaatctacaagctagctagaaatgattttgagcattatttgctattatggactttggggaacattattctattttattaaaaagtatctctactcatcctgtgtaaattattttatcttctaaataagactatgttgtacagtacagtttgtcttcttttctatattaaagtgtgagtccagtaatttagcttccttttgtgaagattagtgaaacgtagccattttgatcacactgtatggaaaataagtaccaattgcatcttacagtgttagtgacacaggcaagcacatatacagaaccagaacaaacttcccaattggtaaaattcctactcagtcttgaattctgattcctaatagctaactcagttatctcccagcagtcttcactacagatcaattgcccagcccttccaactgcatctgagatatgtgtacattatcagtacccatatttcaaagctaaaaattcagttagtttcttagctagtaatgatcaagtttttaaaaaattatcatctcagttttcaccttaccttataccctttgttgagtgtcctttggtatcaagaacgtcatacatattctgctaaatacattaatgttcaattaaagttaatgccaactttgaacactaccttggaagtgttgttatttccataacctgctagaacactttcttagtaatttcttcttcccagaatatgcaagctctgtatttttgggtgagtattggaacagtgtgtgtttgtgtttgtgtttgtaggcatgtgtgtacatacgtgcctgcttgtgtttgaaaacttgatttaaaattactgacagtaatacaatttttaaaattgaatgttccaggtactgttcaaggaggagacaactttcagatggaaatgtcacaagtgggattcagtgcagattactcttctcaaaatgtgcgtatatcagatagcttcaagccatgttgtcatttggcataacacttccagacacagtagccttatacataaaatgggaagacagccatctagggatcagcccttctgattcctagtcacggtcatttagtttctttgtgctgctgatttacctctaaaatttgaaggataataatgtcttcccttccctgtttcacagggatcttatatgggggaaaactgatagtataccagaaagtctttgagtaccccagggcacagactgtatattaacttaaggtattattcctgcaggaattttctttgaatcaattaactactggaaatgtttgttaaaaacacgtactcttgtcatcaccgtcatggtcgaattctgaatggtcatagtatctttttctaagagcagacagaaaagagttgaaaaaataaggaggtaggaaaaacgtgaggtggaattggaatacaacactgtcttttcagctcggggaagtctatttctatctctcagaaacatccacctcctgggcccctgattctaatttgagtcaggaggtgagagagatagtgaaaggaggcgaaaaaaaaaagaaagagatcctgggaattatttaaggaacagtaggaaatcccaggatttgatcggcaggtcagaggaccaagaacagcttgttttctatctagaatcaaaggaactgactttttctggatcatcaatccttagagatgctcatagaagttatggatctttccctcagaaaaaatgtaaatgaatctatgcacggagaattttgcacacaatcccatgaggtttttgtacatacgctgaagtcctttcatgcaccccaaatccagagtccctcaatttactacagtcattcacataacttcatggtctcttatcctcaaagtagaacacatcttttccttacttgctatttttcatggcttgtattttttagtccaacatcttatctttggtacgctctaagatagaagaacaaaaaattaaaaatagtgtatctcatcctcaccaaatctgcctcgtttgatgatttatagcattgagtgtttagattgggtttcaagtcaatccagagtaggcatcttcctttgccctccccacagggctgacaaatggttattttccttccaatagattgaatgtcacagctaaagttgcctcttgtagctgtgctattatcaaatagatggaatataggaatatactggaacatttgagaaggggtcaggaagagagaggaagaaagctgaaagtagaacaggtcagaagagggcctcccgagccgtgtctgggatagcagaagtatctccgtctctcccgtgtcagtacttctgtttctcaagcatgtctcatatccggctgtgagctttccttataaatatgtggagtgagagactcacttctgactcctttgtaaagttcataagggtttaccattggcaaatatatgcctttgaaagggaaatttgaagatggctctgtacctgtcctgtactacaggttattacaaaggtttgtctgtataacatatcatactaaataaagtccaaaataacacagccaatgggaaggcttgttctctagcacaaatatattaagacaattctacaatatgtcaatatatgttcatatatatttcatcatttttaataaatctaaacaacttatttcaatgttttgcctaccctgcattcttatgttttaaaggtgatttgtttcaatgatcttcatttttcaattattttaggatattctgatgctgggtgcagtgggagcttttggctggagtgggaccattgtccagaagacatctcatggccatttgatctttcctaaacaagcctttgaccaaattctgcaggacagaaatcacagttcatatttaggtaaggcatggtaataattggctcagcaaacttaagttcccttgctttaaaccagctctttgttgaatctcagggtgagttcagcaaaatccttgaactgtcatctaattatcatatttattacacatacatatgttgtctctttgccaatcgggccttaaggcataactacttattggaatactatattatactcactagtttcttctggctggtcaagtggttgtaattcctggaacatgattgtgttcctccaaaatggaaatagttcccaaaagtcaatacagtaagtgatagtcttatagtattttagagctcttagtcttcttgttcttataataagcagccactgattttgcagacttactatgggacagttcctgagctgctagtctatctacataaacatttaaatctttccaacaagtctttcagggatgttttgcctttgagagatagcaagattaacaacttgtctaacgttcaacaacctagtaagcggcaaatccagaatctgaacctcagcctgtttccaagacctgtgttctttctactgtgcaacactaccttttaaatacatttattcattcgttcaagaaatattttttgaatgccaggttcacaggtggctgatgagaacagcgtggaatctagaggcagttttataggtagaagtcccacctgcaaagggaagtgctgcaggtcaaaggacaggagcaattcatcttagaaaaaggaagacatgtcctcagtgatgtattcaggagcactagaaactttgcatcacatctaacacaaaaggatctctggtcacctttactcacttcttttaactttattttgctcagatagtcaatgttaatcactctgttgctccttcccttttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccaggtaaatctcactgtttagcaggtgaaattaattttaggggcaactgggcaggtggggagtcaggtgaacagaaatggaaaacaacatggcctgagtgcctactctgtgattggctctgtaatctgagtttacttagtgtattccttaaatcatcacaacaataccaagaagacagccctcccttttgacaacttactgggaatttagctagctttctaaggtcacacagcgtccatggattgagctgtcattaaaactcagtcctttctggactcagaggctgtcctgaatgattacatccccttcatgtttttgactccctggattaataatgcatggatattatttagttgtgatggcaggcatgtaaccactgctttgtaggtaagcacacactaggaacaaggatttggagaggaaataatgagaagaagggagcagcacaacattataaggactgaacttttacatctgaacctgtcagaatgtcctgttggttttgaagattctaaaagtaaaacaattatcttctctgccactttcagctgatgggtgacagtttggtagttagaccctatgatgaatcccagatatggcccactacagcaaagatctgttgctagagcaaaggccagctgattgcttcctgtttccttactaaacagttttgacccaggggcttgacacacatttaaaatgagcatcactaatccctgacaaccaacaaaaagtggtttccttctttaagctggagaaacttacaaagatttctcttctctgagattaagtgtgatcctgctgttcctatggattttctaggagtaagaagacccgagttcttgacttccgtgaccacaaattagctatggtcacatacttttctctcttttttaatattttaaagaagttcttctttaatttagaaaataacagtgacagtgttatggaaggaatcatttcttagtcatttctaaatcctcaaaaagtgttcacataggcatgcattgaacgttgttgaatgggatgaaggttcaaagtctcagcttttcttattttaatttatctccaccttgtcctcctgtcccaatctatccagcaactacttacctgtctcatatcatgccatgtacacttacatcatcatatgtgctttcccacttccctctgcctagaaaactccatgtccttcttactttgcaatttgaatgatattttaactttctaagccttcctgactctcctgctctctgatcactcagcctttgggacttgcctctattacaatttattttactatagaagcttaattatttattctccctgcctctacccctcctgccttttgctatgacaaacctcacatacctacaaaaggtttgccttataagtatgtctttgaccccctggcatcagaaacacctggaatgctaatttaaattgctgtgttctggatcacatcctagacattacttcagaatctctagaaatgggtctcagggatctgtatttcaaaggcattttcttggagattcttgtgcacactaagatttaagaaccaggtgttagatggtgttagaacctgagggaaggaactgtgctctctgtcttcatgttccaagcactttgcaaatagtaaacactcaatttttgtgtattgaatgagcaagtaaatgttcagtgtaatattagaagtatatgaatcctaggaattctaagtttaacatgttttattactccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagaggtaaaaaaaaaaaaataaactaatagtttaatttgctttagtactggtaatttaacttgcatttggaaagaaaaatttattattattgaatgataatttgcacagatagtatggtttacatttcatcatttttgaggatgtccccattaagttatgattttaaaaatcacattaacaggaaaaactagagttgaatgtatagtgtactgccattttccatgagaggtctttgaatatatagtctcttatgcaaataaagccattataagtgcacatcgtttattgaaatatgcacacacacaaacatttgtgtatttctctagtatcacatgtaattttttgcgataaagacaacaataacagggcaatgctttcttgttatcagttgacagtgaaaaacagaagttttaccaagcactttgtaaattccttgtgatctcagatgcttcctacattagtttgtcaggaagtgtcattgcttagtgtaacatttaggcatgtatccaactcttgaagtttcaagtccttccacaaaaaaacaccatacattaacatggcaaagcataatttttccaatttgtggactgaactctctaaatccatgtatataagtgtagtgaactccatgaaataaaaaaagaaaaccaaattaaaggcacagattgacatagaaaattatatgctccttagtatataagaaaaggagaagctgatgttaaaatagtaaatactatgtttaagtattgtgatattttgtaccacctgatttattgatatttatgtaaaaattaatcttttaacagaagtaattaattaaaacaattctaaagcaattatacatataaagaatgtgtaattgagtatcaacaaaggctggacctagttacttgttgaaaaactgacaaatccccccttctttaaatatttcttacttgtgagatatactgaattatcattaattgttgaaaatgaacagatcttttaataccgtgtcaaacgcagtaaaaatttgtataagattatattagaggagaaagaacactgacccagtttcatggttgagaaacattgctttcttgtgaagtcatgaaatatttccatacttgatcataaaattgaagaaaaaaactgtgttttacaaggaaacgtcttttcctttgcacagaattatttaatgtttttaataatggagatattaacaatctcattttctacttcctgtaccactataattatgtcactatttggtaatttttacagaaagcctaaattaagatattgtgttttattttgttctgtgtctgctttaatttcattcaagatattagtaattttcaccagaaaaattttaaatcaaaaggttggaaatagatgaagatcgtattattgagaggaaaatgagaccaagaaatggatgctgttcagctacagtaaagagaattatctcctttgaccttggtttatgagcagatatttatgaccttactgaaattcttatttataattctgatcataaatagttcaggtttaaaattctatccatttttaatattaaaaaattagtttggtcatcgattgctctgaattttattttcttttttattttatcatatttctttcacttttttaaatagatggggacttgctctgtcacccaggctgtagtgcactggtgtgatcatagctcactgcagcctctaattcctaggctcaagcaatcctcccacttcagcctcctgagagctaggactacagctgtgtgccaccactcctggctaactttttacaaaaatgttttatagagacaaggtctcactattgctcaagcaggtctcaaatacctggcttcaagtagtccttctgcctcagcctctggagtctttgggattacaggcatgagccaccacacccagctgctctgaattttaattatacaagttgtaaggtttgctttaatcatccttttgtttcccctttgcaagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccaggtaatccatgagctgttatggtgatgtatgtatttgtgggtcttatcatattagacatagaaagcgtcatgtaaaccatgcaatccgtccgccttattttgtaacttcattctttcactcagcaaatataaagtgagcctctactgtgtgcccaagcactgttctagagtctggggatgctataagaacaggacagacacaattctgatctttgtgtgccttatattatattggaggagacaaataaaaagaaagaagtagataagataaagtattccagatagtaataaaggaatttttaaaaaagcaaatgaaactaaaataggaaataaaatttcagcaataggagtatcaggtggttgaaggggtgactaatgaggcctcactgagcagccaattttggagtaagactggaaggaaaagaactaggaaattaaccctgtacctgaacttgcatcaatttgctccaagtccactgatcttttcactggtttatgattttttattaaagatttatgctgtcccttcgatgaaaatgtggctgtaagagtgatgcagagatcagataataagatgtgattaaaaaatgaatctttagaatttgtagagaataaacacaatctgggacattactatatagaaaatataataatgaaattcagaggctgccattttctggttcagctgttgtgtactataatttcgtgtcaaacctgctcttttagaaaatcttgggatccgatggagcctttaggagccatctccagtactttgggaggtccttggatggctatggagatttaaatggggattccatcaccgatgtgtctattggtgcctttggacaagtggttcaactctggtgagtcaggaagagccagacacaaactaactaaaaattacctgctaagaaagcagaacagatgtctgtactggtattatagaaatgccacatgcattctataagactatagggaatcgatgtatcatagtttgcacaaaggaataaatgtgtttttccaagtaggaaaaatagatatatttgcttaccattagaaatatagttctctcctcatatggtgagtaaaacagtacatagaaaacataaagttctggaaatggtatccaggctatttctgaatgttatcttcctataaatagccttatctcagcatacagaagggaaacctcatgagagtgcattcaaaaatactgaaaattcagaccacacaagtaaagtgtaacttctatgtgactgaatggtatattttaaaattattagtcataaacaataagccattatttaggtttagctgacctctcattgacctccacaggagttgaagattcagagagaacagtgtgaaggtcatgtgattcaaggtcaaaaataagtatattgggccggcaagggaatagaatcagaaagaagttgtttattcaatcaagaatctccattcatttgtctctgtcaaaaaatgtgctttaaatgtacaaatatttgaagaacagaaaaataatattcattgattattttttatttctgagtttaatgatactatttacaaatctcacttgtgcttttaaagaatgaagtacattatttttattgcagaatgaaacttttatgtggaaaaaataaaactcaagaataatacttaagactttaaaaaaacaagaaaatatatttactgaataaatcagttaaaatcatttcagagtagcatatcaagagtaaatacacatatcccagaacctaaagtataataaataactaatatgttaaacatgtattgtgttagtgatgcagtcacaaattaaaaaaaaaattatctctgtctgccatcttagagctttcaaatatatactactgctaaagtgctttgatagagagtagagagaaaaattcagtaatgctggtactgggtcctctatgataaaggatataatacgtgtgctcagtaataacatccatccatctgttactctttatgtcttttaggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtgggtgcgtagatctgaaataatctgtatagaaattggttggcttacagagttttagtcctgaatataacatattttggtttgtaggccaagagaaataagggttttagttatagacacttaagtttccttacactggagatgcccgagaatggttcactagtcatggaagatttgtttagatcttccttccacatctctagaaggttctgctgcagaaagttgtaatctctatgacataaccaagggccctcctgcttccatcctttgagtttctcttacctccatttctcttacttaaaaccttgagcatacacagattatgctgaactgccactcaaatgactatatcatgttggctatgccatgatctatataggacaggttcagtaaaagtatcaagtatttttcctgtcgttgaggaattaataaacatgaaataatgaaagaaaacatgaaaagcaatatataacttttacccagtgttttaaatgttctaaataatacagagaaatgagtaaaagtctgaattatgtctcatcagatggggaaggatgaggaaatcattgtgggcaagcatcagcaggaattgttgtcttttctcttgggctggccaagttgtctttcaaggcctggcagaggtcctgcctcctcttcaaagctttttctaagcacactatctcaccttcatctcttctgccccaattatctcaccatgctcaatgcatagcttgcaatttaacacttgattcaaagctaccttctttcattaactgctgcttcatgggtcccaattcccattccgtcagaatttggctttaaacttcagaacttgtagttcctataggaattcaattaagtgacaaacatattaacttaaagctgaaaatacagaagcaggttatttgccataattcataccaagatacaaataagatgagaacacaaagcaaaattagattcaaatcttaacatgctttccatattttcctacttttcatatccatttggaagttttccatgcagatgttcaaagattgacccaattttgagtagcatatgtcacttgacctgccatgtagcacatctaactgagcacacatgatagttaagtcaaaaaccgttgctgcataaacattgtggctagtctgcctaataggttaacttgggaaatatattatttggcagaaacagcaaactggtcagctcttctggccccgaagcatagaggtgtctcatgtatcttccctttttgactatacttcaacccttatggtgatgcacactcaaaaattctactttcagagaatttccttcccatccacaggctgccgagggtttctggcctttcttactattgggcatctttccctttaaatcttttttcctgatgccttcaggtccacaaagacaagccaagtgaaatgattgtgagctcatttgtcacttcattgcttggcaataatagtatgtaagacgtgaatcccatcttcacaactgtggaaagtgaatttataaagcatatggtttctatcatttattgcatcaggtgcacacttcactttaagattaataacatagcccatgaagcgatgtatcatttttataaagctgcttgaaaaaaaaaggaaaagcattataatgtggactaactttgtcctaactgcactcacctccttgccattgtttttcctttacatcatcttcacaacttatttttagtttatttaattctttaatattttatctatctttgttggcattgttaagtcactggagcaagaaaaattgtacaacatatatgatagatttttttcaaggtaacatgtagaattcatgttttgggaagtatatacaacctttaaaatattgaaaataataaagtaagatagaataaccccaaataaggcaataaggcagctgatgctgtgaatggcaccaggtgttctctctcaattttggacacacggccagtggactttagttgaaggtaataattctgatagtttagacatcggctactgacatcagttattatcacataattttttttcatgagttggtattaggaaacagaggttcaaagagggtaagtaaattgccccaagtcacagagctcataaacagcagaattaggattcaaaccaagtctgcctgactgagactttattgctgcagtgttgcatgcatttccctatgtgagcatctagaataggtcaagcactgtccatgttcccttagagtatctcagttaatcttcacaataacaattaattcttacaactggatggaagcagaaagaatatgagctcttatttcaaaaatacccaacttttacttctgactagccatgtgaacttaggtgaattattttacatcacttattctagtacattatttgaaaaataagataataaaattcactttccagattcattgtaaaacttgtatggcatacatgagaatgtgtccagttgcaggcgctcagcaactgttcctttccattctgtgtctccgtgttatgagtaatgaaacccgtgcttgtgggagtgagcaatttgcccaggttcatcacagtaggtttcctggcggcaagtctagtttcctttccactgctcccagccacatttctctgaatcacatttctttgtatgcacagtcacctacgtcacatcagagctagaatgacaaatgctttgtggtgctagctatggttcacaagccaccaatatgaagactatttccatattttcttgatgtgagatactttgtccaagaagacacaataaagcaaagatgctttttcctataagttgatttgaaataacatttctttatgattttttttatcatagccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggtaaggcctcaggaacatcccttttgactttatttcttcctaaagacgagagagtggtaaaagtcaaaaatggaagcttatgagttagaaaatgctcacccttccaatgaatgcctttcttatgtaattccataaataagaagcatatttactttatgctaatatttatggtcacaatctattatataagtcagcaacatcaaatttcatttagaattgcaatgaaagggctaaaaatacaattcttaaagaaatcatagatacagtgttttcttaaatgtttaacagagagaactttccattggcaataaatgttattttgatattttcctatcagggaaaaattttatttattgttcagctactgaaaaataactccaattgtggtttctactattagatttaagttaacatagatgaaatatagtagattatgagataacaattatttgttctaatcgtatgctgtaattactgtatttaacatggattttgaaaatttcccaagtgagaaaaatgcttttcaggagaaaacttccagccggaaatttattttataaatgatgtgaatatttccaccttggaaaccacataatggcatttgaaaggataatttactcaggaaatcacttttttaaaaggatatttaagtactttcttagaatacagttctcagaatttaaggtgcgaaagaactgccagggaaacttttgggaaatgtatattctgggttcttaccatcagaaatctaggtttgaaggcccaaggaatatgcagatctaaggagcaacccaaatatttctgatgtaaatggatggtacagagagatcttacttcaagaaatgctaagtgtaaacactagaaaaacataaagttgacggttagatgaattaaaatcagttgagttgtttagttcatttttcaatttgaaggtttcttgtttgtgaagacgtagacttcttttttgttaaagtgacaattttatagattccttaaaggaaaaaatcttatttcccttctctcccatcctgtgctgactggtggatcagattatacatgcaatccctagtgaggaaatggagacagccaagctgtttttctttaaagtttaaaaaaacaaaatcctttttcactatttgatatcaatgccagttaaagtacatcctacttgctaagcccgcagccagccaaggaaacatctcctcatagtccagagctgtcatggtagacaggcccccagaaggaataagtccttctgggaggacttctgggaggcccccaagagttaagagtaagtcctgcctgtgaatggactaaagaataccaagataccgcttctgaggaaaaggcaaattcaaatgttagggtttcatttgtatagacatagtgcttttttgacaagaactgatgagcttaactaagaatccctgcttcaaattcttactagacccaagtctcttttggtttcttagtagaagagaggctaaaagcagaattaggatggaagaaaagaagcgagagtcttgattattcacaacaaagatattctacataattgagagctgactgtgctctaaattgtaaacacatttggaatcattttcttgttttaatgttgctatgctctaataaactgactctgtctccccctgtatgtttgtgtgtgtgtatgtttaggagccctctgatgttgtcaactctttggatttgcgtgtggacatcagtctggaaaaccctggcactagccctgcccttgaagcctattctgagactgccaaggtcttcagtgtaagtgcagcttacacttcctggatttagactggcaaataaagttccacagtcactgcaatagtgtctgaaggatggttaggatgcagcctgaaaattcttaattttctaaatgaactacaattacatatgcataaagttcactaacacttaagttccatgacagcagggatttttgtctttcttgttcactgctgtgtttccactccctagagcagggcctggcccattgtatgtgttcaatatatatttgttgaataaataaataaaaataaagtaaatgccttgtgctcatactcaaaaaatattaccaatacatatgaagctctgcgtatagctgtccccgccatagacactttcatctagctccccctgtgcaaatgattatcttgaattgtgtgtttattaatgcttttctttattattttgttaaacatttatatattcctagaacattgtttggttttgtactttatgtaaatagaataatattctatgtattcttctgtaatttgctttttcaacccaagagcaaatgtatggatcttttttcctttttcgtagattcctttccacaaagactgtggtgaggacggactttgcatttctgatctagtcctagatgtccgacaaataccagctgctcagtaagttttactttaaagcttgttgtaaaatgtagaaataaaagacatactagattactttattcaaacgaatgtttatagagtttttctacaaaagaaacattcataactcataaatacctttaaaaactaaatttcaatgtctaccatccacataggagtaaaacaataagaaatataaaattatctgtatttaaatggttccattccctctaatacaatagcaacaaagaacaatccaattgcatttacttatttgttgtcagtatcattttgatgcaaagatagtttattacacagcaattttctcagtattctaagtaagtctaaagagtttagttttttaatgagtgaaattttaaaatactggcctttttatttaacagtaatggcttttcccccctcctttttacttttaacagagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggtatgtgatgagaccctgtacttacttccaccatgcttcctacttatagatcactgtcttctctatgtcctctgagttgtttaaagaagcaccttaaccctcaacatgatcaatctgaactttgtggcttccgactagttaaactgcatgagaacatagtctggctctatatctagattctgcttgacagcttgggtcagtttttcccttatcctgagacttggcagcagtagccagacactcccataactcttcttgagctatcagtgtgatgaggctgctgcattctgcacagatgtggtgcacttgctctgagacatttgagtcccaaagcttagcctgagctttgcaactatggttgttgctgctgccaagatgatgcacgccagcaaagccaactaatcacattgacttgatcattataccaggagcacacttgactgtgagtgctccctggtccctcctctaccaccaaattatgaagaaaaaagggagagaaggaaaagctgagattttccaaatgagctatctgattaaaggattaaacaatgatttcatttaatttagagttaatgtgatcttaataggcttagagttctaaacctaacctgaccttggtgtttaaacaccctgtgccaagtggcaactacttcctttaaagggaaaaaaaaacctgaagaaaactaaaaaaaaaaaaaaaaaaaaaaccctcaaattacttaaaatacagacaaacaccaacatatgattttactttcttctcttgaaaatgcttcaaataaattgagaagaacatattcctaaagccagcatttcaaaatattgaattaaagctattcgtgcatctgaaaataaaaactatcatttttttctggggaaaaaatacagtatttaatcttttctttgttttgttggatgttctaggtatctttagggttagcaataaaagtagtatattagccacctgggcagtataaaatttcaagtcttgaggtataataaattatttcagtatgaaccaaccttactgctaaaatgccactgtacctcttttaccaggtgcgtgcatacacacacaaatgttgtatgccaattgatcattgttgtttccttggtcttgttcaggttgatgggacagaagtaacatgccaggtggctgcatctcagaagtctgttgcctgcgatgtaggctaccctgctttaaagagagaacaacaggtacaacttgcatttcatcctccaatccatacaagccctccttagcacatatgctaatttaccaacataacatcttgctatcatgatttgataggcatcacaaaataactagctgcatacttaggggaagttttcaatatctaaatgttttctttaaattattaataaaaatgggattttctccatgcaattcattccaaaaggtacacatactatggaaagttctttttgtctaaatatgttgagcaacattggtcaaagcactatacacagagtcacagagatcatttattaacccctagtaacaagtttcacatcagctcaaagcttccaaattcagacaggtatatacgcctggataacttacatgtgtcacttggaagtcaagcttctctaattctaatgtgaggcatagtaaaacaaggtggacaaataaagatattccacaaatttgaaagcttaaggtatataaaattcagaatcaaatttgagtgagtttacttttatgagaaacattttttttttcacgttggcctctgagtatgaagcatcatagactgagaaattttaattttgtctttaggtgacttttactattaactttgacttcaatcttcaaaaccttcagaatcaggcgtctctcagtttccaagccttaaggtaaaacataatgaagtcatgaatggaatgatggatagctttgtatttctctttaagtaatttcctaatgtttctttctatagtgaaagccaagaagaaaacaaggctgataatttggtcaacctcaaaattcctctcctgtatgatgctgaaattcacttaacaaggtaggtgaagcagtgggtaacctgctatcactgacaccaactctagatcagaagatttttggctcatggctaaagaagtcctctgtatgctcattcttaactgaagaatttgaattaaaattcttgtcaactaaaacaggagtccacagacatattggtccctaggaaaaccttgagtgactcgttaggcttattaaaccaatgagagtagcccagaaaggcagagaaagatccccgtagccacacatcacaggcacactccacattgcaggccctctgagtagctgcaaacattctcaaaatgttgaaacagaactctcaaaggtcctgagagttgtcttcactttcttctcactgcctacttcccattgtatgtgagatctcaagcagtatccccattcctggacattgaagccccaagcacaatgttttgcacagagtaggtccacaataaatattgaatctagtcactgtttgaatattcaaatattggaactagatcaagtctagtttctgagggaaaaattcctcacatatcagattagggttttcttccagccaggtggaaatgaggttttttccaaaggatgttatccataaagaaatgctttgttccctgtttttacctgcccaaagcaagcaaacctgagagcagtggtgtaaatgtcactggttgatacaggctgtctttaattgttcagagggacaggtgtcttggtaagtgggtaacacacaaattccacaggttctaataggtcgatatcactttaactcacacttagaagtaaggtgagttcatggcacagacaaactggaacacagttgtgcagatgcactgggcacaggtgatgccctcctacaggcctgggaaccagagttctctacctggtgaagcaataggacagcttcccagcacagatcaatgacccctgaatagcacactgcagcactttcccaagaaatccagtgacagcaggtttgtctaacttctaccacatcactccagcccctaagagcatggaatctgtagatcatccaatagctctctgagcaaaaacaaaaaggaaaatatgtcatcatgtctagagcttgagccaaacagcaaagatgaaaagaatgcttctgtatcaagtgagttgcaaatagcacaagcagaaacaaaattccgtccaaataatacatctctgaaaaagtcatcagtaactgcagacttcaaaggatccccacttgctaaaataagaaattggaaacaaatgcaaccaacccaaattgatgttaccacattacctgaattttttccttcttatatttgatcctttcttctaaatattttttgtcaatacagtctttttattattctactctcctacaatggccaatattttcccagatatttaagaatgaaataaatataagattgaaatgagactttacttttactaattatcatcttaggcaggtatttttgtaatggcaacttgaattcaaatgtattctaatgttctttaaaatatatcctcaaaaaaattaacgtagggaattataaagaacaaaagttaaaatgggtcctagtcctactacctagaaaacccaaacattggagaaaggtagacagtgagaagtcatccctccccaccttccctagtgccactccccataagagactgttttcagaatatcttccagatacagggttgcttatctaccaggatatatgcatgtaacacacacatacacatatatatacacacacatgtgcacattttattacccaaaaggaatgataaaacactcttctgtaccttgcattttacataatcttagaaaagttttcatatgaggacatacagatctaacttattccagtcctggctggatcataatttatgtaaccaattcaatattaacaagacatttggttgttttgcatttttattttgttttgtttaaccatcataagcaatgctgcaaaaaaaataacaaacatctttgcaaacttttggaaaaaatcctacacaataacttagtgtatttcttagcaacaactttgatactgtataactgtacagttatattgtaaaaaaaatgatgggtagaaatagcgataatagtattatttctgaagcaggatccccctgagtatagatatttactattataaatatattgatcaacacttaagtaacaaatggaaaagtgtcagatctctttaaaatgcaaatgcagaccatattaatttagaaattggccccatttaggatctcacacaaagatcttctggaaggcataggaaataattcatgcacacacatccaagctttctgtttcaaatcctagtcagttttcccattttccatgtcaggctgacaaatcattgtttcctctcatatataaccttgacaaatacatccactcaagtctccctgtgacatattttccttttaaggatatggaaaaaatcattaaggcataaaagagggaaagacaaggttttagtaaagaaacccaaaaaattctacttcagaaaatatccaccccaagtttttaagaaatagaatcaacattctataattaacgtaaattgtccagtgggaataaatggaaaggatatgcacagtgttctcagacccctaccctcactgctcatcccctaatcccccacgcaaagaagctaccctggttggaatcccacctcagagccccagaaatgagtgaggagaggggaggtccccagtttcattctagtctgagtggtcctatgagggtttctctgatctcatcatcactttgcttgcagaacttagttggcaatcttaagcaaagaagttaagatcaatccagtggctttaggtccagaatactaaaacctctggatcatccatcttaaaggtggtctctacactaatggtggaaacagatttgaccaacctcattcagacccaaaccattcaaattggtttgcaactaaagaaggataggaagaacgaataatacaggcatccaataatgaacactgaaggagctcaataccctattattatattttagccacaccaaagtgaaaacccctggcttataaatccattcattcaactaacaagtactgattgtctactatgttaacatactagtcaatataacagtaatcttgggaagacttctactatcaattctaaagtaatacttttgtacttatttagaaacttgagaattggtagacatgtaatgcacaaactcttagcagaaaatccacaaagaaatatgttttcaaaggaatttatgttagtcttagaaacatacattggacgataagcccataggcaagcatttctttttatttggtgcttttgtaactaaaagtaaaatttactttaacctaagctataagatacttaaataaaagaaatattaaccttcaagaacaaaagcaaactaaaatatttggctttacaaacatcatccaacagatctaccaacataaatttttatgaaatctcttcggatgggaatgttccttcaatcgtgcacagttttgaagatgttggtccaaaattcatcttctccctgaaggttggtaagcctgtcataaggatggcaaatccaggagaaagtgagaagaaaaaaaatgagtctggaaataaaaggagaaagtaaaaagaaattgaaagagatccgtggttctcaaacttgggtgtgcattacaatcacctggaggaattgtgaaaccacagatgctgggctttatctccagcgtttctgattcagtaggtctagggtgggcctacacatttgcatatctaacaagctcccaggtgatgcttatgctgctggtccaggtgccatactttgataaccaataggctagatcatagttaagtaaacaactgggctttgtgcatagttatgtgtcttgggtaagggatacttgatatattttgaaggcaaatgttcaacattaaccaacagagcattactataaaggaaggtattgctgtgggtaaaagtctttggcatataattattatgccaatttatcctcagagaccacttctgtttgagtttaccatttgtatacaaatctgtacagtaatactaggtagtatctaaaaatatttttgaaccaaattctatttactattagtaagcgattattaatctaaagattactaccagttaaagataaattaatttgtgaaagaataactattttatattgtaattaaagttaaagaaactttggaaagtaaaaagaatttatccactatcctaagccaataccattttatttttgttcatttctcacttgtttgttacatggttgcaactctgcaattttgtgataaaaaaaatctttagaagaatctttatgatctagatactacaatagaatttataaaatgtggatggtatttggcaactacattctttaatggggcatctattcaattcgcggtaataacattcatagagtgtgtaataagtatacaccagccatggtatcaagtgctttacatatgttatcccatttagttcccagatcggttatgagcttggtattattattcccagggatgttatttaaaatatttaaataaccagtagtgtatgagccctggccaattagaacagaaacccccacccatgagaacagatgctgtaccagtgccctgtgccagcacatacatactgaatttctgatcatctttattttacaaataagaaaagcatagagaggtcaagttccttgcccaagccacactgctaatcagcagcagactgggacacaacactccggcagcccagctccacagatggcatttttaaccatttataccacatgtctcacaaagtcacaaattacttacccattaacattgtagatgttgagtttttttccattgagccatttatgcccagtgttccattattggcgcactaagcatgtgggagttacttatatcctactgctcaaggtcattgccaaggtatgatcgaaatttcaaaaaaattgcaacctcaggcataaatgcgttttaagaggtgagacacagagacctgaagtgtgactataaagtaatggctgactttcatttggactcagtcttaccacctcgtagttgcccttcatcaacacggggttactggtgaatttccttgcatcatgtacatcctgttgcagtactggcacattttattctctacataggtaacaacaggaagtgttccagtaagcatggcaactgtaatcatccacatccctcagtataccaaagaaaagaacccactgatgtacctaactggggtgcaaacagacaaggtaaagattaaaaaattgcctaaaaatgtgtactttcaagatgtaaataacccatgagattagggtgatcatgtctgacattttacagatgggaaacagatggtaactcctatgcagcctgggtgccaactgactagcagttaatttcatattagaaaaaatattgttacaagaaaacaaatggctgagtctagggaattgcaggtggcagaaattattccaaaaaccccattttggcctggtgaagatctgactttgacaggccctgtgaaggctgggaggtaaggggctggacctatatggggagcatagcaggtcttcacagctgtgataaggagctggtcttcaagcagccagcctggactttcgcctggtaatactcaaccctggctgttcattttaatccctctgttcgctcttttaaataacagtgcccagacctaacccaggcaattaaatcagaagctctaggggtaagattcttacaccagagtttttctttaaccacccccactccatccacaccatggttctaacacgcaacctgggctgagaagcgctgctctagccaaacctcttgacattggctcatcttcagtccaacagttgtattattcaacagttgtattatttctgtagtgtgcataggaggctacagaaaaatcaaaatcctaaaatgttccagagaaaattaccctgaattattcacagtgtttagctattgcagatttgcctcatcatatgtgggctataaaaacctagcccacctcatcagttcacatcaggagcatttaaatacttgatgttcacctagagattatatgaagtgtggccaggtcagtggcgttgaaagaagcctaacagcccttcccagacccctacaagtgacagtaggatttcctaacatgttgaaaggaacatcataaactgttttgcttctgaagtctgatcgggtgttcttcttttataggctggtgacatcagttgtaatgcagatatcaatccactgaaaataggacaaacatcttcttctgtatctttcaaaagtgaaaatttcaggcacaccaaagaattggtgaggacaagttaacgtgtgaaagctcccctcattcatttatttcacctgtgatcaggacgctgcttttctcctaccagctgatatcatagagctttcttattttgcctttgatgcttatatgagtcaagatttagaaaatattaggttggtgcaaaagtaaatacgattttgaaacccacaatttacgtttgcaccaacctaatatgtggtcaaatctaggttactggaattatcttatgccacttcttacaaaatataagttccagactttatgacatcagaaaaactcatgtgaagctattgtgtttatgcgttgtgcactttggaaacaaggcaaagagctgtgaaggaactagctgtgtgctacagaggagaagccccttaaatcccccttccacataatactgatgttttttatttagctgtgaaatatgctgctgcacttctctgtttttcaatattttgttatttcctgttctcaagctatgcctgcttctttgggaaagagactagtctagcatctggcatggtgctcggcacatattaaatattcaaataaagtaaacctttagtaagcaataactcctaaacaaacctcagctctcccctatgaacaatattggaattctcctggttttctttaattgcagttgttttattttgtgaaggatggggaaaacaggaaaccagaagaataaaattatttcttttaatgtgtattaatctacaagtaggtaaatgcatgctgtaactgaagtgggccacgctaccttttggccttgaacataggccaatgtgtcatagattttcaattaatgacttcattttttaatgcagttttacattcatggaagaattgagtggaaagtacagaagttcccatataccccctgtcccacacagcctcccccactatcaaaatcccgcacaagagtggtatatttgccacaatcgatgaaactacattactatatcattatcaaccaaaatccatagtttacattagggttcactcttggtgttgttaaaatccacgctgtggaatttgacaaatgtaaaatgacatgtatccaccactatagtatcatacagtgtatattcactgccctacacatcatatgtgctctgcttattcatcctgcccgccccactagcccttggaaccactgatcctttttctgtcaacttgtttaaaaacctagggagtctataattaggtttaatgacaaattgtagtacattttgtgcatgtttactaatttatttaactagtacattgttgctaaacaagttacagttttggggggggttggtttttaggtttttttactcttagaaatagtagtgcaataaacaggcttggggtactttgttccacatattgctgattatctcctgaggctatctatacagacaggaaatggatggggtaaagagtgtgcacttggtacattttgagatatagtcccacaatcccttgaaggagggcgggagagttagaactactaatagctcatgagattgcctgtttccctaggtgtgtcccagcactgagttttatctagctttaaaattttagcatttattttttaactcttactaacttgctctctcttttacctttgactcaatactataagaactgcagaactgcttcctgtagtaatgttacctgctggttgaaagacgttcacatgaaaggagaatactttgttaatgtgactaccagaatttggaacgggactttcgcatcagtaagtatcagttttatttgttagatttatcaatagcaaggaaacataagtctgcactgacaagttcttcccctttgacaaaataagtattctggctaatgtctgcaatggccaaataacccagagcattttaccctgaaaggcagcacacttccatcgctttccaatgcccatccaatttagcagtgcctcagagtcatctgggatacttgtgaaagggtctgtttctcagactccatgcgacctaccacatcaatgggaatggtgtcagggtcatctctgcggccctgggctacaaggggcagcctgctttgtccccctctaggggttcctccactctccatcttcccagtctcctgtgccacacccaaatcaaaatgtctgtgtctctgtctcactccttgagctctcagttaattgtatgattgatctcaaaccacctagtagatgaatctagcataaagatatgtcttcctatattacagccaggtcatcaccctgctctcctgttttacccttttcctgttgggagagcccagtgggcacatgactttctaaatcatctcaatccccatgaaagtttgaagaaaaagccaaaacaatgtcattgtttttttccatatggcaactgtgagtctgctctagttatatttgctttcagcagggattttggtagctagaatttcagtctggcatgaaaaaatataaggatagacaggcctccttaaactggactgcttgtgtggctagcattccttttactgacatgggctccaattgaggaagaaaaacagaaattagtctgaaacctcctggggatctttgtagctcttactagattttttttttctttttaacaaataaatcagttcccaaggtgcttacaaccaaacgctactcatttttttttctgtttatcatttcatgatctctccaataaatccacttcctgctatagagttttgtaaaactggagaactcagcaccctccaaactcatccctggagtcaaatataagcaatattcttggacaaagacatagaagaaaacggaatagtaaaagttagaacaaaatgcagaattgggggaatggggaagtgaggagttgaatatttcttctggcttgcttgcttgcttttactttgttttcttgttagttgcatttgctttcaagtcttcaggacaattctaggtcctttaagacgtgaagcgtgccgttagttgttatcaccttcccagctgctgcagtgtggtgctcagttttgctccattggttcttggctccttggatttgaggaacaaatgttttcatagcaaattttgccaactggaaggaacactgactgttgcacatcaaaatgcacacatgccagctctgtaaaacacatttggattttcttgagtttaagactacatcactttaactgtgaaactttttaaagtaccttcccaacgatcttcagaagcagtttatttctgggagtaaacttcctagaaagtgtagtatttatgctgctttaatgtggctatggtggttaaactaagaaaacacccttgagatgtcaaggtatgtcaagtgacatacaaggattgtgtcaagtcctacatatcttcctccttcatgaaaagtcaaatgtttatcctcaccttgcttccagcaatttaagcagcaaagtggatgtttctcagaccacttaggagatccagtctgaaatatggatctcatttcctgtatttgaacccattaatgcactgccttttgttgctaccctttctctgatgtagtgcaaggcaacttaacatttcaagtaatttcattacaaagtgattgatcagggctccaaattgatgatagagttgctgccatttgtagggagaagccttgttgaacgctagcaggtgcgttacttcactctccagatgtgtgtggcatgcttacctctacttgttaaccctgcaggatattgtatgcctgtgagaagggcctattttgagaatgctataagaaaaattctttcatctttagtctttggggattatgaaaccagcatttacttaactgctgctttttttcttaaacttaaaccattatcaatactcttaatgtttcccccaataatatgtttaagagactggtgagcatggttaatttctgatccaatcatctatattgagaaaattaacagtaaccagagactgagccagtggaaaggaaataaattgctcagtttttggaaatacattctttctggctcccagatattgtttagcaaattacctcacagagtatgtccaataatgtgccctagtaaccagaaaaactgagtcctagtagccacagcatgtgaaagcagctctaacatctaagcgctgcattccgcttcacagtagcatcagacctaatgtagagaaaatagtgaaatatacacatcaataatgtttctattgaaaaaatagacttttttttttcccccagacagagccttgctctgttgcccaggctggagtgcagtggcttgatctcagctcactgcaacctgtgcctcctgggttcaagtgattctcctgcctcagccgagtcgctgggattacaggtgcccaccaccatgcccggctaattttttatattttttagtagagtcagggttttgccatattgaccaggctggtcttgaactcctgacctcaagtaatctacccacctcagcctcccaaagcgctgggattacagatagaagccactgtgccctgctgaaaactaggctctttttctgtaactagatggaggaatgaatgtaaagttatttcgaattagtaagttaccagtgacatcagcataaaatatccttcctatatacctgccccaaattaagtattatttgatagaaacacttagataggaaatctgaagttatactgatgtgatataacaagctgaaaggttcagggccatgggtggtcaagttcaagtgcacttttaaacactatcattttacacacatgtacccagaaggaaagttctcttaccttttaaatgttggttttccattccattgtgtgacttattcaggtaagtatacaaagatgccaagtttacaattttctctcatgtcacaaacttattttttaaaaaatctgaactgtgatcttcccagttagaaatattcatttttaaatcctcacttttcaacccagttctcaagttcagatctcctcagggagatattttaacctactcatgtctggatcccaccccagagagttgatttgtggtggcaaggtgcagacagacatgtattaaaattacccgaggtatttctgacgggcagtcctgttacacagcactggtttaagcacacacagattctggatgggtcttcagaaccatttgctcttgtcacattccaccaggaaataaatacataaatcataagcatgccagcttctctgcatttgctgctgctacgataaaacatattccttattcttatgttccagtcaacgttccagacagtacagctaacggcagctgcagaaatcaacacctataaccctgagatatatgtgattgaagataacactgttacggtgagcatatcacacccttccctgtgagcctcagggtctgtgatggcattccacttctaaaagcctgggatagtcactcttcttacctacatgtatgtagaagtatcttactaaaactttaaagatctgatgtttattatgttgagattttggcgagggtgtgtgctacttaaaaagttcagtgatacacttgccttcctccatgccccccactcatgtcagcaaagctggctttcctagaggtggtgatccagtgagaagtacaacaaaaggggctctatgttctttgggactccatggtgtctcttctcatgactaagccagcagcaccagttcttcctttctcctcctgcttacacaaaatggtctggagcttaggccacaaaacttaatcatgcttatttaaatcataaattgtattttgaaaaatttttaaagaaaggtactgaagcatgcttaataaataatgcatttattagagggttttaaaaaatagttctccttacaactagacactgacactgtgtggcatgtccattcattagatcttacattcgggaggactataaatggtccccttgataaaaaaaaaaaaaaaagcttttacagagaaatgtactttcacagaaaacaaaggctctctgttctaagagctggcatgagataattttcctctgcactgactctggttagaatatgccatgtttagatacagtgggatttccatgcccagctaatctgctggcagagccctgagcattttcctcccagtgcttgtgttaggagttgaaagccagtttaagagtctgcccccaaggccagcttggcagttggcctcagtccactcctctggcttggtcaaaaagttatggccccatgaactatgggcctcctcactccatgcctgagagtgaagctcacagcactggagccccactcttgtccaagggaaaatgattctacgcaacagagcacacttctctgcctctggtttaggagcctcagtgaaagcctacaccctctcttcagacactggggcctggaaaatcagaaatagagccaaaggaaatgcagacttcaaattcaaaatgctatgaacttagcataggggagaagtattatagattttttttaaaagctcattttagaaaaacatagtgttcagacaatatgtgaaactctactgaagactgtttttagaaagcagtattaaatatatcaattggaaattcaaatgaacaattttaataaatccattagattcctcttttattggtttcctctgagcaatactaataaataacagaagccaattactaggtgcaaaagtaattgtggtatttgccattaaaagtaaagaaaggctgggcacagtggctcaaacctataatcccagcactttgggaggccgaggcaggcgaatcacctgaggttgggagttcgagaccagcttggccaacatagtgaaaacctgtctctactaaaaatacaaaaattagctgggtgtggtggtgcacgcctggaatcccagctactcaggaggctgaggcaggagaatcgcttgaacctgcgaggcagaggttgcaatgagctgagattgtgccactgcactccagcctgtataacagagagagactctgtctcaaaaaaaaaaaaaaaaaaagtaaagagaaagtacttttaatggcaaagactgcaattacttttgcaccagcttaatattactcagttgtgtctatgaaaaattttttaatctaaacaataatttggataaatttttgaataaggtatgtaacctaaataataacttcacatgttcctaagtatctgttaatttatttgaatgcctggcccacttaaaaatctgatccacaaaatgctatagtcatgggtccatagggatccgtggttccctgggttagaaagctgtggaaaagagagaagtaggcttatgactgccattaagcagtgagctacaagaatttatcatcactttattcataaattgataaagccttacattttagctcttgaagatacaaatgaaaggaaatacagtcaccaaggccagttgcaagtttagcccagcccataaatttatgacaaaaagcagctcatctgccattgcaatttaatgttacatcaagtaaataaaacacatattatcctcttcttttgcttctaaatacagctctttaggaatattttctaaagagaatgcttgagacactttccccaattaattaaatttcccctaattaattaaaaactgaatatacagttttactgttaacactcagggcagccattccattacagcatctcaaagattgccaggaagcagatacaaagaatcctaagtagcctgaaggacaacgttcccactgaaaaggtcaacttgacccttgagatattatttctacttttccaacaatatcaacttggaatgaggtttaagtgaaactagtattttagacacccaatacaaagctgctgtttcatcaccatgaagttgggttaaagagtttcttcgactcccttccccaaagctgtttgctttcacttgatgatgctttcacttgatttgaatgtatgccagaaatggaagtttctatttcataagtaagataagcatctgagattgtcaggcatgatgtagccacaagacactgatgtagttaaagcggagaaactagaaaagttgtattttttagctggttggactttgcaggaagattttctctaaaattattctgacaatgtttgagatacgccatcatgagcaagtcttgtcacctttctagagctgtagaccttcacttacagaattagagaattggactagaccatctccccccttttttgtggtattaaaataactcaactgtgaactgacatttccagattcccctgatgataatgaaacctgatgagaaagccgaagtaccaacaggagttataataggaagtataattgctggaatccttttgctgttagctctggttgcaattttatggaaggtaagaaaagctttatattttaaaatacagggctcctgaaggccagccttgaatttgcttacaaaacatcaacttcaggttttatatggtaccttctctatcacaaggagaaaagaaatgcaaatttgtttataatttcttactcatgtcattaaaaacaaccagtaaggatttttcttcttttaaaccttcctttcatccagagccctgaatgttttgttcagcttcaaataagtagacgctgaaaaatgtagctttatgcaatgcagctgagctctctggatataaatttccttctagcaggtggtagatatcaggtcatcagtctgcacacctcccttcagagcctcagggattcccagaggtgcatcagaggacgtgggcagccaagggggtcagaggcaccttacaaaataagccacgggtggtaacattcttatatcatcacctttacagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaat

SEQ ID NO: 12061 - DNA, 38371 bp, Human
  misc_feature (1)...(38371): n = A,T,C or G
tggtgttttgttcttattattttaagaatagatggagaaaagaatgctcggggaggccaggcagggtggctcacgcctgtaatcccagcactttgggaggcggcggggtggatcacgaggtcaggagttcgagaccagcctgaccaacacggcgaaaccccgtctctactaaaaatacaaaaattagccgggcatggtggtgggcgcctgtaatcccagctactcaggaggctgaggcaggagaatcgcttgaaccccggaggcagaggttgcagtgagcggagatcgcgccactgcactccagcctgggagacagagcgagactccgtcgtctcaaaaacaaaacaaaacaaaacaaaaaaacaatgttccggggaaaatgggtctctgagctgcaataagagaaatgtgagttagatccaagaaagtacatagtaacctcttttttttttttgagacgacgtctcactctgtcacccaggctggagtgcagtggcgcgatctcggctcactgcaacctgcgcctcccgggttcaagcgattctcctgccccagcctcccaaatagctggaactacaggcgcccgccaccacgaccggctaatttttgtatttttttagtagagacagggtttccccacattggccaggctggtctcgaactcctgacttcgtgatccgccctccccgggttcccaaagtgctgggattacaggcgtgaaccactgcgcctggccagagtaacctcttgaagttccctttcgatttgattccttggtggaggagacctttagtctccgcccacttactgccacctggccctacccaccaaacacctgatgggtgctgacgtccgagcccagtctccaaacactctgttcgagcttgggtgggaagagggagcctctgggattctgctgggctgggccctgaaggcaggagtggacgagaaatggatacggtctaggctcagcttcccggctacgcagtgcgttctgtgaaggacggactcatttctacattgacagtcttagcctttgataccagaagtcgcagcacttagggggaaaaatgctttttggtaattataattagcgacatttggttgttaccactgctaaatatgtctgtctttgctgaggagccaatctcagctcggatcagggtgagtggataggagaaataaatctcggcaaagacagcgaggggcctgagtgcgaggaagaactcccagagaccgccagccacctcttggggactcacagcgctgcggaggcgagtccagcattctagccagccgcgcacggacgtcggttcccagatgcgccaatgccaggtctctccagcccggctggccttttcagcagcagcagcagcagccgcaggaaagcggccagacaaatcccacccccggccccgcccgtcacatccatcttgctccccaggcgacgctttctcggagaagcgaggggcggggaggggaaatctaagcctttgggggttgccgacaggtgtttgggggagaaggcggagctggggtagggaggatgaggagggaggggcggtgctgcccctttaagaggaggcggccgagccgggatctttttctctttccccggaaggaaagcgcagcccgggctgggctcgcaaggtggggaggtgcgggactgggcgtggggaggcggggcgcgcgccgggggacccctccctcctgtcctccttgcggtcgaccggtgcgcttgccagatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgtaagtgaagctggagggtgtggggtgggagcgagagagtgtgcgagcgcgggatgcgggtccggagctgagtcggagcccagggcagctggcccttgggagccaggattaaggggcggccctctggctgctgggggttggcgggaagtggaggattgggtgtggggtcgggcagtaatcattggcaagtgctgacggggccagaacctgtctggacgccacccctccgccctttagatctctcatgagagcggaagtggggtcccggtggctgagtcctctcccattctgtgaaccgagtacccagcactagcctgttctctccagggctgggagctggggtaaactgcaagataaacacccagcggactccccccttcccgtacgcttgggggaaaaatgagcatatacatttaagcacctcgctggtagtctgcggccacgccagccacaccctctgcagagccagactggatggccttctcaaccgctggcttggcggatggagggtgaggcgatgggtgagtctgggcgtttggagctgtccatacgctccctctgacgccttgaggataggggcggtgaaagagagaggaggacttgtcccaactctggctgggtctcctcctgcccacccgcaagcagtggcactctccccgcagacatcttccctgcattccacagattcgtgttggatcttcaaccctgagtgtgtttgttttggtttgaagagggaaacagtgtttttctctttcttctgttctccttccccaacagctgcaaggaggaggggaagagctatgcacagtggaggaaggaggaggaggttgcacccagcctcctgggtccccctcactccaccagacgccctcatgcccaggagcatgtccaggcttcagaggtctctctgccgtggcctcagagcgcgcggaggttggcggttgggggaggtgaagctgtccaaagagggacggtgtttaggacaggttaagcaggtaccatccaccactttgggctgggcgatctgccaggcatctgcccccacctagcctctgcccccacctggcctctgaccccactgaacaagaagacgtggtcacatccagggtacactggaaaatctccctgctctggctggggcctgcagagcttgaggaagtttagaatgtccaaagtccaaactctgcccccgccttggttctgccctcctgacccagcctacctacctggacttaacctcaactccatcttgctcttgcagaggctagggctaccacacccttcccagcctggccccagcagctgccacctggccttagccaaccctctatcttttggagatcctgagccaccatgagcacaagtttctacatcagctctttctgccctaactgagaaaaagattttcagactttcaatgccaaatctgcatgatataagataacataggtaaagagatcagactggaaagaaagagtcaataatgattccgcaacccttttgcctggtgaccttgagcaagatatttcccctccctgggccaggtttcccccaaaaggggttggacctggatctagtgctctttcccactgctgctggcctgtgagaagcaacttgatatggtagagggagaagaggcttggaggtcccatggccagtgtcctgtctcagatctgttaccaatacctgaacctgaatttccgcacatgttggagggaggggaacagcatgccttctgctgggatgttagtggggctgtaacgagataaagtgcgtaaaatcctctgcacatgtgcctttctccaaggagcacctgaaggctcttgcgctgaggccagaacctggatgcatcctcattacccatgggccccgcccagggtggctgagcaaaggggttctacttttctgtctgggaagctggagctggcattcagcctgccaagagcccagaaggttctaaagctaatgaacctctgaggggcagttctctcccttgagtatcctcagtctttcctaagggtggttctgtgtcttggcccttctcttcatctcactaaattcgacccctcggccatttgggagagccagctgggcttagctgcagccagctgtgtagccagatgcaaacagctgcctgagtgcacaactcagaggaactaactagtaagacgagctgcagcctcatattctgttagcctgaaagtctctttggaaaagtgggatggttcgtggtcttggacaggctcttaaactggggttcgtagaaggttttcaagagatgcagggactccctgaaagtgtacccaaaatcgtagtatttgtccactgccctgggggtgggaggaggggagagcacagctttcttgttctccattcataaggcctcagaaatggttagaaacccaggggtgggaccctctttgctgccccatcaccttcatctctggactggggttcctggtccacaacatagggggctagccccaacccagggcccagtctcctagtctgtggaaatgaggggtaaggagcaggcagaggaccaaagtgctctgggcttcttggcaagatgcatgaggggttccttggagggacagggactgttctctgggaggtggttactgacaccctctctgctccagcacctgcactgacattccctcctgggaatccaggcattctggtctggcctgaccctgtgggcctatggggatactgccggtccttctctctctttcacttttgcttggaaatgagggtatctgggaagcccagggcagggtggctcctagaaatgaggtcatgcctgaggtacgcaggagccaggctcacctgccatgctctcctaacatcatgtttccctgggcaaagcaggtgcctggcagccttcaaggttcgtgccagcagaaatgggcacagcagctgtggctggaggcagaaggcctgctcgtgtagtatctttttcctctggctctacccagtgaccagtctaggccaagaggctttcaactgggcaggagtaggggaagcctgatcttgtagaaaaagcagcagcgaagggggcttggtcagaagtaaacaaagaaggaagaagatcccctttgcagtaagaggaattgaggttagatgacacttagaatgccctcgggggtcaaatacaggaaaaatactgaagagccaaggaaagggagcagaactgagaaaaatggccttgttctttttttatctgaggcttagccagggctctttttcctgtcctttctcattctctctctccctccagcttgttgctctggttctagggctgagtcaccagtggggagagggggctgggtgggcagcaagggaagggtcaggaaggatggggagggctgcagtttcagctgccacagggccggcctctggggagatggctaattcgggcagcaaggctggcatagagctgggatccaggcatcccagagctgcccccaccccttctctggggctcagaggtggagcaggcaccctccccacctgcctcccggccggggataggaggggaacacaggaggctaggtacccaaggagtgaggccctgccatgttggcctgagtgctagatcctttggccccctctggaatcctcccatggagccaccaagtgcctccctgaggtgacagaatctgggaaggtgaatcttacaggctgcttctctgagcattaccccaccccagtgcccccaggggccttctcctctttgaggtgagccaacctggtaccctgaattctcctgggtactgtgccgcgcccttctttgattcttctgctttctccttggctgttccattagctctgaactgccccaaggggagtgatagggcaggggtaaggaagggctttttcggaacttggagctcaaggggctccgcagaggccaagaggggctgtttggctggagccaatgggagggtgaggaggcagctgttggaaagcccttgagtagtcacttcacccatcccactccatctggggggctgggggtctctgctccccccagtccagcctgactccaggagaggggcagtcccatctcctatcttccttgctctaagagctccatctaggcatccctccacctactctccctccttctggctgcagctgaggggatgggttcagtactgctctggaaggggtcagcttttggattttgtgatctggaccagacctaaaagcaggtggctggcagaattgctcatttgtgtactaatttgcatttcatttgcatacagtaaggtccctctcaccttcaggattctccaaccccctccgcacacacctgggtgtgtgtggctggaggaagctggaaccaccctctgcacacccgccttcccccatccatgtgcaggcctctggctgtagacccattggatcctgggctgggagccagagggccttaaagggcctctgagtgggccaagtggaagctaaaaatactctgggggggtgaagcgggggctcactctggaatctctgaggagggaggggcctgggatgtagggctgggattagggcactggccctgccctgccctctatcagtaggcataaggctggttccaggcaacaggcaggagggtattggtggtaaggggaagtatttcaatctgattgacatgcgtgcccagctctgcctgctcagtaccttgggaagttcagaggagggagtcccttagccccttcctggctgagttgagggggctgggagggcatggagacccttttgctcagctgcctcctgtatgacaacatgggcagggcagcagcagcaacaagggggcaacacttccattacaggcgtgcccaaggcccggcctcccactgaggcccggaccccttagtgtcactgtagaaaattcccaacctccacctccagccagatctgagcccccgctgtagagtgactctagctgccagcgctcccaccctgaccccagtgatcacctggtatcctcaagccatggaagtcttcctatgtctccctgctgatctctctaaaccaccaaaggagtctcttcttttccctctgctccaggttccctaacatgccagggcagaaattcctgggtccagccaggcacggtggctcacgcttgtaatcccagtaacttgggaggccgaggcgggtggatcacctgaggtcaggagttcgacatcagcctggccaatatggcgaaaccccatctctagtacaaatacaaaaattagctgggcgtggtggtgcatgcctgtaatcccagctacttgggaggctgagtcaggagaatcacttgcacccgggaggcggaggtggcagtgagccgaggttgtgccactgcactccagcctgggtgacagagcaagaccctgtctcaaaaaaaaaaaaaaaaagaaagaaaaaaagaaattcctgggtccctggagggagggctggaggcatgctagaccagtcctgatgccacaacaaatcggaacaacaatgctcacattagctatggcttcatatcagaacacctttttgtagaatagacctatttgttcctctagcaaccctggaggtcagcaggagaggggctgcccccattttacagatggggcactcagggctcagagaaggaaaggaaattgccccttcaggcagaacaaaccctagacccaggtccgtgggttctcaggctgagatgctcctttcccgcaggctgtgggtcccttctctcatctgtcaggcacgccagagagcggatgtccatgggtggtcaggcagtggactcatcgaggccttcccagcccagagagaagtgactctccaggcctggctgccaccctggccccctgccagcctccctggccaggaagcttcaccccttctcccaggaacacttccccagggtgaggtctgagctgttgtcttgaagtataggcaaggtcccacccccttcccagcacccgcaggcagtacattcctgactcccagtgggtggagataccccaggccctggcatgcccaggccctgcactgccctgccctgcccagcccactccctgtagcccacactcacaggtcccaggcagaagctacaggcgtggctgttgcttggcacttccagactggcaggaggcccagagcccaagttctgagctgggagctgtagagtgatagagttgctggggccaaatggtggggcacctgggaggtgcctgccacccgagaaggccagggccatcaggattgagcaggggctcctggcagaacatttagaggctgcagggaggtgatgtggggagaaaatctgctaaaactgagttctcaaactggggtgcaccagattccaccagatggtgtgttgtgggcagaggaatctacctttttaacaaagatccccggggtttctgatggcccaaggcttgtcctctaagatggcatttcagggccaacccctgcctctttctgctccagccacccctctggtatgggacgggttgccagggtcctaagcatccttgcaggaacttgctgtctgcatccccaaagatggattctgggcaggctgggagcaaggcaagagccctttccctccccacctgctgcccacccactgggaactctgctctggggccacattgtccaaagtgtcaggtacttatcccaacccctacctgtgtgcctgtcttaaggtaactggggaaggatgttggacatcacccaggtcgcttaggggcccaggtctccaagatctgagtctccacatggcttcaggaggaaaaacccagcgttctgacaacccagtcccctaagttctcccctctgaacccccagaatttgaactctctgccaggattcctcatcttgctctcttctggtctaccttcatctcaaaggccaaagcattccttccaaaactgagatctggccatgtcatgcccctgcctaaaatccctctgtggttcccctaaggaccttcccagcctgcctttgtgtgcctccccagaggctcctggactccagctatgctgagggccttgcaggtctctgattcaccctgctggctcttgcttcctggccctgcacatgtgtgcctttgcccaagtgctcttcctccccttcttcacctggagaaccctggtgattgtcctcagactcagattaggtcacctcttctgctggcctccatcactgccccctcagccctgagcctgggctactgtgctccctgcttcccactcccggggcacttccttctagtgtcttttttccttgcctgccttaccctacactgggcacttctggagggcaggagctgggggtctcctggcaccaagaatctgtaaatgtatgttgaataaataacaagttgttccaagtggggcttggggagtctgaacccggacccacctccgtccctatccccaggctcctggctggtgccccccgggagctcgctgtgcccgatggctacaccaaccggactggtgctgtgtacctgtgcccactcactgcccacaaggatgactgtgagcggatgaacatcacagtgaaaagtgaggggaaggggctggggaggggtgctgggtcagaggtctggcaggggggtaccgcagagagaatggcctggaggagatagaaggcttgttcacacggcttctagtcgcttcttgtccagctgggaagagggtgccctagaggagagtggggctggatgggattggtagagctcagaataatgacgagctggagaaggggagttgggagggctgccctgtgggtggagggcccaagcgggacccactcctgccctctggagactttgggcactgaagtatgggtgaggtgctctgattcatgatccttccggtgcccacagatgaccctggccatcacattattgaggacatgtggcttggagtgactgtggccagccagggccctgcaggcagagttctggtaagtgggtgctcagtgttggctcctccacctctacccggctctcccctcatctccagagctgggaggaaagaagagggcagcaggggggtccacggcgcgtgtgtgctggggcctgcacacatgtcccttcctgtggctgtgtgtccctcgctctctgcactcctggggagggggtgagtatcctgtgctctcccaaacccccgcacggcctgagttctctgactcatccacttcctccgcatgcctacactgggtgctcagccttcgtgggaacaagccgagggagccgagggaactgcaaggaggagaaagggcagagagggccccaggcagctcagcgctggctggcgctccttcctgggaggctgactgccggaagaggcccagccctgctgaccccggctcacccagctctggtctgggggctaatcaaatgtgtcacctcctgcccacattctatagtggcagcccctgagttctccatttctgggtcccagatagacatttccccccgcatttttttctctctctgtctcttgttgttgttgttatattccaaaaaggattttgattttattgcttcacacacagaagagttctggttaaggcttgccttgctcctggtgctcatatgatgccaccaggatgtgatttatctcaagcacttaactctgtgttcttcgtgttgcctccattctttgataggcattcttttcgtagtgccaagatgaatgcaacagcttcagctttatcttctttgaccttcaagttctatagtcccagtagatatctgactacaactcattagctctgactatttcaggtactcctctctgaaacaattactgtgaccaagagaatgcaatacttatactttcttcagacatgaattatcagtatccagataggcacataaactcagtcttagaatgtgttgctttgatgtcaggtttttctcttgccttgatagttccacatggctggggaagcctcacaatcacggtggaaggcaaggaggagcaagtcccatcttacgctgatggcagcaggcaaagagagaatgaggctgtctctctctctctctctctctcttttcttttctttctcttctttcttctttctttcaagatagaagactcccagctgggtgtggtggttcacgcctgtaatcccagcactttgggaggccgaggccggtggatcatgaggtcagaagttcgagaccagcctggccaatatggtgaaaccctgtctctactaaaaatataaaaaataagccgggtgcagtggtgcccgtctgttgtcccagttacttgggaggctgaggcaggagaatcgcttgaacctgggaggtggaggttgcagtgagccaagatcacaccactgcattccagcctgggtgacagagcgagactccatctcaaaaaaaaaaaaaaaaaaaaaagactccatctctcaaccaggctggagtatagtggtgccatctcagctcactgcagccttgacttcccagactcaagcgaccctccagccttagcctcccaagctaatttttaaagtttttatagagacagggtctgactgtgttgcccaggctggtctcaaactcctgggctcaagtgatcctcctgccttggcctcccaaactgctagtgctaggatttcaggcgtgagccaccgtatgtggccccatttttctttttctttcttttttttttttttctcttagagatgaggtctggctctgtcacccaggctggagtgggtgacatgatcatagctcactgtagccttgaactcctgggctcaagtgatcctcctgcctcggcctcccaagtagttgggattataggcaagagcaacaatgcctggcttttttctcattttaaaatttgatgtggccaggctcggtggctcattcctttgggatgaggcaggaggatcgtttgagcctaggagtttgtgatcaacctgggcaacacggcaaaattccatctctaccaaaaatatataaattagcccggcatggtggtatgcgcctgtaatcccagctgcctgggaggctgaggtgggaggatcacttgaaccccggagagaaaggttggagtgagctgagatcatgccactgcactccagcctgggtgacagagtcagatcctgtctcaaaaaggaaaaaattgatgtaatgtttacatacagtgaaatgtacagatttcaaacttcaatgaatttttacaaatgtatgtacctgtataaccaaagatatatcttaaaatcactccagaaggtgcccttgtaaccccttctaatcatttgccaccccataagccaccactgctgggatttctgtcacctttgaacactgttttaagctccaggttggcatcagttcactgaaatgcctttttgataaccctgttatggatggctgtggtctaggagcccatttaaagtgattctgcaccctggatcctttagcagttatttactcactgttcattcaacagatatttggtgagcccctactgtgtaccaaacactgtgctattcctagaagcttagcagtgactaagacaggctcaggtaacatgctggtggagctcacagctagaagggaccacagaaagcaagtaaacaagaaccagggcctacttctggactttgcctgtctccaggctgttttaagtcaccctattctggcccatcagtttgcccaataaatatatactgagcagctaaagtgcacccagagaggctgcgcatagattctcccctccgtgaagcagcacagcatgtgcttaagagctcagattttggaaggagacagccttggtttgaatattctctgcctctctctagatatgagatcttatgcaggttactgagctctccatgcctcagtttatctaaaatgggggaaataatcattcctacaccatagggtcactagcaggcttaacacttaatatgtgaggagttcagaattgtgcctggcatataggaagcactcatgaagtgttagctgctgctattattattaccgtcattgtaattattattttaataatggtcctttcattaagaggacagggtcatctggagatggcagagcagcaagtcccttaatctctctgttactaaccccttctagaccaagagcctgaaccccacagtctctcatccttccctgctttccctttgctgagatctctaagccactctcagatccacactttacagctttccaaaaagtgttcctgaccctcagagcagatttctgaattctggaaaggagatgcaggtttaagtatcactgggagaaggagaagccaggagatctcctttgactcctgtttggcaaagccagaggcttacagggtaaaagagacagctgacccgggtccctgtgcctgactaaggctgcctgtgtttggggggtccccaggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggtggggaccatggggccatgggggaagaaaggaagagcagagaccacccacccctagttagccacggggacagctggcctagaccatccacactagaaacaggacctcatgccagtatcagcaaccaccatgacttctactgttttaaagcacttactatgtgccaggggccttacgcatattatgtcaatcaatcttttttgttgtttttttgacatagggtctcactatgtcacccaggctggagtgcagtggcacattcatggctcactgcagcctcgacctccccaggctcaggtgatcctccaacctcagcttcttgagtagctatgaccgcaggcatgtgccactacacctggctaatttctgtattttttgtagagatggagtttcaccatgttgctcaggctagtcttgaactcctgggcttaagcaatccaccctcctcggcctcccaaagtgctgggattatgggcatgagccaccatgcccagcctcaatcagtcttttttatttatttatttatttatttatttatttatttatttatttatttttttgagacagagtctcactctgtcacccaggctggagtgcagtggtgcaatctcggctcactgcaagctccacctccagggttcacgccattctcctgcctcagcctcttgagtagctgggactacaggtgcccgccaccatgcccggctaatttttttgtatttttagtagagacgggctttcaccgtgttagccaggatggtctcaatctcctgacctcgtgatccgctcacctcggtctcccaaagtactgggattacaggcgtgagccaccgcgcccagcctaatcattcttaaaatactcttatgaggcaagtattattatatccattttacaaaaacaaaaactaagacttagagaagtaaattgcccaaggccaacaaagttatgaaacctggattggaatacaggtccatctgacttcagtttaaccatttacaaactaattctaaaaataaaacatgctcctggtacaaccactacatagtacagtaggcaatgtcctataataatagttatcgccaggtgcagtggctcatgcctgtaatcccaacactttggaaaactgaggtgggaggatcacttgagcccaggagttcaagactaacgtgggcaacgtagggagaccttgtctctacaaaaaatttaaaaattagccaggtgtggtggcacacacctatggtcccagctactcaggaggctgaggtgggaggatcgcttgggcccaggaggttgaggctgcagtgagctgcgattgtgccactgtcctccagcctgagcagcagagcaagaccttatctcaaaaaactaaataaatatcgctactttctctctttctcttatcaaaagtcatgggcactttttcatgttgatatatataggaccatcattttagaggatgaagggtattttcttgtaaaagaccatgcttgtaaaagaccacactacacatggtctcacagggggtgtctgacagcttatactccctccatctctttgcctccctccatcacacaggttgtagcaatagggaccccttttcccttactgaacctttattgttgtagaatcagcaggcagaggagccttgaatctcctcttgaccaacatgtagccccaggcatagtcacagctctgggctcaccgaaggctgaggcctctgccccctcttctggtcctgcctcccaccccctggtcatgtagcaccttggcaaagtcacagatactctccagcagcagccctgggtgcagggtccagctaggcagcccgagtttggggtcaggaccagaaagagataatggtgtggagtctgacctcagtgtctagagagtggggaaagccatctagcatctaatatccaggagcctgagtgattaagttctagccatggctctacaaccagctccccatgggactatgagcaagtcaacttccctcctgagcctcacttatctgcaaaatgggggtcataatttaacctcaaataattgttataataggccaggcacagtggctgacacctgtaatcccagcactttgggaggccaaggcagatggatcacttgaggccaggagtttgagaccagcctggccaacatggtgaaaccttgtctctactgaaaatacaaaaattagccgggcatggtggcgcatgcctgtaatcccagctactcgggaggctgaggcaggagaatcgcttgaacccaggaagcggaggttgcagtgaggcaagatcacaccattgcactccagcctgggcaacaagagcaagactgtctcaaaaaaaaaaaaaaaaaaaaaaaaggaaaaaagaattgttaaagaggatgtgttttataaatggcaaaatgctcaccaataaaaggggttattactatccttgttgggtgggggtgggggtgggctggacatggtagaggaaaccagaaaccggtggtgacttatactccctactctccctccctcaatccctgtgaaggaaacagctacatgattcagcgcaaggagtgggacttatctgagtatagttacaaggacccagaggaccaaggaaacctctatattggtgagtacagtagtggtagcccatcaagtggtagaggggaagggggcttagtccctggtggaaaggtgaggccagagtgcagttgtgactaatggcatttagttaaactagcacacacggattggccggcacctgtatgccaggccctgttccaagctcccaagatgcaaagttcttgacttcaggatgctcacagtccagtgtccaggcagaactgggccatggctgctggccatctggagtctactttcttgccctacttggaatagtgggatagaacatcatggtggggggcaagagagggaatagggagatgggtccagagtagaaagagacgaagttgactgggaccttggttgaacatcttccctctatcccagggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtgagaatctagggacatcctctggggccagggagagcgatgggcgggggaaggcttacctaagccaggtgaggggagtggaggatttgcagttgtgcggctgtctgcatgttgtttgcagaggtttgcagtcaggctttatgggagtctgagcacctgcacatggcatttgtgggacccctgcgtttgcttgtttctgcttgggatttgtatgctccagtggatgtggattgtttgggtttgatttgtgcctgcatggcgtctccatgacatatgtcttctatttggtgggtcatattggcatctccatgtccttcccatgcacatgtccttcccacccatgacctgtggccggaagagccatttgcagagccctgtgccctggcacagtcacacctgtcaaacaagaactatgctgcatattggaggctgacctcacactcccatttccctcctctcctgtgtaggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcagggtatgagccagcactcctcccccagcacccctcctccagcacccctcctcccagcacccctactgactgagcaccagctgcacatcaggcttgacagggcccacagatgagacaggatggggccggacctggggagctcgcagcagtactagagagaggatgtgcagatgtgcagaggaagcacagaggcaagctcagtgggcctcctggaggagcttgcatgccactgtgcagccaaggctgggctgagagtgcacagtagagaactgatggggcacaacatgggtgtggaaactggcctggtgtgcccaaatctagcgggtgtagagtgttcacatcagagaggaggctggagggggagtggggtggggtggggtgaggatggatgctttgaaagccaggcagagtatcttagggatttatatttgggtaatggtgatggtggggtcatggggcatccagagaaagttttagggcagggatgtgatataataactttgtaccctgaaggatgattctggaaggggtatggaatgagtgattgcagggatggagcaaggccaggggagttaagatcaagaatgtaatatctcaggtgggagatgataaggaatgggacaaggtgggagccctggatataggggtcctcataagtgttctgcaggacttggggaccaatcggacctggggtatcagggacaggggcagacccagggctggagtcagtgccatgggggcacctggcttatctgaaagtcacttctctgataatctcagtttcccaggacatagctgagaaccaagaggaaggcaaaggagcctctgaagacccaaaataggtgccagaaagttcagtcaccagaggccaagtgtgcactgtggaaatcatttggtttcggcctgggacctgcttctgctccctttacaggccttactaacaagcttggcttgctgattccctaggccttatctgatccaaagctgcaaactggaaagagttcagtttaagaagataaccaaatacttgggggttatttgtggagataatgattagaatgtaaaaagccttgacactttcagtgaagttcactgtagtgttgtggttaaaatcccagcccctgctgtgagacagccctgggctcaaattttctcttttctacactcattagttgtacaactctgggtttttggagtgtctcctcatctataaagtggggggataatagtacccaccccacagcactctcgtgaaaattaaatgaatagctgggtgtgttggtgtgtgcctgtcccagctacttgggaggctgaggtgggaggatcccttcagtccaggaggttgaggctgcagtgagctatgactgtgccactgcactccagcctgggtcacagagcgagacactgtctataaacacacacacacacacacacacacacacacacacacacacgcacacacgcacacacactgaatgcttgacaactgtctggtagagtcacttgtcatctcctgaacctactttcccacccgtgataggaggaagctgggctccagatggtcccagtgttcatcctgagctgcagagctctgctctgtccctgatgctctgagccctgcccatcaatcaggccaagatcagttctgtgctgggctgtatggcctggagcaaagagttagggagacgtggggcccagagtacctgggtgaccctgtcttgccttttcttctgcagatattgctgtgggagctccgtttgaaggcttgggcaaagtgtacatctatcacagtagctctaaggggctccttagacagccccagcaggtacagagagacggggatgggtctgctgcccccaccagccgagatgggccttccttgctttccttcacccaacccttccctgtagccccctgggccctgctccccagagcctgcccccaccactttcccctgcccccaggtaatccatggagagaagctgggactgcctgggttggccaccttcggctattccctcagtgggcagatggatgtggatgagaacttctacccagaccttctagtgggaagcctgtcagaccacattgtgctgctgcggtgagccaggaggccagtgaataagggtctttctcttcttcatctttgtctgcacagattcccatctgtgtccatgtttgcgctagctccttggaagcctgggccccaactctggcctggggcaggcaggaggcactgatatctgtctggctctgttgtctctgcagggcccggcccgtcatcaacatcgtccacaagaccttggtgcccaggccagctgtgctggaccctgcactttgcacggccacctcttggtgagattgttctgcccacctactcctcatttatttatagggaggctaggaggggctgcagctcccaaacccctcccctggcctcctgacatcccacctttagaaatttgattcttggggccagcatttgccctctctacccaacctcattaaaaagcaaaattccttgtaagaggtaatggatgaagtcgggggcagtagagtatagtggttcaaggtgggagctctggacggcctggttcaaatcccagctatgccagtgcaggggtggggatgggctctggaaagggggacgcatttaagtggatggatatggaggagagtctcctcaggtgaattattaatccctcttaggctcagatttcttgcttgtagaacagaattgataataactgattcacagggttgttgtgataattaaatgagaaaatatacagaaagtccttagcacagcactgtgtataccctaagtgctcaaaaaatgttagttgctaagaaagtgacagtaatgatggcgatgaccccaaggtctttaagtgaatgaggattttggatcagaagacaaaggcagacagagcagggaaatggggtggttggtgcaaggagacctggactggggattggccgacctaggttcaagactgggctgggccaccaactgactgaggacttcagacaagtccttctgggccctaggcctcagtttccccattagtgacctctaaccctgttctctttggctttaaggggagtggaagggaaggggtcagggacaccacagacctgctttgtggactccccagttttgtccctgcctctctccagaagggcctcggtttccttttgcccagtacagaggcgagagctagggcctggacgtgtgtgtcccactgtgacccgccctcctgtacatccctccaacagtgtgcaagtggagctgtgctttgcttacaaccagagtgccgggaaccccaactacaggcgaaacatcagtgagtgctggggtgcagcgtaaaaggggtacgctcccctgtccccttgctgaccaccctgtctacctgtagccctggcctacactctggaggctgacagggaccgccggccgccccggctccgctttgccggcagtgagtccgctgtcttccacggcttcttctccatgcccgagatgcgctgccagaagctggagctgctcctgatggtgagggaggagcaagggtcaggatgagggctcccaggtccctggaggaggtggccagtgtccccctagatcaagggtgagggacgggggtctccccagagacagaggttggggacatcggtttggaaggctattggtgtgtaggagtacagtgtacagcacccacacatgaggagtgatggagacccttggggtggggatggggccaaagggcttattacctccaaggaaagtgaggagtgtgggagctcttggctcagcccacctctgggaaaaggggtccctgagtagggagcaaggtcagtccctctctgggacatcagggtggaaggggagagctcaacctggagaccctgtggatggggaggtgaagggacttttgaggaggagaagccctgtctctcctcttggagggtcaggatagtaggaagtcgcaatttggcgaccggactggagggagttcagcctaactgtcaggttttcagggtggggggcgggtccagctcttctctggggttcagggtggtgtgaggattcagctggggcagggagcagtgcagggccgggctcagctcaccctctctccccaggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtgagtggggctggcgcctggactggaagaccaggggccagaagggcggtggggcgagagggcactggggggggtggtgcggccttcacacctccggccaccccccaggtccagttccagaaggagtgcgggcctgacaacaagtgtgagagcaacttgcagatgcgggcagccttcgtgtcagagcagcagcagaagctgagcaggtggctgtgggccgccggccgcgttaatcggccaagggtgggacggggcctcattaactggcagggtgggggcggggcctcatggcaaggcgagcccagggacagggctttagcgggaacaggtgggatggtcagaaacggggctttctcctccaggtgcgactagaggacggggcctggctgtcccaagatgggcttttctcacctaggagaccccaggggcggggcctagttgatccgggagtgccctgggggcggggctcttggctgagtcctgggctcctgctctcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgccccgtgagtgcccgccggccggctcagagcccaagcagggctccccgcgtctttgcatccccatatccatgtcctgtgcaggtgttgtcgtctgccacgtgcccacctcctctggtctgggccttcttgggggccttagcgtctctgctgcttggagaatccggctctcaagctctagggcttctgaccttgcaccacagaggagggaggacaagccctactttgacccgaccctgaccttattcgccttctttcctcagcccggggcctgccaagctaatgagaccatcttttgcgagctggggaaccccttcaaacggaaccagagggtgagcaccggccacatcctcccagtcctcctgggtccctggctgcacctctgatgagctccttgtccttccagcctctgcctgcctgctttctgggctccctcgaagtggagagccacagtgcgggaggagagactcagtagagggtgagaagaggcccagaaactaagacaaatggggctgctagggagctgtgcacaaagctagagcaggtggaggggaggaaaccagtttgaccaagcaccaactgtgtgccagcccctgagcccaacactgtgcttctttgatatgatataattctcacagccttctgaggaggtagatgctcttttacagaagaggaaacacacacttagaaagtttcagttacctgctcaaggttatgtagctcaaaagtagcagagatgtgacctgatggagagaaagggggaaagggaggcagaggtggggtggggaggtagagacccctcacccagaataggaggaggaggagaaggccagaaagccaactagaatagtgtgcatcccctccttccccatgacatcacccccgccaggccccatatgccactctctgcctccctgacccttgtggcagatggagctgctcatcgcctttgaggtcatcggggtgaccctgcacacaagggaccttcaggtgcagctgcagctctccacgtgagtgacctcgaaaagccagtctgggtcagggctgaggtatcttggatcaccttcctaacccctgcatttcctcccaaggtcgagtcaccaggacaacctgtggcccatgatcctcactctgctggtggactatacactccagacctcgcttagcatgtgggtaccgctctccaccacccccaccccagcctgctgtgcctaagctagggttccctatccccaagctatctcccaaactcctctgacccctctcttggcccagtgtcctcaggcctccactttccctggatcatccttttcttaacaacaacaatcactatcgttaccgttactattccccctgtaaagcaggcagaaatggaggaatcagcaaccccggggctaaggtgttgtccctaccattttataagagctcattgtgctaaggattttatatacatcatctcaatgacttctcacagcagccctgtgatacaacagctatgattaagtccattttacagatgaggagactgaggctcagagaggataaatagcttgcttgagtccataaagcttgtaaatgcagagctgaggtttctattgaggtgactgatgtcagaggggctatagttagccagctttggtgcccacccccctctgccagggccctggtctcttgtcccccgtgactccagcatccttcttacccctagggtaaatcaccggctacaaagcttctttggggggacagtgatgggtgagtctggcatgaaaactgtggaggatgtaggaagccccctcaagtatgaattccaggtaaggggctcgccagagtcctgggctggggacttctaggaaggattatttttattttctctggggtctgaaggtgggagggttgggggttggtaagatggaggtggttttccaggagataatgactatgacacatcttgtgcccacaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgtaaggacactatcagggatatttcatttgcatgctacagggcagaaaggccagtgtcttcccctccctcccctcatacccctttggcaagctgtctctcctaccctttcctttcctgcaaccctgctcccaattcttcctctgccctgccagcaaatctcctatttcctctccaggaccctggggacaggccatcatccccacagcgcaggcggcgacagctggatccagggggaggccagggccccccacctgtcactctggctgctgccaaaaaagccaagtctgagactgtgctggtgagtggccagggcgaggttggaggggattgcatccaccccatcacagggtgcctgggcaccaggggcacacaaagcaagggagacctcagtgtgatgaggtgatgaggcccctgctcttgggagcctccagacagagcagggagcctcatctcctgccctcagagggttctccactctgatgggggaggattgaagacaagggaccaaaggaggaggcactggctctgctccaaggaaccccagcctgttgggggcgatagagctgctcagagctttggccggcaggaggcggtgtcgggcagggcaatggtgggtggtgcgtgtgccctctgcaggaaaggagaggagagcgggcctggcaagccggttgaagcctagctgggtggagagtgggaggtggtgtcccaggggcagggagctggctgggaagcaggtgtaggcggttgggccctgtttacacaagcaggggccagattccatgttatccatgtgcctggcattatatgagcttggcccaaagagtgtgtctgaaatgcatagctgtgaggttgggggacgtgtgcatgagtgaaaggaagtcagacccctttgggtcacccaggggtgagacaaagcctggaaggggcgggaggtaaggagcaaggcatgaagaatctggagactcagactatgtcacgtcttgcgttccctgcccgcctcagacctgtgccacagggcgtgcccactgtgtgtggctagagtgccccatccctgatgcccccgttgtcaccaacgtgactgtgaaggcacgagtgtggaacagcaccttcatcgaggtcagtgcctgggtctgaaggtctctcctaccatccaccctgagggggagaacaacagggagagggcgagtccagggtcatagcatgggtgtgtgtgtgtgtgtgtgtgtgtgtgtgtgtgtgtgtgtgtgatttgcgtgtctttgcatggatgtgtatgtgtttgtccccagccaaaatgacctttctcgtgtccattattctgttatgtgtccattactgtcccacctccatgcctttccccagggtgttccttaaccctggaatgctcatttcccctcttttatctctgcgtgtaaacccctattttgttttcaaggtccctgtcagatgcttcaccatcagtgagctcttttctggcttttccagctgaaaatgacctctcttccaatggccacccacctaactttctcagaagccacacatgccatttatcacgctcgactctgggttgcaatgcctcacgtgcccactttctcatgccatctagaccaaactttttctgtacatgactagattagaaatcttttcaacttggcgggccatagagtttctgttgcaactactcagtactgccattgcaccacacaaacagccatagacaaatgaatgggtgtggccgtgcgccaaaaatacttcatttacaacagcaggtgccagtccagatttagcccacaggcctgacctagactgtgaccttcattgtttcggttgtccccagcatccagcacaggacctgacgcagaaatgaatgaacaaataaatgaatgatgcgcatttgtgtgtggaggggaggcctggctgacagatcctttggggtgctgtttaaggatgctacttggtgggagggtgatggggtgggaaagcttagggtcggaggtaggctcagagaagtgtcaagtgttccccttgacccaccccactcccaatccaggattacagagactttgaccgagtccgggtaaatggctgggctaccctattcctccgaaccagcatccccaccatcaacatggagaacaagaccacgtgggtgagtgcgcatgttcactaggacagcagtctccagccagagcttgagagtacagggcatcttttaagaggacactgacgcacttcagccatatggttctcaatcttggccacacggtaagagtatctggaggagttctggtgtctggactgcacccagagcaattaaccccgggtccctgggagtggattccgggattgctgtgtttaaaggtcccccaagtgatgctaatgtgcagccagggctgagaaccactgcattagcttccttgatctgcacaacgcctccatgaagagtagggctgggactgcctctctattttatggctgagaggctgaggcctagagagacttgagtggcctccccaaagtggcacagcttgtcaggggctggaacgtgggtctcctgattatctcacccattgtcacatccactatggacctgtgagcttcccgccacgggcaatatgtatgtatagagagaaaggcaggatatcaaggcagaatggagggaggttcagccatgagaacctggtgagtattgacagatgatgtcatcatctacgtggcagaaaagagaagcaatggaaaagctattattttattttattttgcttcagagatggtgtcactctgttgccccagctggaatgcagtgtagtcctgaactcctgggctcaagaaatcctcccacctcagcctcctgagtagctgagactacagccatgtaccacgatgcccagctaatttatttctttattcatgtatttatgtatttatttatttatttattttttgagatggagcctcactctgtggccaggctggaatgcagtggcgtgatcactgcaagctctgcctccctggttcatgccattctcctgccttggcctcccaagtagctgggactacaggcgcccaccaccacgcccggctaatttttgtatttttagtacagacagggtttcaccttgttagccaggatggtctcaatttcctgaccttgtgatccacctgcctcggcctcccaaagtgctgggattacaggcatgagccactgtgcctggcctaattttttatttttagtagacatgaggtctcactgtgctgcccagcctggtcttgaactcctggtctcaagtagtcctcccacctcagcctcccaaaacactgggattacaggtattagctaccacacctggcccaaaaagttattagacccaataagataattcaggaagtccaagaggtcaaaacaagatcaaaatacccaaaccccctaggtttcctacatgctagcaataaccaatcaaaaggatagttgaaaagatcccattcaaattcatcagaaaagtgatagagcatctgggaataaatataacaaatatgcagcaaaaacttgagaaatgattagaaaaaagtcaatattgtattatcaagttgtcagatcttccacccaaattattccagtctcagtaggattcaggaaacttgaaaaagaagttcccaatcttgaatctgagttgcatctagaagaataaatataaaattgctaataatttgttgtgaaaaggatataagtgaagatacgtgggagatacttatagggagatgaatgcagggttggttatgtacattattgtacatttcctaagatcaattaatgtagtatagaagaggtagaagaagggccagaaagatcagtggaacaaaatagaactttatggtacagatggcatttttaatctgtggagaaaggtagattattaagtagtgttgggagaacacatttggaaaataaagacaaacctctacttcacaacataaacaaaaatacagttagattaactatctacatgtagcaattaaaacctaacatgccaggatacaatatacagaacactttaatagtaacctttaattatgggaagagtgagttataaacccagaagtcacaggaaaattttgataaattagactctatgaaaatttaaatctgtatacagcaaaagagatagtaaagaaactaaaagaggctgggcacggtggctcacacttgtaatcccagcactttggagactgaggcaggcaggttgcttgagcccaggagttccacattagcctgggcaacatggtgagaccttatctctacaaataaaaacaaaaattagctgggtgtggtggtgcacacctgtagtcccagctacttgggaggctgaggcaggagaatcgcttgagctcaggaggttgaggctgcagtgagtcgtgatcatgccactgtattccagcctgggtgacagagtgacatcttgcctcaaaaaaaaaaaaaaaaagaaactaaatgggcaaatgatatactgctttttaaaaatgtttacagcatatatgacaaaatattgatatgtattttttaatatataaaggatatcaattggcagcgtacatagggtgaaatacaaatgttcatcttgctcataaagaaatataaatcatagcaacaagatttttcttgcctatcagattgggaaatattaaaaaaaataatgctggccaggcgctgtggctcacacctgtaatcccagcactttaggaggccaaggcgggtggatcatttgagttcagttcgagactagcctgggcaacatggtgaaaccccatctgtattaaaaatacaaaaattaactgggcgtggtggtgcatgcctgtaattctagctactcaggaggctgaggcagaagaatcgcttgaacctaagagagaaatgtagtgagccaagatcactccactgcactccagcctggacgacagagtgagactctgtctcaaaaaaaaaaaaaaaaaaaaaaaaaagaataatgctgtctaatgctgatgaggtggagagaaatgctattgatttggatgataaattggtagattcttttaggagacgaagttttcagtatctattaaaatttaaagtgcccatttccttagatccagtacatgagaatatattgtaaggagctaataggacaagtatacaaagataaatatatggggatattttagataattatttataatggcagaaagttggaaacaatctaaatgtctttcagtaggagattggttcaataaattatggtacatttccttcaatgactgtgcagtcctcagaagagattaggctgatctttaccaattgacgtgaaaagatgatgatattaagtgaaaaaaaaacaggttgctggctgggcatggtggcttatgcctataatcctaacactttgggaggccaaggtaggaggatcgcttgagcctaggagtttgaggctatcctgggtaacaaagtgagacccatctctacaaaaaaaatcaagaaattatctggatgtggtggcacatggtcccagctacactggaggctgaggcaggagaatcacttgagcccaggaggtggagtctccagtgattcatgtttgtgttattgcactccagcctgagcaacacagtgagaccctgtcttaaaaagaaaagaaagagaccgggcgtggtggctcacgcctgtaatcccagcactttgggaggccgaggcgggcagatcacctgaggtcaggagttcgagaccagcctggccaacatggtgaaaccccggctctactaaaaatgctggggtggtggcgggcgcctgtaatcccagctactcaggaggctgaggtaggagaattgcttggacccaggacacagaggttgcagtgagccaagatcgcaccactgcactccagcctgggcgacagagtgagactgtcttaaaaaaaaaaaagaaagaaaagggaggaaggaagagagggaggaagggaggttgctgaagggtgtatgtgacatgatcccatttatgtagatcatattaatattccatatttaaaactatggaaagagattcaccagagattacagagatcgtaatttctagatattaaaattactgggaaccagctgggcatggtggctcacgcctgtaatcccagcactttgggacgtcgaggcaggtggaccacttgaggtcaggagttcaagaccagcctggccaacatggtgaaacccgtctctagtaaaaatacaaaaatgagctggttgtggtggtgggcacctgtaatctcagaaactcaggaggctgaggcaggagaattgcttgagcccaggaggcagaggttgcagtgagccaagattgtgcccctgcactccagcctgggcaacagaatggaactctgtctcaaaaaaatatatatattatagatttataatatatattagattatacattatagatttataatatatattagattatacattatagatttataatatatattagattatacattatagatttataatgtatattagattatacattatagatttataatgtatattagattatacacatatagatttataatgtatattagattatacatattatagatttataatgtatattagattatacatattatagatttataatatatattagattatacatattatagatttataatatatattagattatacatattatagatttataatatatattagattatacatattatagatttataatatatattagattatgttatattatagatttataatatatattagattatgtatgttatagatttataatatatattagattatgtatgttatagatttataatatatattagattatgtatgttatagatttataatagattatgtatgttatagatttataatatatattagattatgtatattataggtttataatatatattagattatgtatattataggtttataatatatattagattatgtatattatcggcttataatatatattagattatgcccattataggtttatcatatatcctagattatgnnnnnnnnnnnnnnnnnnnnataatatatatattagattatatattatacatgtataatatatatattagattatatattatacatgtataatatatattagattatatatattatacatgtataatatatatattagattatatatattatacatgtataatatatatattagattatatatattatacatgtataatatatatattagattatatatataactgggaacctttagttttctttatatcatctgtatttttaaaaaaatcatcaaaataattttaaaagaagtgaaaatcatgtatagtcagaacaaacacggctgggcacagtggctcacacctgtaatcccagcactttgggaggccaaggcaggtggatcacctgagttcaggagtttgagaccagcctggccaacatggtgaaaccctgtctctactaaaaatacaaaaattaattgggcacggtggtacacgcctgaaattccagctacttgggaggctgcagcaggagaattgcttgaacctgggaggcagtggttgcagtgagccgagattgtgccactgcactccaccctcagcaacagagcaaaactccatctcaaaaaaaaaaaaaaaaaaaacctcatatacacacacatccgtatttatctccattgtaggggaagaaaaagaatgggactatcagccgggcatggtggctcacgcctgtaatcccagcactttgggaggccgaggtgggcggatcacctgaggtcgggagttcgagaccagcctgaccaacatggtgaaacctcatctccactaaaaatacaaaattagccaggcgtgatggtgcgtgcctgtaatcccagctactcgggaggctgaggcaggagaatcgcttgaacctgggaggcagagctggtggtgagccaagattccaccattgcactccagcctgggcaacagagcaagactctgtctccaaaaaataaaataaaataaaataaaataaaaagaatgggaatatatgctatgaattctttgtggggtttttttggtgaatatttatggagtgtttgctgtgtagcaggtgttgctctaagcagttttcttatatcaaacacacttaattctccccagcaacctatgagagaggtaatattcccattttacagatgaacaacagagaggttaagtaacttgccaaggccaaacagctcgtgaatagcaaacctgggctagaacccaggtaatgtggctccagaacccctgcttttggtcgttctgctattctatgaggtagtcattatgatccccctcatcagaaagcagaaagcatgagattcagaggggtgcaattacttgtccaaggtcacacagctcatcagggaaggagctggtacccaggcccagatgtgtgggtcacacacccagactccaggccacctcccagatctgaggccgctcctctggagtcaagtctgtgcctgggagaagcaggaaggaccactggacctgctgtcagtggggcaggcacaggctttttccagtcccaggctgccccctactggcagcaggacaaacagcaggtgcctgggcccagctaggataggaagggtgaggatgggcctaagcaggctgacacagggctgagtcctcctctccccgctccagttctctgtggacattgactcggagctggtggaggagctgccggccgaaatcgagctgtggctggtgctggtggccgtgggtgcagggctgctgctgctggggctgatcatcctcctgctgtggaaggttagtagcccagcccactcctgctccgggacctccaccagcacactcaccagcccttcctccaacccacgtctccccatcctggtcctcccttccatctcacccccacccttcctccctgtcctctccaccttctaccaccagcttacagtctcacccctggcctgggttagtggggggagctgcaagctggaaagggggacccaggagctctggcttctgaccacaccaccaagctgggactgagccccagcccccaggctccccagccctaaagccctggtccacgagtgctgctggtgaggatagcccagcgcccccctgatggcccgtccccacctcctcccctccgcagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctgggtaacacggcctccgggcccccttccccgagccccacagctggccgggcctctgactctgtcctatctgctcctcttcccttatgggcctgctctgacctcattctgtccccaccaccaccccaaagatcaggtcactctgactgtccctccagccccctgggtgtctggctttcatcagcctccccctaagccccttggtgacttgggaccccatgagggaggcataaatcctctctgtgatgaccttgctttctggggattggaacaaggtcaagggcaaggccaggccccatctctgtaaaccacagccatgtccagaataattctacactcccatttccacccctagggaaggaggggagcagtagagaccctcctcctgggaactagcctgtttcctcctgagcaacccttccaggataacaaatggacccattcccaacattgtggtcagggtagactgcccagtcttcctggccattccatccactgtctctgcagctgccctcggtctccatctgcctcttcctctgctctctgccttcctcaactccttcttcctctggggcctggggtggagaaactcatcctccgtatctcagtgcagagagatgggatgcgtttcggtcaagagttctggctttgaggagttctgggtgggagagggagaggcctggcactccttcctggtggctcaaactctggatgctaatgttctttctcttctccctccaactccagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtatgcagctgcatctgcttccacccactccccagcctttaccaaccccaggtcaatggatgatgatatcatccagccaacacctaggtaggatgaagccaggtctggggacttgcgggtttgagggtaaagattgatggaggtggccaggtgcagtggctcacacctgtaatcccagcactttgggaggccaaggcatgcagatcacctgaggtcaggagttcaagaccagcctggccaacatggtgaaaccctgtgtctactaaaaatacaaaagttagctgggcgcagtggcgcatgcctataatcccagctacttgggaggctgaagtaggagaatcacttgaacccaggaggcagaggttgcagtgagccgagatcgtgccattgcactccagcctgaacgacagagcaagactctgtctcaaagaaaaataaaaagattgatggaggtgacactggcccctgctctcaggaatcctctcatctaagggtcagtcatagagatccagaacagaagatgaggggtaagccttgggagacctggatgaaacccagaacgccttcttggaggacagcgtgctgaccctggggagggacgagcaggcagaggtggcagtgtgcagggtcgggaagaggtaaaagctactcagctgtaggaacaggcagtcctggcaggctgtggagggaggctgggtgcaagggtggagagaggagagcccttagtcgggctgaattcaggtaagagcctgctttcctgccttggtttccccacaaccaccaccagacgccaataagagatcagaaggtaaaccactgatccaaggctgcagagactgaactgtcacaaggtccagcctccaggagctgagagctctggtctttcagaagctccttgggagtgtttgagcgcctggcttacatggcaacagcacgtggatcaagccttcgctttgcttcctgccatgtcctgggttcccaaagcagcttcctcctttgccctcggtttgtcccctccacacaggcctggggaatggagtaaggctgttccccctgtgacctggaatgtggcctaggtccttctgttaattttccttaaggctgtgaactttggcaagacttcactggaggctggaaattgctacccagagaagcgcagaggtagaagccaggtcagatatgctcagagctcacagacccaggctgttctgggagacccacctgatgcctgggtgcctcccagcctccttgtggtggcagctgcctgccccacctccctccaccagcgctcagctcacaacagggttctgggcccaatgtccgcccctttccctctcctcactttctgtgccgggatttgccccttcccagggtgactgacaatggaatgtccactttcccaaggaaaaccctagcccctacccggagctgccaagctctcagaacccagtgaatggagaccacactttattttctagaatctgggatccagttctttgggcataacatgtgtgggttgtcaaagctcggcccagtcttgtccttacagccacttcctgcttaagacaggggtgttgacacatccctctggccagtttcacagaccccctagtctcctgtgagccactgcttgaggaagaccccccccacacacacacacactcttgaggataggtcattttcagaactagcgtgagctacatattatgaaagaaacataactggcagagatatagcaatgcccactgtaaaagaaccctctgcaatgccaagtttcttgagctccttggagagtccccccccaccaacccacactgtacatatagtgggagatttgggaatcggtgggggtgcagtttacctcggcatcacctaaccaaacttgactatgatgtaccacatcacaccactgctgttagcaccctgcagcaggctctgcagaaagagttcttatccaagcacagagcccacattatggaagtccagcctaaggtgagggtca

SEQ ID NO: 12062 - DNA, 373694 bp, Human
  misc_feature (1)...(373694): n = A,T,C or G
cactgcaagctcgacccctcagcttcaagcgattctcctgcctcagcctcccaagtagctggaattacaggcatgtgccaccatgcttggctaattttttgtatttttagtagaaacaaggtttcactgtgttggccaggctggtcttgaactcctgacctcaatccacccacctcagcctccccaaagtgctgtgattacaggagtgagccactgcgcccagccagttcattctttcaacaatgtttaagcatctacctaagcctggcactgagctgggccttgggggctacaaagatatctaagacttttttctccttagagagctataccgtctatggagagggacagagagcccccaaaatgatgaacatgttctaagtgttgagatagaggcatgtgaacactctttggcagcccagaaaagaaaggggaagaggaaatggcacagaaagggtgaggcaagaactggcctggaagtctaggatggataggattttgccagttgaagaggggtaggcacatttcaggaagaaagaacagcgttggagaaggcacagatgtgtgtgaaaacccctgttggacacgttcaggggacagctagaagttgtgtgtggatacattgtagggtttgtgggaagtgagtcaggaaaggggcataaaatggggctggaaagagagatggagcctccatgtgaagttatgctaaggagatcgggctccatcctataggcaggagtaggtggtggggggcaacgggaagttttcaaccattatccaaactctgttgtagaattaaaaagtggaaagaagagaacacaggcagggaaaccataatagtgtggtcagacttcaacatgatagcagtcaattcagtaggaatcttgaatttgagtagtcaagttcatagagacagaaggtaggaaggtggttgccagaggctgggggtggggatgggggtagggttagggggaaagaggagttattgtttagggtataaagtttgttttccaagatgaagagttgtggagatggatggtggtgaaggttgcataacatgcatatacttaatcccccgaactgcacagttacaaatggttaagatggtaaactttctgttatgcatatttacaattacacacacacacacacacacacccttcagtgcacgcaaaccctgctggactccaaccttcagagcttccgatttagcagggctgagtgggacctgaggatttgcattttctgacaagttcccagatgacgttgatgctgctggtccggagaccacacttcgggaatcactggtgtacgagaccaagtgactagaatatggaggggtgctctgctcgcttccacgtggctactattgttatgaacaacaacagccggcgtttactgagcactgctcctacagcttatctcacaactgggtgaaggagcagaggatgcgcagggctagaacctggagtctaaactcgtccttcacccgggttgctctggatcttactggttgtgagacagggagggaaagagagacaaaggcagggagacaggcccagcagggccggcagagcctgtagtgacggaggggagcagccttatctccgggaacccgagcgccccgtgcgcggcggggagggggcagttcggggcgccccggcgggtcccaggggctgactcccgcccgggaagtgcgcgcagggctcacggcccgcagggggcgctgccgcgccgtccagccgccgccgcccgggccgcccacctcgcgggcgcgcccctccgcagaccagcgccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttccggtctcttccacgccgccgtcccgagggggcgatttaaatgtctccgttgcgcgcggctcggccgccgggggacggcgggagaagggaggacgccgtccggggcccgctaaggtcggggtcggcgcctggaggcgggcgggggcgtccgggtgcctccctggggtcccagcccagagcgtggggggagagccgctagagttgtctcctccgccgcccagctagactcggcttcactctctgaatcgaaaagtaacttggctcctctgcctccgggcggccgccgctggcccagcgagcctcctgaacctcgcagggcctggaggagtcggggcactggagctgcacccctccccggttttggggaacccctgaggaaggagtatagcctctccagcgccgctgcgcggggtggggctccccaggggcagggtgtctgggatccactggggcgcactggagcccagagccccggcgcccccccccccccccagctcctacaagaccctgggtggaagtggagcggagaagctcctaggatatagggaagaggaaggtgagggagcacttcccagtgacaccgccggtggggcaggtagttatctcttgggagagcctgagtctcatctcatatgggccattcgacccggagaccttcaccagaagccttaagagagagacgtgtttctatagtggccaaggggtccagttgtcccctgagtccggaggggtgggcctaagaagggggcagctctcccccattaagcaccataagccgagtggtacagagcttgtgcccaaccccagcagagaagcactaagggggggttggtgccctccttggccacatcctctggaccagagggtataaacagccacacagtggtcacttcttgataggagagagagttaggctgcgggaagttcccccgttcaaggtcgtgcctcatgggggcccaggtgacagccaggccggggttgattttattgtgtattcaccagcctgagcgtccttaggggtggcaggcagggaggtcgaggtcactgatgctggtgctctcagcatgtagttatgcaggagagtcactgctctgtattggacagaggctgatggaaaagggtggtttgtggatcgcagtactcaagcattcctggaaaaggggactctgagaccagcccactaagaatcatgctgttcaggagatcagccttcaagagaaccagttttcaaagccctcacatagctctcgcccagctccacatctccctctctcacttactccagttgctgggtataagaccgagtgtgtctgttcttaacacttgtcaaattccccttttaaagcggagcaggctgaacatttttctgtgtcctgcagactcagggtctgaggttgaagaacacatcccagatccccacactaggcaccaggcacgcgggaagcactgtcaaaaatgggagggctgctgtggacagcgggctgctgagaaagggcgggcagctgagcaggcagccaagccagccggagcattgtgtgtgatctgcaggctgaggctggctcaactgccttggagctctttgacagctagagggagagaggccaggccactgtcactgtggatttgcatgggccacaggtcaaagccacactgcctgggaaaggaatgggtagagacgagagcagatctgacagagaaaaggtgttcagcctactttgatttaaaacggggatgaagaaaagctgtgtgacatgagcagatttggccagtgtgggaaaagacagtctggccttcagcttggtacccagggtaaatggtagggagtgggtgtggagcagtaatgctgtgcatattcttgttgccagttgagatgtgggactggtatttcaggggtccatgggaacccatgtgtctgggctgctgagctcaaaagtgccctctcttgttctgatacaagctggctactctttgtattggagtgcttgtccccatagctgttcaggcaccaacttaactctactgaaatctttttaaaataatgcttctttttcctccctcacccaccatattgacttaattttttcttagattgtgttctccccttgatttctgttctcatgctgttgttttcaagtattttcctccccatccttttttctctttccctttttcccagtattctttgtcttagaccttgaatgtattttttgctgtatgtatgcttgaatgtgttttttacccaggcttggtaaactatggcctttggagcaagtgacttccaacatcttctttctcctttttctttcctctagaggctagacttattgtgcaaggctgctgaaacttaagccaaaggattcttgcttgcataggcccctattaatgccttgtccccaattttataattttatgttaattttcttaaagttagtcaccctaaatttgtaagatcaggtcctgtgaattctggatctgtcctaagtctgtaccttaacttcaactgtggggttggttgattgacttggtaactgattgttggtcgcttactcctaagcagtacctgagccctggatcttctagtcctgcttgagggacatgtcagtcattttcaattattcgtgattgcaaacagcagcaggggtaaacaacctttaacgaaacccttgaggacaatcttaattatttcctttgaataaattcctgggcttagaattgctgggtcagagaggatggaagcttcaaggcattctttatgtattaccaaagtgccagtgaagtgtgtgtactttagaaaaatacattaatttattcagacactggaggcttgggagtagttttgcaaagggctgctctagtgcactgaaagagtatagaacctacatgggggtgacttaaaaggatcacaaatactcgtcaaaatgagtgaggaaggtaaaatatagacatgaaagggaaaagcagtatagcaaaactttgaaaggaaaagaagacatgttaattaagccttgtatcttacgtctctcttctcgaagaaattattctttgttacttaattcaatattttgcagtctaagatatttgcttcatgctaattaactacctgttttacaggtgaaaagatgtgttgtctctagggaaagggagggagaagaatgtgctggaagtggtagggggagagcacagaccccaaagtcagcacggactctgcaggcggcagagtagagcgttcccatgttgagggacctgcgggtgtacatctcaaagcatgtgaatgtgctctgttggtggaactagcacttctctaatcccataactgagcatttctctcaattattttgtagaccaaaattgtcactaatcggaggatcctagatccctgtgtaagtgtgggggtgatcttgcttttcccagccctggtgactgaacccagctctgtagccatatcacactgagcacagagccccagacccagcttctctcagagtacttgcttgagtggtcccgctgtcactgtgctctgggcagtgagaactgtccccatggctagatggaccagaatatcctggacaatgttccagatgacgtttgtatcagctaggatacaaacatgcaagggactcaattttctttttttctaataacacccagagtgtctgcctgcccagagccagcttcctctcctatagctcccactccctgagtcttctggcgtcctttgaacaacaacagtaagtgccagggaacatggacaaagccgatttctgtccccttcctttagacatggaccggttactcagctgcagggctgacaactgtaacaccctgtgatataaataaatgctgcctggctggcgtgcagcctccagagcggacgtctttcacaccccaccccgtcccctcctccttctctgccccagacgccctggagtccaaagtggttgggtgcactggcttcctttctggagacgtgcttcctgctccctctcctgggacacatcaagacggctgtgcttaggcacagagcgagtgctcggaaatggaagatgtgctgggctttttgctttgttaaagttgtcagagtgttgttcagtgaggaataggaggcaattccaagccaaggagaacatatccttgatttgcatgaaggttgagaattaaaagaacaagctagatagttctggtgagctgtctgatgtagtcaccactagccagatatattggtatgtaaattaactaaaaataaaatttaaaatgcagcttctcagttgcacttgccacatttcaagtactcagtagccacatggggctagtagctactgcattggacacaacacagagagaacattttcatcatcacggaaagttctactgggcagtgtgggtttagagcaatgatgtaagtcttaaagggctagacaaggatcaaaaggagaggtaagaaaaagaaaaagaaaaaaaatcaacccatagcatatgtgagtactaaaaccgaaacgggtgcttacatctaactaaaaattattgcctgctgaagaggttgaattgtctttctactcataaaacaccgcagggcctgatctatatttagggctgggggttcaacaatgaaaactttttgctcacaatctgacaggtgagaaaattgtggggttctagttgtgtgtctcaaatgaaatttaagatctaggctctgatgggggagaggcttgtcctcaggcaggcatgagttgttcagaggggcagaagagaaactcctgtgaagggaaaacatttagaaggggagccctgggatcataggacctgctgcccctggccctgcccgtcttgctgaggaaacacccagaaatggtggtgggagccctgccttctcataacctcagtggtgagcatctttgcagagttcctctgtcctgtgccagactctaggggaaggtgtaggtccgcttcctcatttgaatttttctagggaaatggcattttcagacattgttcctggtcctcactcaccctacagagcctgctttctcaagctctcaagaaggaacaacacatatatgaggcctgagttccaaggggatccaaaaagcatcttctcggggtttctgggaaatttctctgaagatctggagaagctggcaagggtgctgttttctgagctagtgctgaatgctggctgggggcagagacagctgtcttgcccagtggagaaccttccagggcaagaagacagtcttgtctcaaccagtcattaacggccctgagtgtgagagtgtgaagggccgggccccagccagctctgattccctggtgacatgctgctgttcaggaaatggtctcctgataacttctattgtgatttgttcagggaaaatgttgtttttacatttgttaaaagcagccatggtgttctctgaaattccttgctttcaaggggttgcatggaattttaacaaccaaaatgaatttcgtcagatagtatctacaagaagtcagatgctttcacaggcataatattctttagttgagtctttgtaacatcctggtgagtggtttccagtttgctatttggggaactgaggcttacagagttacacgccttgttcaaggcccaccccagcctgagagatcaatgcacattcactgggggcttgtgtcagtttgcatcctttaggaagcagatgctaggacagagataggagtgtgagagaattgttgggggcgggtattgcctgtgaaagacaaatggggaagttggatgggacagagagagcctctgactctatgcagatctgattaaagtctcagtcaactcaacagagatcactgggcagaaatagctgtcctctgccagggtcaggtattggctggagctgtctgggaagagcacagcctcagctggaatcctgcagcagatcccaagaaagctgcagctggaggctgtcagctgacattccgccttgcagctgaacagcatgaagtgacccacacctctgtggctgccctggagcctgccacgcgtgaatcactgtgttgggagggtgtgagatgtgctccttggcctgcagtgtggctggggatcatctttgctcatacctctgtaatcagtgtgtggagcgtcaggactgacagtagggccattgggactggcccagaaacagaatcctgagcaatcttgccaccagctgactcacaaggtgcctctttctgatgtcagagaagtcacaggtgatggatttcagaagaaaggagctctgctttacgctgagccaccgagttctctgaactgcaaatccttttagccaagtggatttggcgatcaaccaaagcagaataaaatgttttatcccaaccttcctttttgccagaaggagtcctaggaagccgatgtaagtccaagattgggaaaaatctacagtctttgaaaccacgggctcacttggtccaccaatgtctgttctgaccaaaaaggacttctgtgttgagtttaaattagcaacagtagcaacaataacaccaaaagcagcaacaatgtatctgaatattcagtagatgtcaagtgctatctacattggtactcataccagctcatttaatgttcccaacagtcctttcagctggtagccatttgggctgccataacaaactgttataggttgggttgcttataaatgacagaatttatttctcacagatctagagccttggaagtccaagatcagggccccagcagatttgctgtctggtaagcacctgtttcttggttcatagatagtggtgttctcactctaagctcacacagtgaaagggatgagggagctctctggggccacatttataagggcactaactcattcataggttatatcctcatgacctaatcacctcccaaagtccccacctccaaataacattaccttggggtgaagatttcaacatatacattttgagggaacacaagcattcagtctgtagcagctggctatcattttatccccattcatggaggggaagctgaggtacagaggcattattgcccaagttacatggctaatgagttgtcgagcacaggcctgtgcctttgcccacccaggctgactgcctgtcaggaagtcaagaatccgagtttgggggcttcagggcgctcaaacatctgtcttgtgaagttctgttctgcctgctttcctggaaaagttattgaattgcaatagcagtagcttctctgcggcaccctttggggatgcttattcatgacccactggctactcttggggggatgctagggttctgttttctggagatgtttgatcactgagtgaacagggacccaatgattctgccagggacatttgaagggcctcttctcacaccaaggctgtctagcattaagacagaagtgtcccaggaaagatggagtactctgcaatattccatgtatccctctaacctcctggggctgctttgttactatccccccatccactctgagttctactggctcccaccacttatttaggaatctctgaattggggaaggtagccatggtggccagtgtttcagaatcactcctgggtttgtaactttattaaagaaacccacacagagtcaaacttctgcaccagtgaccaacaatatgtgagaggatgatttgtatcctcaaatatttgaacacttaataaaaggcatgaatgggtacaaaaaattagaaagaatgagtaagaatgagtaagaactagtatttgatagcacaacaaaatgacaatagtcaacaataatttgattgtagtttaaaaataactaaaagagtataattgaatcacttgtaacataaaggataaacgcttcaggtgatggataccccatttaccctgctgtggttattacatattacatgcctgtaacaaaatatctcatgtacctcataaatatgtacctactgtgtgcccaaatcttttttttttttttttttttgagatggagtcttgctctgtcacccaggctggagtgcagtggtgcgatctcggctcactgcgagctccaccttctgggttcacgccattctcctgcctcagcctcccgagtagctgggactacaggtgccccccaccacacccggctaattttttgtatttttagtagagagtgggtttcactgtgttgggcagaatagtctcgatctcctgacctcgtgatctgcccactttggcctcccgaagtgctgggattacaggcgtgagccaccgcacccggactatgtgcccaaatttttaagaaaaataaaaaatcacggaacaaatttcctccatcttagctgatctgttggtgtgttaaggccacctgggagatggcctttcctaccccttcctatctagtgtccaagtgctgtgatgtatgtggatcccagagtaaacttggtgttgtgcagtacacaccagtaggcagcattgcagagggtcttggcacctcttttgcaccaggatgggtcctagagggtggatgttccagattcagctgagtagtgttcctgtctctaccttcattgaatccctggttccacagcaacaaccagatccacgatttttgtgccataaaagggggcactgctgagatgcacaagtgcctggtggccaagagagtgggctccagcattagccctgccctcagcctgccttactcagctctctgcttaggagctgtgtgatcttgaccaattacttcagctgtttgaacctcagtttccttttctgtaaagagtaataagggtacatccctcattaggttggtgggggcattaaatgagatgatatctgcaaagcccagagcacaacacggcacacagtaagcccttgatagatgctcgtagttatttctcttgttacttgatctgatttatgaaaccaatggtctttttcatcctgacttgagatgctgagttttctttcagtatttttgttgattcattcatttattcatcagactttgagtgttgacactcaacactgaaatgaatgagatattctaacatagacacactcttcattatgtgtggcctctaacatttttgttatgctctacataaatctgcatttttgtgcattcatttacaccctgtctgcttccaaaaaggatctgagatggctactttaaatggagatctttgggattgtaaatcctagaattttgcctgcctgtttcttctctgtgctcttggaaagccaaggagcagatgggaggccacccttgttatggggagctccagctcccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgcccccgtgcctctgcttttcccagttgggcatggactccaccaatttcattctctgacttagcgttatgtggtgtggattgtactgctctccctccatttactgtaacctaggctctccaggataaaaattattattgccaaccttttatgaatactttctatatgccagaaccactgtgttcatagttccctttatgcagagcaggctaccactcccgaagcacagagaagccaagtcacttgtccaaggttacccagcaagtaagtaaattacagagttgtgctttgaaccaaggtgggactgatttaatgctaaactgactgttctcagggttagccatgctaccctccctacctccacctccatcaaggccctgtccaaggtatcaggtttctaaggaaaaaggagaagggccctgaaaggaaaagggcttcttcggagggcatttgtgtctgctcttggccttgcagataaaataccataatctactcttgcaaatcaggccatcctggggtgcatggtcccccaaacactttcatctgccttttccttttgtgcctcatcactgccttgggagggggatcatgcatttgttattatccttgttttacagaaaaggaaaggaagggtcagagtggccaggggacttgtctaaagtcacatagctgtagctggcacactcctgggtgtgacttcggatacactctttagggcctattctactactccaccatgcctgtcccatctcagggccttcagtaaaagtctgtggtcctggttggtgatgagattcctttgagggagggaaaggagaccaggtagctagaggagccatagcaatagttgtcagctgcatagttggataattggtttggacttagcgggaattagtgggcgatggaattaccacggtccagattccgtcagaagtggcatgccttagcttgatgacgtatctgttttctatcaccacaatattgctgcatccctaacaaaccaccccaaaacttagtggcttaaatcaaccaccacctgtagcttattctctggttggcagcttaggttgggttcagctgggtggttcttctgttctctccaggactcactcatgcatctgtggtcaacttctgggttagctggttggctggctggcaaaggatggcttcagctgggagggcttatttttgctccatatgtatttcatcctcttgcaggctagcctgggcttgtacacatggtggttgggtagggtaccaacagaacaatcagaggcttgcatgatttcttgaagcctaagctcagaagtcaaaccatgcccctctgccacattcttttggccaatgtaagtcacaggtccagactacatcaagaggaggcagaaacacatttcatctcttgacaagagaagctgcaaagtcacactgaaaagagcagggatacaggaaggatggggaattgtggccactttgtaatatattactggtggtgaaagcatcctggctgtccctgaattactgtgacagtctgaataaattcctgcccagcgcaccagaaaagggaacaaggttctattaacctaaatagcaaacacagagagaggctctctaaaagaaaatgtttactcaggaatagggcattgcagtgggaatacatgtgtcacagtaatctgcatgaatattcagggaggtaaaggaaaacaaaggcttttaaaggaaaaatgaggattacttaattgttttgagataattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttgaacacctactttgtagcaggcactatgatgggtgttttataaacattcttttgcttaaaccttacaagaaaccttcttaggtacacttttattcctcctgttttacagaagaggaaaactgaggcttggagtgtttaagacacttgtctaagagacacagcttgtcagcagtagaggcaggacttaaaccctatgttactgcctgtgcttcttacactttatcaccatgcataactttcccataaagcttagaagccaggtagaactactggcttaaaaccctagaaagcagtcagtatccactgcttaaataccaggagcctcagtttccccaaatataagaagagcttatgaggcctttcaggtcccatggctccattgggcaagcattggtccctagtgagtcccctccctctggaaatgaagggtttggtgtggtcagaggtggctatcctggcaccagctcttcctttactcaagcctgggctgctttctgcccagtaagggatgcggacaattcctggggtttccccgtggtggacacacagtgaagaatttgactcatgtaaccaaaacgtgggtccctggggaagctttggctttgggatcaaatgctgaaagcaaacctaatgggtttaaagtttttaatccccagttgctgtccttgatctggctataattttgcctgtggaatcgctgctgtggtgtttgtggggagggagggaatctttgagacactgtcagttctcagtcctgcccagggaggcagctgcggctcagtccttctctgtcacccgctctccagagaatttacctgcagattaccctcaaaacatgagacaggttcagagcgaggtgggcggctggaatggagccttcacagacagcttgaccacacacagggagctcaggaagcagctttgttggaaaaatgcagggcacttaaactgccacaccaggagggggtttggagaggctggaaagagcatgccattggacacagacactctgggttcaaatcccagctctgccacttactggtggtgtgacccaacatctctgaatggaaaacacatgagaggctgcctgacaggatggccatgagcaagaaagcacccttgtgagcataaccagtgttggtgcatgaaccgatgcacccacactgcttattaagagaggcaaacctctggttaacaccatgacagcagtgtcaatgctttggaaaagcaaggtgattgaagttcaccttttgagtcacctgagcctgatggggaggggaaggtcttttctcttccaaaccccagcatgccctttgacatgacggagctttcacatcagagttctcacttcagagctgccctcaaaggctcactggggcttgctcaggtggggattacatatgtgagtagctggcaccagagggggcactgggtacctgttggttcccttttcctcctttcaggctgatgtggggtgggtagaatagggcacgggtgatgtatttgactactggggtgcgtgctacagcttggcatcttaacatgaataaccatcttaacctcctctggccacctgcttccctatctgtaaaatggggataatattagtacctcccgtagggttgctgtgaagagtaaatttgatcctgcccgcaatgagcctaacccagcacctgcacactctacgtgcctgctacatgctggttgccctaattagaagtttagagtcctgcattgatgagaggacctaaaaggcttatgaggccaggcatagtggctcaggcttgtaatcccaacactttgggaggctgaggcaggtggatcacctgaggtcagaagttcaagaccggccttaccaatatggtgaaaccccatctctactaaaaatataaaaattagcggggcgtggtggcgtgtgcctgtagtacccagctactagggaggctgagacaagagaattgcttgaacccgggaggtggaggttgcagtgagcggagatcgccgcactgcactccagcctgggtaacagagcaagacaccatctcaaaaaaaaaaaaaaaaaaaaaaaaaaaaaaaagggcctttgagtttgtggcatctttaactggggatgggataggaggagagagccttgcttctcaagggcaatctcttctactggctccaaatgaacataattatttgtaatcagtttagatagttacatagtacttcttaaactatcaatcacctggagagcttgttaaaatgcattctgatttaatgggctggggcctaagattctgcatttccgacaagtgccaggtgttccccatgctgctggtctgaggaccacacttgaagtagcaagcaaagcagagaagtagcttgatgctttgttgatggcagcctgttggtggggacactcaggcccttttatgtggtaaccatagcagaaaggaacatagtcttgttgagagtaccaggagagttggggcgatgtttgaagtggctaggatgtctttttataacttagcagatggcatcttttcagtggcttgttctgaactctgggccatggtaatctctgtatcccttgggatcagcctggtaaacagccagctgaattaacttcagaaaagacccactcatgggctggcctgcggtagtcttgctggatggtggcctaggtacagagcagtgctgggctgcggaggaagccacgatgttctgtaaacacatagatacaagcacattcccgcgtgccacctcgtgagtgtcatgcatgtgtgtgcatgcccccttatctctagcctgattttccattgcacaggatttgggaaaaacctttcatctgaccagctgatcagaagttttgaactgaaaggttgttatcagggtttgaatcagctattgttgttagaaccattgagtaccttgggcttggaaggaaataataattcagcaggttcctttccactttagattttggtgtaaactttgtccctgtcagtcttggctctaggctggaggaagcagtgcctgggaataagctctccagggtcccctcctgcttagataacctatgaatctgtgtctgtgaatttggagccatggcattatctgaaatttccagggttccaatgccagtttgggagacacagtggaggaagaacctgttgtttcttgcagccttttcccttccctcggacgtgatgaattctcactcttgtgaatttttttgtgatttttgtaaaataaattacaagtggcaattagtcactgtgctgatgtaaatttggagttggtgggaatttttggactctgctgtgtggccctggggtttttgagtggaagaggtattttatgctccccaggtcttagaacctgacctgtggaaaggctgaggatgtttcagcagtttagacagggcaaactgctaattcttctcacctgtgaaaacagctggtcttatgaagcgcaatatgtgacttaccccagtggctctaaagctcagccgctacagcaagggggaaaattgatcccttaatgtggctttcttctcactggagttttgttttgtacgtcattgtgcatttgagttacagcagacaagggccagccaaactgctcttgtgtgggtgagggaggcaatgtgatctgtttgggaaagtgcttgctttgatttccaaagggctgtgggttccagccctgcttctgcttgggaattctgcagttgtgcccagcaaacacctggggaggtgcatcccagggcattattgaggagccgcagggcagcctgggtacctgcaccattgggagtcttgcttctctcactccccagcagggcatcttcctcatggaatcagatacagaccctccaagactgacctggaaggagacactccagtgaggggtgggtctccctggctctttgtaccctccaattcttcaggttctaggtgttgagctcagggcagtgggaattaagatgggacccacacacattcccatgaaccttaacaccatgtctctgagccaggttagtgacgatgtcctttgtgatatctgccagcctttgctggagtcccctttgagggcctcagacttctgttgtatgatgtagaggccttgtttgtctgcccctttgcctagctggagtgttgcaggaggagcagcagcattccaagaccagggtgcagtgaatgactgagatcccaagatgaaggtggctttcagggcagagggaagggagcctgggtcagctttctacatccccaggaaagctgtccagggtcatcctaacctctgctaaacaccttttccacaaatacataatatgtaatgcactctattccaaggcatgtgggagatgatctatttcatgatacagaagaaacccttgtgaggtgaattccctctcttttctaggctgctggagataaggaacaacgcctgttctcactaagaagtggcttggcattttctactctttgaacatcagtgtggattttgtttgaagtctcattgtccaagaccttttccaaatggctcgtagctcagcacaaaccgtgcctgattagtgttgtttggtattctttgctatagatcttctgttgactgctttccggaaacaatgcataaaactgtaggtcagaattatttttgtaacatctggaggggagcttactgccatttcccccgtgttctgcactcacacaggcccaaacctgcctcttctgtcttctgggtgggtcttgcccctttcctgtagccgggggatgctcctgctggggatggcccaccctaggcagcttttcagttcaagatggaggatacagaggttcattcttgctcctgtttgcatgcaaactgttctatttctgttttgcagtgggagagaggatacggtttataattccgcactgctgctattttttttcctatttgcccctaaatgtccatgctgtgtgtgtggtgggtggtaggaggaggagagggagacagaagagaaatagcgtttctaaattttctatttgttactgaaatgtaacacatccaggaaagtgtccatatcatatacagttatcacaaatttgtataatgtcactgaggttgaatgacaacattatccgcacccccagcaattcccctccctaattgcaaccctgctttctcctctccagaggtaaccattatcctgccttctaacactatagttaaatttcacctgcttttgaactttagataaatggaatcagactgtgagtatgctattgtatctggcatcttttgttcagtattgtatttgtgcagttcatctctgtggttgcagttgaatgctgttcatttgttttcattgctgcatagaactctttttttgttttgttttgtttttgagacagagtctcactctgttgcccagactggagtgcagtggcatgatctcagctcactgtaacctctgcctcttgggttcaagcgattctcctgcctcagcctctcaagcagctgggattacaggcacctgccaccatgcccagctaattttttgtatttttagtagagacagggtttcaccatgttgcccagactggtcttgaactcctaagctcaggcagtctgcccacctcggcctcccagtgctgcatagaattctgttgtattgctgtaccatgatttacctgtccactctagcactgatgggcctttaggtttcttcttgtttttttttttttttttttgatattacatatgcagctttgaacattttgcatgtctcctggtagaaatgtatgcatctctattaggtatagtcctagaaatggaattactgggtcaaagggtaggtgcatgttcagctttattaggaactgttgaatagttttcccagtggttttaatggtttatactgccactagcagtgtatgaaggttctagttactctatatccttgccagcacttgggattttcagtctttttggtttgagccttctggttggtatgaagttgagtttctctgataactaacatagttgagcaccttttcatgcatttattggccatttggctatcttcttttgtgaagtatctatgcttgtctttggcctattctgttgacttgtcttttcttattaatcaatgaggagtttttaaaatagattttggataggaaccttttgttggttgtacgtgttcccacccatccattcgcagtctcctgggtaggtgggactaaaagcgtgcgctgccttgcctggccatttttttttgtgaagatgggatttgccatgtcacccaggctggcctggaattcctgggctcaagcgatccacccgcctcggcctctcaaaatgctaggattacaggcatgagccaccacattcagcctccttaagctttaatatgcctgggaaagatctaacaggtttcactttaggacctctcccccaagcccacacagaaaagtataataatatgattttcaaagtgagcactcagagagcccacccgtggttgggtgaatacttagccatctgcctcctattttcttatcgtaggttgtgacagaatgcctttttctcttgctgcagggtccttgtgggcgcaccaaaggcagattccaaatacagcccttcagtgaagtctcctggggctgtgtttaagtgccgtgttcacaccaaccctgaccggagatgcaccgaactggacatggctcgaggtgggtgaccattactgctgtggtggaaatgggttctgtacccttataccttgctcttcttcttcccaggatggcctgatcattcactcacccatccatccttccctccttccctccctccttctctccaacaagcatgtattgagtacgtaatagttattaagcactgggatacaccagtgaacaaaaaaaacaaggatgctgccatccctagtcccataaattagtgggcaaaagagatattaagacaagtaattgagagagaaaagaccagagggaaggtgagtatttgatttaatctagataggagggtcaagaaaggtctgggacctttcgacatgattagaaggatgcgtagtcgttagctgggcaggtgcaggaagcacagccttcaagcagaggtgccatttggaagcacagagcgaggttgtgcagctggagagggagccaggagagtggagcacaggagggcagcaaggcaggctggggccaggccacgtggggcctagcaggccagggcaatgtgctggaattttattctgtgtgtgagtggggaggccactgaaatcaattttgggtattacattttaactagggaaagatatgatcagatggatgtttttaaaagctcactttgcgctgggcatggtggctcatgactgtaatcccatcactttgggaggctgaggtgggcacattgcttgagcccagaagttcaagaccagcctgtgcaacatggtgaaagcctatctctactaaaaatacaaatattagctgaacgtggtgatgcatgcctgtagtcccagctactcaggaggccgaggcaggaggatcacttgaacccaggaggtcaagggtgcagtgagctgagattgtgccactgcactccagcctgggtgacagaactgagactcttgtctccaaaaagataaaaaaataaaataaaagctcactttgatctagcagaaaatataagatctttggaatcagatggttctgactgcattcaaagcccagctgggactgattgggaatgtcctatagcttcttgggcctcagttccctcaccttcaagatcaagactaatatacctacctcgcaaggatggtcttgagaagattaagtgagataatacaggtgagtacacagaactgtgcttggcacatcagtacaaaggaggtattttgttataatcatgactgcaagcatttctttctccaaagtctttttgcataaagattttctaatttttttgttgttttttgtttgtttgtttgtttttgagacagagtcttgctgtgtcacccaggctagagtgcaatggtacaatctctgctcactgcaacctctgcctcccaggttcaagcgattctcctgcctcagcctcccgagtagctgggattacagtgtatgaccatcttcggctaatttttgtgtttttagtggagacggggtttcgccatgttggccaggctggtctcgaacttctggcctcaagtgaaccgcccacctcagcctcccaaagtgctgggattacaggtgtgagccaccatgcctggccaagatcttctaattattttttaaataaagagttattgtgattttctttagcagaaaaagaggtttgtgaactgtttgttactggtgcataacaaattaaggagcttacttcagaacataaatcaaggccctgcctctttccatgagaaagtcttgccatgtggttgggtgcagtggcttatgcctataaccccagcacttcgggaggttggggtgggcggatcacttgaggttaggagtttgagaccagcctggacaacatggtgaaaacccatctctgctaaaaatatgaacattagtgggatgtggtggcgcacacctgtaatcccagctacttgggaggctgaggcagggcaatcgcttgaacctgggaggcagaggttgcaatgagctgagatcgtgccactgcactccagcctggacgacagagagagactgtctcaaaaaaaaaaaaaaaaaaaaaaaaagaaagaaaaagaaagccttgctatgtaaaaaaacagttgtctggattaaacagtatagtacatagtgatggagttgatttacattttgtggaaagttccttatttcctcatagggctgtggaccaccctttgaaagcagccagcagaacatcactcctcaacccaagtctggctcttctcctctttctccagggaagaatcggggcacgtcctgcggaaagacctgccgggaagaccgcgatgatgagtggatgggggtgagcctggcccgacagcccaaggctgatggccgtgtgttggtaagtccctcctgggggtgctgtgggaagggggtggcactctgagaatgaatgatctgttaggaaggctggatggcatggtgacaagtgcatggctttgaggttgcttattctggactactgcttagacaaatgacttatcttcttattttctttatctgtcaaatgtgaataatgtctgtcccaaggtgctgagatgtgactattgaaaaataaaacatatgtgaaaagtgctttgtacatctcattcattacataggtatttgtgtgtgtgtgtcttaaattgaggtataatttacagtacacaaatcttaagattacagtcttgattttcacaattgtacacacctgtgtaaccatatgcccactgagatatagaatatttccatcgtcccaaaagtctccgatgtccctttccagccaactcctctcacctgagacaaaccacagctgtgatttgtataatacattacttttgctttttctagaatttcatataaatggaatcctacagtatgtgctcttttatataagacttctttcactcaaaataatattttctgaaattaatccccattgtatgtatcagtagttcattcctgtttatctctacataatattacattttatgaaataaatgttatttttaactagttatttatcggacctccaaagcacctatgctgtattttgatccgtaggtgctttgagggagatagaaagaaaagtctttgcatttgagactcctgagatcctggagttgtgctgtgcagtaaggtggccaccagccctgtgtccttatttaaacttaaatttatccaaattaaactagaaattcaggtttttagtcatattagccacatttaagtggctcaataatcacaaatggttactggctactctattggaaagcagagagagagaatattttcatcatcacagaaagttttattagactcaacacgaaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaaggacccctgcaccctttcccagtcagttcctctgcccttggtgagtgaacaactgttctgacataggctttctcttgcccttgacttttatcagaagctgtacgaagatttttgttataaaagcgtaagctcaagaggggaaagtaatactagctgccgcttatggagggcttcatttgggtcacatgctgcaaagctgagggtttcgtgtgtattttatcccagggaaacaggttttccttaaggcactaggcaaagtgtttttgtcccctctctaaggagcccacttttgtgttaaacttcttcatggcataagctgttaatctgaattccgtcctcagcacaattaagcatctcccccttgtcgggccccttgggagaggaggaagcagctggatgctgtcgccagcatggtgggggcctccctcctggaagccgttgtaggtcctgcacaggctccctgagcccgctgtttgccttggtttccagtcctttcatcactgtcatggctggccctggaccctctccaaacttccacattcctccaggcatggtggcctgaccctgactggacaaatgggccccagaggggctgaacccttgtctgccattctggggaaagaaagggaagaagctgactcatctgtaaatcaaagggtagcccaaggtcctgattcagaacaaaaaggaggtggtggccccgtggcagcataacacaagatgctcttaagggcatcgagcctagagtcagagtttgctcctgtgaaaatatttcctctctgcaaggaaggataacctctctgtggctgagggcttgtttccagaggggcaagacagaattctgtgttaccacagatcagtatcacaaaggagtcatttctggggacagtgaacagcaatgaggaccacagggaagatttagcaaagggagccaagaaggcagcactagagcatttgtggataatggtgccatggatagtcctgtctaattaattgcatgcaggactatttttttaatgttttatgaagttattgcatcatccactcagtaagccactgtatatgggtgctgggcaaagaggagcatctgacaccatctgctttccttgtgccttttgtttgtttttctaattgtggccaaacacatgacataaaacttaccaccttaaccattttgagtgtacagtagtggtaaatgtatggcacattgttgtacaacaaacctttaaactttatcttgcaaaacttacatccattgaacaacactctcctttttctccttcccgtggttcctggcaacattgtatttctattaagagtttgactactttagatcttatgtgagtggagtgtggtgttcgtccttttgtgacgaacttacttcatttagcataatgtcctcaaggttcatcatgttgtagcatgtgaccggatctccttcctttttaaaggcagaataatatttcattgtatgaattcaccatgttttctttattcatctattgacggacatttaggttggttctatctcctggctgccgtgatgaatgctgctataaatgtgtaccaatatctctttgagatcttgttttcagttctttggggtatacacccggaagtgggattactggatcaaatggtacttctatttttaatttttaagaaacctccatactattttcccaaatggctgcagcattttaagttctcaccaacagtgcacaagggtttcaatggctccacgtccttgccaacatttattgttttcctttttttttttaaatagtggccctcctaatgggtgtgagataatattttattgtgattttggtttgcatctccctgatgattagtaacattgagcattgtttcatcatctgcttgttggtcattttatatcttttttggagaaatgtttaggtcctttgcccaattttaaattggattgtttggtttttattgttgttgagttatcctcatggcattttgcacatgggcagtcttgctaggaaaggcttgtcctaagtcccctctgcccctgccccactctgtcctcggcacttctctttcttcccctgtatgggctctgcctccttcgtgaagcctgttaagggttttctggaacaagctgagcatcttttgtgtcattaggaactcaacatcatcttattacttatattgtgtgtataatttattttgtggccatatgtccccttttatggaagccacttggggatagagaccaaatctacccactttcattctcagcatctggaggacatctctctaaggaatggcatctgaaagtgtgtttgaataatacagggactgagggtcaatgttaaaacaattagaaaccaaattagttgccatcttttcttggtggctgattctaagtggctgaaggaaacaccaggaaacattctgtaaaatgttccttggaaatggcaggcaaaaacaagatacagtgagtgtccctatttacatttggaggtctcatagccatttgcttttttctttaatgtttcaaccctacctgtcagagctttctgggaggcaagtatttacttttaaattaaaaatgggaaggatatgtgttgttcaggtgcattttgagaacttgagaagtgcctgggggtgtaggcaagagaccagtatccccaaggagcacaatattggattccaaggttgggtttgaagagggagaggtgggctagctcttttgaaagtggtgtctggtgctgatagaaaacctaagaacaaatggagaatttgaaagctgcaatggggcgtgaaatgtctcagtgaccaaaggcattatgtggaccatggacccagcaaccagctctggcaaggaccagattgtcaggctggtctggcaggttgaccttggcttagtgcctgcccatctcagctccatggacactgttgcacctcccaggttttccccagaaacaaatgatactggatgtaaagatagcatcaggattagaggcaagccccttcccttctcactctctcatcctgagcttcctgtgtgcagacgacattttaagaaatgagcggggaggggaatcacttcttgaaataaccactgaacaaactctgtataggcactgactgctgctcagactttggaggacaactcaaaatgttcaagtctaatgtcgccccttttcatcagacttgccaaggctcagacaacaaataatttaagcttctagattatttttgtgcagaagcagtattctctggttctctttgtcatttcctttctaattatcagggctgtccttatctgttcagtgcttcccatctgtccatttttttttttcaaagccacagggtacatttttgcatttacttctgttgctctgtttcctgattttttttaaagtgaactttttattgagctgtaacacacatgcagaaaaaggtataaatcatcaatgtatacctcaataaattttcattaggtgaacgtcctcagaataacattttcacaccccagcagccccttcccaatgcccctcctggccacttcctcctcggttggggagcttcttaggggagtctcatggcatctcagcctctctgtgatcctgctccccaccacacaccattcttagcagccaggcccagttgtggccgtgcactgtggacctggatgcatgacaaaggctttggccatctctatggcaggtgcgaatgtaggagggttggcagggactgatgtgcctttgtggccgaagcacccggaaagtgccattacccacctctaggagggatgtgttgtttccatacaacaaaaaaggcctttgaaataaagtgtttattttctttctctttttcctcttttgggaggaagagcaatccttataccttgaaatgtgtcagattctaatatttggagtgggacaaggccctccttcccctttcttatgattagttgaaatctgagtttgagcaagtcttgctgttttcagagaatgctctccttctcctgttcttccctcacagccgaactcatttggagagattgatggagttactaatgctttggagacagtccctaggaatttttttaaaatgtagtggtcagattgacatgtgtgtatatataatgataatcaaggctaaacacagtcttctctttctgtaatttatattcagagacactttgcattgttttcctacatgaatccttcctttgacactttgatctctgacctcccagaatgcttttagtttagtatgaaatgcaatatttggatcttctaggaattttccaagatcaccccttaaatagtttatggcacttaaaaaatgagacaatacaccagacattaagtacagcaaagccttcctataagtgtcagtgtgcagctggctatcagacagcaccatgataaacatccgcctcttttcacagcccctccaactcagaaatacaataaaacatggtcaacccttgaagccaagggctttgctaagtccaaaaacttagcaaaaccaaaacataactgatttacccacaaattagataacaataagtgattcaagtttgcgagccataagaattgagtcagaactttaaaaatcaattatttagcagtatggagtgattatttacttagtgatatattttttatagttctctgcctcatatcatttcagtctatttagaaacctgctattttagcacaaaacaatatcaaggagaggagtgaatgtggtttgcagcagaaaaaataacaatagattgttttctgtagtttaatgtcatacgacaagaggcagaatgtgggcaagctcaggttttgagagtcattctgagtgtgtcctcttttgccattgggcagagagtggccttgtccagggccttggtggcagtggcttgaaggatgaagagcagagagcttagaaggctgtgatcttatcatagaatgatgtcagggagaaccaggccccaagagccccctcactcactcggtgacgtggggcattccattcgaccccagagtggttatttcacatgtcctgggacatgtggcaggggggctgtaaagaggataaagtcaccaggcctgccccagggggtgggttttgatggcctctcaggtaggaatgagaagttttaagatggaaaatgcttcatagtgaaacaaggaagactcagaattcctggattccagtgctgtttgcagcacttactagctctgccacttaggcaaagcactctttgatacatggtgctcttgtacagaaaatgggaattctaaagacacctctgctcaccttccaggattgcagaagaggtcagaggtaggccataagaacgctaaatgttatcacttacgaaaacaatgcgtttgagggaggcaaaccaagatgttaaaaactgattattttcaaaagcaatattttaagaaaatgcattcactggctggggtgaagtgaactgatatcagaagtgagtagtgaatgcccaggagaagtggaacgggctgggcagggtagagtgtgtgcctctgagtaagcagctcggctcttcatcagcacagcagtgacatctggatgtgcagagacatgcacgggaactggggccactgtcatgtccaagcagaaggcaggggcatgtttagtgtggcagaaggacgatccaggcctgcatcctggctgctggcactgctccagtgtctgttagcagagctgccctgcctcatggtgtcttgcgtggcttcgaccctagtgctgagaggctcctctggagagctggccaatgcatctgtccatcttcttcgccagtatgcggagctctcgtgcaccccaagacccttggccatgaaccttccttcagctttctcctcagagaggccttccttgacctgcctggcaaaaccagccactccctggcatgagggaactttctggtgagatggagatgttctgtgtcttgctagggccttggtgacatgagtgtgtacatttgtcaaagctcatttgtgcattttgctgtatgtaagtttccataaaaaaacaactctccacacacatttacttctagttaatgagatgcatgctgaagtgtttctgtgggtagaaacatggttgaatatcagccattcctcccttccctgctgtctccacatcggttcagtcccttgggcctgtcagctctgaagccacccccgtcgcccatctccactgcccctcctggtccagacctgcatcatctctcacctggtgttcatttgcacttttgccctcctgcagtctccaccaagcagccaaatggtctttccaaactgtcacttggatcatgcttctcaactgtgtaagactctccaccacttcccattgcagatctgctgaagtcacagccattcctacgtccccctgtggtccaaccttggccgcctctttgatcttatctccttcccaccatggtcactccagaccggcctttctttctcttgagcctctgagcctttctcacgatgtatcctttacattctgctatcctttgaatcctcccagaaccctcttcccctcatgcttcaggccttcccgacctctggtggaaactatccttcccactcccagattctctattctataaccttgtttctttccttcccaatgctcaggactagctacaattctcatttgttgatatatttatttcctgtctcctagtaggctcccagtggcttgttcctgttcatgcagttttctgatgcccagaaaagtgcctgttatgaaggtgtggctttctggtccctctgctcctctcttctcccacagaaagaaacatctggcactgacaggagtctgctttgtgatcttttggggccaactttcctgctctcaactgctctctatccctttaggcctgtgctcatcgctggaagaacatctactatgaagccgaccacatcctaccccatggcttctgctacatcatcccctccaacctccaggccaaaggcaggacgctgatcccttgctatgaaggtgagcatggattgatttttcctcatccccctacccacctcatgccctaagcccgccttcccacctctatgcaccaccagctgaacatttccccagctttccacatgctcatgatagggcagcactgtttgctcccagatggtctcttggtccccaaggccctgcccagagaagaggcaggtacagagggggcagcagtcccaggcctttccaaccctcacctgacttggctgcagagcccacggtgcttaccaagcattatgaagtctcagggaccgaaattcaccaagcctcagccaagtgacctaacagctgccttggttttctggtaatgccaggtgctgtgttgccttgggaaacttaccttctctctctggacctcagtttccttgtccgaatattcagtggttggcccagatgatctctacagccccaggcagctccaagtcagtcattaggctcccacacagcttctggctgcactgtggacagatgtcctgaggctggggggagaggagacccaggattcataaagcaacagctggacagaaacctgacactctgaactttcagcatttcatgacatttgaggtctgactttccttcccatgtggtcctgcagcccaggcagatgctggagaattgggcgcatcctgaatgtggttttaagagctcctcgccaaggggcacttggaaggaaaatgtatcctctcagacttagaaccttcaaatgcctgggcatcgaggacagtcactaatagtgattgagtcagtcactatttagcccagtcgaatctgagctttaagcgttcagaaaacacggttattttcttcagtttgatagctcgtagtttcaagttttctcagcctaattttgggtaagctggaacctgctccttctgtaagtgctggactatttatttcttaattcccctcctactttatttggacagaagtctcactggcttatgtccacattgcctttgggcctccctgggttttcctaggtttcaaattttgtggacactaaaaaggattcatgagaaacactatatggacactgggacccttctgggtactgaggtgacacaggtagggtgctctgggaaacgtcccccacagaagagccagcaagatctctgcaggaggcacaaaccctctcccctatagagtgagccttcctttggtttttctttctcctctgtatcagcatttgatcagctctggctgggccatgtagggaaatgaaactctggccctgtttatatctgtattgtcccaaacagaagaagaacaaacttcatcttaaaaatagaggatgatataatcaatcaagagtggagggatcgttggtttcagaaacgcaaagcatgtgtcaagcctgggtttccactgccccagtttactcctcctttttcctaaggaagaaaaaggaaaagcctctggaacaaccggtggggcagctcttcaggctgagaaggagcgatgggctcagcagggtgatggaggcagtgattgttgaaccatactagttatgcataggaccagtactttggttttcccagaagatgacatgttgtgacagggacacatgatggtccctgatgattcctctatatataccacaagcacaaggacagccctctgaagagggaggtggagttcaatgtccatgtgtacgcaggtccacgaggctcataattctgcattactttctattaagtagctgtggatcatcagtaggccagtgttgatctgaggtctttacacattctctcatctaatcttcccagaagctgtgaaaaatgtttgtttcttttttttcttgggtctgattacaggtattttattttggaaattgttctagaagacaccagtgaggcagggggaagtaagaatgggaagggaaggcagcccatggaagatgtactcctcagcacgttacctgggcgagtgggtgcagtctctggggtgggtgctggggccagtgtggagcacacatctagagtcctcctgcctgagggctgaggggaaggggcttcctccacctggcatcctgtcctgccatgtgtgtgggctgggaaagcctccaggacagaggtgctggcaggtggcagtcaggccacatcataggaacggtggtaggagctggggggagacaggtgggatgcccaaaggccagcttctgtgttgtcattctcctgtgacaggagtaagtggagactcagagtgtatgtgaattgccccaggtcactcaaacaataaatggtggagcaggattttgaagctggcctctgtctgactcagcaaaccattttgtgtcctggtaattaatggtaatttctgttagtttgttttttagggtttctaatttaaatgagaagtaaaagccagtcaacaaccctcacaaagcaagaaagggtgactgaactatcccaaaaatacaatggacttaatgatggttaaatggaactggtgaagaaattagcaaaatgattatgcccctgcccaatcttccttcccatgggcgcacacacacttttatatgctaacccattcattggcccagggtgggaaataagggatggatggggctggcatgtggagtattggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacgttaggggtcacattatggttaaagacaatgggaagattttagagtttgacaggacctttcagataccacctagaacagcctcctgtctttcatgaggtccagagaggtgatggcctgagtttttctttctaatctgttattcacatgccacacaatggagaggcagagtagcttggtggccaatgcacagattctggacacagactgccggagttcaagtcccggctctgctacttcctcttattaacagtgtaatctcagatgggttatttaagttctctgtgcctaaccaacctcaagggtctatgaagaggactgagttaatgcttctaagtccttagaacagtgtctggcatatacttgctaatatatgctaagcatatatatactaatatgccatgtacaacatactgtattctgagcaagtgtttgttaatcatcatagggtgactgacttgtgtaccgggaatagaatccacttaatcttaagtacttgttagttgccagatagacaaaacccaagtgacacagttccagctaccaagaagctccccatctacaggggaaaacagagaggggacagggtgttttaaaagtgggagggccgtgtggagagagaatttcctgccagtgtgtactgctggagcccgtccccaagggcttgagctgcatccaagtgcaaggtggcattatttcattttacaattggaaaaactgaaacccacttaaagtctgcaggctgttgagactatggaagagagggatggtggaaattcgagactggtcatggtggtgggaacagggcaagggaggagggggacggctgcctctaaacccacttcttgtgggatggtggaaagaccgtgggaggggctgtgggttgaggacggctctgctgcacttctgcccctttagcctcaggcctgtcacttggcctctcagtgggagtcgatgctgtgatgcctccactgcatttaccgctttgggttatggtgaggagctcccgagaaaactcaggtgaaagtgctcagcaaggccacccattgttctataactgtggcctcatggtaagtctccatatgggccagctgtgctcctttacaacattggaaggtcggtttggttgcagagactctaaatatgtggggatctctccaaaatgtctcaagcttttgaattcttaaaaaattggtctctggtttggcactaggacatggcttctcaggtgcttcctgtttctggttggatgggaaaagctaccagaatatcctgttggaaccaggaaaaacagaggaaatgggaaataaaaatgaatttaggacataaactcatggagcatatccttcagtcagtttagtttgtgtttgtctgatgtgagaacatcattacctaccatatgttctttggttttatcagaatgtgtgagaaaacgagagctttggtgggacgatgtatagggaaaactacttgtaaattaaagggcaagcactataaaacattaattactattaaccaagctatgatattttaggactccgaaatgttaagtcaatgcatgtgataaaatcaagtacagagatttctttcatcctttgcccttgagaccactgaggcaagaagccggaacttagcaggagtgagactgcaaacaagttgtctttttattgtgaccgaaaaacctgatgagtgtggaatagtttgggagcagcatggcaaattaacaaagcctgttcaagattaaactctgagaaagaaatgcaagaggtaattatgatgccatggtatgttagacctaaattgtggaatctggctttactactcacttattgctatgattaaacctatatgctcctactttctgacttagtgaccttaggcaagctccatgagcctggtgccctcatctataaaatggggagattaagatctacttaagaggtatgtgaggtataaagtgcctaccacagtgctcagtcgagagtgaatgctgctcattgccttcaattagaaaatgtaaattttctaattaattttcaagcaacataatagtattcttaaatattctcagaaggtgtctaacatatcctgttttagtgactagataatgaagggtagaaagctggatattcctaaaatgattttaagagcccttggcaagttataatttctcaaatactgttgaagatcatattggcacaatttggttggtaagtgttccttccctctttttgtagatgacctaaaactttaactcatgccatgtttaaatgttcttaaatttgggattgttgaagtctgaattttactgtgctttaaaattgtgatggaaaaacttcctatggattccaaagatttctgtaccactctattatcagggaatgactggcttttatttctagtgtgtgtttgcatttcctaggacagtgatcatttccagggaaggaaatagattacccattcaaaggtgaagatttttttcccctttaatgttaaaagtggtctccacaagggataaaaatcaacgaaggtccatttacaaatgaaaaggaattggggttttgttgtatttttgttttgtttttgttttggagagaaccataaaaggctaagttgatccatttaaaaattcaagaacaagcctcataaatttttattaaataaagacctctacatttacataggattttatggtttccaaggagctttaataaacatatcttatttaaataaatagagcaaattaaagagaagaggatgcagttgtacattatggccagttaaacagagagggattctgagggggaggaagggagggtggccccagaggacagccatggctgtaaggaggaggccagaggtctccagcagggcctctctggggctttccaggtttccttggagccaagaattttaatcttgggcaaacctgtctcctatacttcaaacgtgtttccatgtattacgtggaattatagactacctaaactgcatcttttgtttctctcagaaaaattcacagattcagattcacctaatatttattgagcacctacctggtgccaggggttgtgctaggtacttaacatttttgatcttactgagtaatcacatcattctcagataagtattcttatccttgttatacagatgagaaaactgaggcccagggagcttgatgaaggtcacaggcttattagtcagaggaggggttgacggcttttaagtgtgtagtaggtttctttgtagctacctgttctgttgggatcctggttttcttggtgattactgagtgctgtggcctatcacagaaaaaaaagtcatattttttttcaatggcataattttatgaatttttgggacactacactatagacttgttaagctatgtttcagttttgcaattatagatacactctgtagacaagtcccagtaggtacagagggcagacgtgggtcctcagactgataaaatgtagccaggagaccaatctgctctagtctggagtggctgcttactgggaacatttggtttcagtatctgcacagcagtttgtctgtccatgctttggtgccagttatttcatgagtctttttatttttattttttggttatatagatcagaggtttccgtgttgcccaggctggcctcgaacgtctagcctcgccttcttatgcgccaggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacataatgcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattggccaggcgtggtggctcatacctgtaatcccagcactttgggaggctgagactggcagatcacctgaagtcaggagttcgagaccagcctgaccaacatggtgaaaccctgcctctactaaaaaatacaaaaattacctgggcatggtggggtgcatctgtaatcccagctacttgggagggtgaggcacgagaatcactggaacctgggaggcggcggttgtggtgagccaggattgcatcactgcactccagtctgggtgacagaatgagactctgtctcaaaaaaaaaaaaaatattgtaaaaaataaataacataaaaattaccattttaaccatttttaagtgtacagttctgtagcattatgtacattcacactgccatgccattatcaccaccatccatccccagaacttttgcatcatcccaaactaaagctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtcctcaaggtgtatccatattgtagcatctgtcagaattttcttcctttttaaaggaaggaatatttaataatattccattgtatgtgtgtgccccacatttatctattcatctgtttataaaacattttctttggatgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagatcttttccccttttaaaatctttctttcatttaattctaagtttctggctttatgcactttgtgtttcatgcacaccatagcttagtcatcagttattttcataaaatgttctcgcttcctctttaacctagctgtttaatttatttacattttttcccccatttatatggtggtcccttgtaaactgagggtagttttattctctcttcatttttctgtataattgcccttttttttttttttttttactagagctgtgtctgcccaaatgcattgtttcctgtattgtacaattatcagttatttagatttgccactctgttagaaacaaaatgcttgttcctcagtgccacaatgaaatagcacttgaacataaatttaattttctcagcaaggcaatttttacttctactgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaactggctgttttaaagagagcaggagtacgatcctgagtggcggggtgagtagtttggtgggaagggtggttacagaacaggtgactcaggatgatttgggtcagagcaagtgaccaggggtgactcaagatggagcaggtaaccagggtgacttaggttaaagcaggtgaccaggggaacagatctgaactactgattagaactggcgggaaagttgtttactgaaactagaggcaagggggccaaagagaaccaggaagttaaactttaaaatggaaaatcaaagaataagagagctgaacatattgacatactgattctttgaagagaaacttggaattcgctataacaactccttggtgaaattcagaataaagactggcaagctatttttcccccagtattttatttcagagctaagctaaggaactacagaaaaataattgtaaaattgatgtgttaaaaagctttgaaagacagaactttctcaaatgggtaatatgaagggagattattaggaagaatatatgttatgctgtatgtgaatcttgatctttctgtggaatggttttatcctggtcttttggaaagggtacaggaagtgaccccacccgattggtggtctgcttgaattacattcattaatgtaggctccatgcattgagttgcggattgtgaacatttggaaaccagtattttttttcctctctgaattgccttctgtttagacagggcttaataaaaccagcagctaaaccaaggaaaatactcccatttttagaatggaggagccatacgacttaatgaattaaagcatgtaatgcaggccaagtaattcaaacccacccatggcaggaagagttccacaacctggttccagctcctctaagtgacttctaagtccccttgttcaaccctatcttttgggtctcagatttggcttccccccccccctttttttttttttttttttgagaccgaatctggctctgttgcccaggctggagtgcagcggcatgatcgtggctcactgcaacctctgcctcccagactcaagccatcctcccacctcagcctcctgagtagctgggactacaggtgtgcaccaccgcatccagctaatttttgtatttttgtagagatgggggtctcactttgttccccaggctgattttcaactcctggactcaagtgatctgcctgcctcggcctcccaaagtgctgggattacaggtgtcagccaccgtgctggccagcttccccaaatgtaagggttaggtttgttacagtgcctgtgagctgctgtcaggcaaagcctgcttttcccctgcttctttgaggtggataaatgttttgttcagtagtggagagggcactagctattgtagtcctctctgcagggccatgtccctgggggcatttggagaccaagtagacatgcccaggagcagccaactgctgggccccacggcctttgtgtttgtgcaggaaaagttcttcctgggaacacaggagactggaggtcacccccaccccttcccaggtccctccaccctgcacttcctggacttgtcaatggagggagggtgtgtgacccaggcttgttggggatgttgtttgtggggcagccccttgcctctctctgcgcctacctcacttcccatagctttgtgatataggctgtcctgccatctcaggtctagacaagcaaaatcaagttgtatttttaagttttttagatacgagtatggtagaataaccctatgtacatactctttggggaagaaaggctcgtacatgaacatttagaagatggattagggagaaacctaaacctgccctcttgacatatatatgaaggaatcaggttaaaataatagtagtgcccttaactcacagaaatagcattcaaaggagtgaaaacaatggaaagcatgcttgtggcctaggctgtggaaggtgtggaatgtgaaactgtctaatccaataacacccactaactttcctagactagagttgccaggccccacaactgcccccaaagtgtgtgtggcagggatcggataggtggtagaaggattagaactggattctactctaccttgaagggattaatgacagtcacagaagtttctgggaggctgggacatggcctgctctctgatctagatttgattataggagccagtcaggggcccccattgtttgattccttgccctagagcatcctgagaaggcagcttagactttgggtttcagaaacatgaaagtcagtgatggtaccgacttccatgtgtgtcccaggccctcagacctctggtggggcagtcccagcttgggaaggcggaggctggcctgaaaacagtgcttcatgctgcctgaaacaggggtgcctttaagggcttccccttgctggccttcagcctgggccagaagtggggtattcttagctcccagtgaggctgtcaccacctcggaaacccgaggtcctgctcccaacatagaccacaccaagtacagtttggggaggaggcactgaagttctcaaatctcccattttttggagaccttgtcataaagagaccttgagactgctttaaaagatgaaagagtcccacacaattcctattcatgtcagaaatttatgaggctgaactggtggtgtgtcttgcactatagtttcattcagctcatggggtctgaatttcctttttatgtttcattttttcaagagttacaattgggtgtttagtctctagagtcagtgggatggatatgctttttgccagacttttcacatttaatatgtaactgtttgtttaggttgagacattttgatcctttttgccgttgtgctatttgatgcaggatttattattaatttgtattatttcttgctattatgaaatttgatgcaggatttgttcattgctttgcactagtctcactcgcagccctggtgcaagattctgcagggaacaaacaagttccttttgtcactggactgctttctggcaggtctagcagttgtccttataataaccggacaaggcgggagaactgattttatcctgcatggaagaggagtaactcaattgacattctttgtcatttagcagtcagttaatggccacttactggaaaatgttactaggctctgtggtgagtgttgttagaaactgaattactctgtatatttccccagggccctttttccccttgcctggagtagacactcagaacggcaggaagtggcactgtgttgcaatcatagtttcattgttcctttgtattttgcatttcaaaaataatgatattgcttttaatggtaccagagacttgccaggagcccagggggtggtacagggtcactggggtagccccagcctgagggtgcccaggagtggtctgtggaaggtctccagcaatgtcagcctcacatgtgattaatttgagtcactgtgaacatctctccacctccttgactttacccatgaaatgatttccaacatccagtcactttcctgggtatttttagtcactcactttgcagaacctttgatggtctacagaagtgaaggaatgggtttctaagtccaagctgaggtagaatcctggcattgccatttactagagctgtgtgaccttagacaattcacttaacctctctgagcctcagtattcttacctgttaacaagtggggatatgggttcccagggatgagggaccggtgaaatgatatgcctggagacagctaacacaatgcctggaaaatgctaagcacttgtcaaaagtttcctacccctcttccttgccagcttaaaattataactgcagcagcagaacgcccccatttgttgggtagcagtgttgtgagctgagggggtggaggagaaaagcttatctgttagttttctttccacctggagagatcttccccctttccttccacacagcaatagtgtaaccgaatgccagagcagtcccttcttcttgcggtcctctgtggacggcttgtttctttttggatggtaggaggcatccaaagcctcttttagggaaggttggtcttcttccaggagactccacactgggatggccacatcattccatttctgggtcacgttttcagctccttgggcctgcaagggatctctgtcccttctggagtaaatgaaataattgtcactagcctcccacttaatgactgtggctattgctcctctttctcgcacacgaggggaggaagtctgctggggcactgggcagcctcccttcccgatggcaccagagcctggatttttgaggtctggtggattcctgagactttccttcctcaccccagtctggacagcatccctgggcccagcctgccgcggcactcgtgggaagtggctggctggctctgctggctccacgcacagctggcatacactgacatggctgtggtttgcttctctctccttccttgcccctagagtataagaagaagtacggagaggaacacggctcctgccaggctgggatagcgggcttcttcaccgaggtgggtgtctgctgtctgggcatttctgttctcttgtgggtgttcatttccttgcttatatgattttggcaacccttagaggtgggacttctggagtcccagatacttgagcctcgagggagcagattctggtcctcacaccagaggaggctatttctacctgccaggagggcaccagctggccagagaccactgggcagaggaggtggggtggctcatctcgaggctacccctatttgatgatttttgtaggagtctgcttgactctgagacctggggaaggagtcgatttggggatgtgtgagtgagatgacattcagtcaggttgtgccccatcattggcgactgtgcagatacatgaagcgtgtgagcatcccctcctagcagccttctctccttagtggagagacttgtttgtttttcgagacagagtcttgctatgtcactcaagctggagtgcagtggcgtgatctcggctcactgcaatctccgcctcctgggttcaagcaattctcttgccttagcctcccggttataggcgcccaccgccacacctgtatttttagtagagacggggtttcgccatgttggccaggctggtcttgaacacctgacctcaggtgatctgccagtctcggcttcccaaagtgctgggattacaggctgagccaccacacccggcctgagagacttggttttacacacaactctaaccattccttttcccagattcagaaggacaggacacctgcatgcttatgtgcccgtgtggtagtagcatgacttttggctggtagtacatttttagggactgttttcttgtgtcattcttacttactgtaagtttgcccttcgtatcagttcctcctctctcaaacactttcatgactgcctgctggcactgtctatccatgtggttgctcaggccaaaaaaagagtactttttacttctaattcatctgcagtcctgttgttttagcctccaaaacacatcccaaatatgacagcttttattactattacaatcacctccattatcaccatcatgcttctagaaaggccaccaccatcacctggaggtacactggccctgattggtcttcttatgtctattatgcttttttaaaaattgtggtaaaagatgcataatataaaagtcaccactttaaagtgtgattcagtggcattagtgcattcacagtgttgtgcacccatcaccatgggctaggttagaacactttatcacccagcctgcatccattctgacctgtgaagtgtgctttctgcatactagccccagggtccttcaaatgaaacccatccttctgactccgaggcttcccagtccatggaggattacaatgtaaagctcctcatcctggcccctggacttggctccctgaggccacctctctcttttcctcactccaggagagcagagagctggggaagggcatgggacatggggggtggagggaggatgaagggtgctctctggcttccaaagtgagggcccctcctgagtcaggagcaagactgcctaccttcctttcagaaactgctgtttaaatccaaagagaacatagacagttggcaatatagtgtctgatccagaaagcaagaaagaaaaggcagaaagtctgaagttttattttcactctcaaaccaataaataggagatgctaccctccaacccccattccgcaccctcagtgattcttacctcgctggagaatcatttttatgacagtcgacagagttctatgccctgggaatggcaccgccaatcatcctaaccattgaggccgaatttaaagattgttctctcacctcactctcctacttctaagccaccttgcaagtcccaccacctcctatgccctcaaaacctctaacaatgacatccattgccctccacatcctctgccaccctacaaatctaagccatagttgtcttgcttccaacccactgcggaatccttctgccgtcttgcttccacccttgcctctggacagactggtccccatgtagcagccagaaccaccttttacaaacaggaaaaatatcatggtgctcccttgctcaggactttctggtgtcttctcatcctacttagaatgaaatgcaaatgccttcccttggcctcccagccttcatacctttccaggctcatctcctacctcacccactacatggtattttcagctgctgctaggacatgccggactcccactggtggcattgcactggagatccattcacgtggctccttgtacacaagtgtttctttagaagagacactaatggaggaactgctgggtccaaaggcactcagatttgaattttgatacatgttggcaaattgcacttcagacatgtttaccagttgacactcccctgcattgcttctgtctctatcttctctcactcagactttaaatttttgttatgaaaaaacatctcgttttaatgtcactttccctgattattaatgtcatttaatatccttttaaaatattgaccatttgtatttgttttcctggaagttgcctgtttatgttctcagtacattattctgttttgttgttgttgttgttttcctggtttttaggaacttgttacatattttcaacagtaatctcttacctgatctatgtgttgcaaattttttcatcagcctttttcttatgttttaagtttgcctatgatgtctttatcatcctggcaataaacatgcacatttggccaaatctatcagtcttttttttttttccctctagattctaaacttatctcttaagaaggttattccttatgtatactgcaagttggcatgaacagctgggcaggagagtgcccgggatctacaacacatgtctgggctgaacaaactcccatattttatacttatattttcaatatacttgtatttttaatagcactttcataggttgtttttaaaaaagatttcgatctttaatctttctggaatttgtgttgtatacattgtgtgatagaaactaactacattatttttctaaatatatagttggttgttctgatactggtttgttaaacaacttttcctctccccattgaaatgccatcctgccgtgtggcgacttcactctcttcttccatctcagcaaacatttagattgtgtgacaactatggctgttgttcctccaacaggcctgtctagtattgtatgacttgagtcaataggcagtgggaaccactgtaagttcacaagcaggtgacacactggcagatggcagtgttgaaagaaaggctatttgagctgggtttgcccagaactttgggagtggaagggcctgaagggaggcctggtaggaggccgtgatgtggtaggaggccgtgaagcaacaggacagtgtagagggaggcttaaggaataaaaatgattgggggaggcagagaatatgaaggaaatgtcaaggggctgggtggccagggagctgtggggtagaggaaggagggtttgagccaggcttctggagaatggtggtgcctctggtgaaaaggggttgcctgagaaagaacccattgggagatataaactgccaagtctgctttcagacacagggagtgtgcgatgtttttagaggacgtttggacttagggactggagtcctgcctggggcagaaacttagatttggcccttgctcatgactctcttaggggatgagtgtgcttagtgtagggcatgggggagacacctccctttagatgggaggagaagctagattgatgggagacatcagaactcaacggagatgttgacagagagccgaggagaaagtgttcccaggagggaagtgtcattatgtttgccgcagcagctggcaagtcaggcattgggctgagtggaggcagggagtggtaggaggaaccggcggggcaggagtgtggaggggaagtccaggtagctgtgcaagctcagggtgaccagaagaacagaagacctgctgaaatccaggctttgggatttagaacctgagggaaacatggggtgtcagcatgtgctggctgtgctcatggtacagcaaagtggggacatggtgggtgtacagagtgtccggggagggtgggcagtggtgagtgggaaggcagcccctctgggcgccactctgtcctctgaccccggcctgctgtctcctggctactttggactttggcctccgcttcagttcccaggcttttggcctccttaaacaggaggtctttgaactcactgcctgccttgtttctggaagttcagctgtttgtggctgagcaggaaatgtggttgaagggtccaggccagcgcgactcccctcctctgccctcttgctgacctcgccacttgggcttgccttttctgtgagctgttgtcccctcccaagctggacatggatctgtggccttctggtcatagctatgttgccccaaaatattttggcctaaggtgcctgcttgacctacaggtcagtgaccctgagcttaacaaagccttcggagctatggataccacctgaattttagcctgacattgaggattagagagaatttcctgggaggtttatttatttttgtagatgaggctaacagaggtagtagatactgcttagcagcaagagaggatttggaccagctgggctggcgttcacgcctgctgtagaagcctagaggcacttgggtgggagtttgttcagcacggacttctgttgtagatcccgggcactcctgcccagctgctcatgccaacttgcagtacacagaggaaatatatggcttctcccaggcccacctacataccccggttcctctaggggttctgctaataaatgcatcttgggaaaaagctgcattgcttattgatgggattccacaaatgtgatttaggtagtggtggcctttgcttagagaagctttcatttgtgtgtgtgacattgacactggctgttcctgcatggtggggagctaagtattagtcactttttcctagcacttgtgaacagcaccagaaaggtcacaagcatcatccatagggaacagaaaaaacaactatgagggatttccaggaaggcactgtccctcccttcagcctcagccctgagggtcgcaggcttggccctgttttatgtagtatgggctgaagggagaggggtgtgagcactgggggcggggtggcgtggtgcggtaaaaacaagagctgttggttttaaaggtttttgaagacaggaattactttatcttaccctgtttataatgtttgagaggggatgcagtggtatggtaggcatacatttttcaacttttatcctgggttagtctaaatcatcagaaagcaacatatcccatccctgcccccaatgttccgaagagcctttgcaggcctgtgctgatgctcaaagctttggcctgtgcaaagctgcaggtggagaaagctctgcactgaggatacatctggggctgaggaggttgctcattaggttcttcagtgccctttgtattatatttggacactgattacaaattcctttccaagctcaaggccaggagaaaaagtctctcctctgatgaacttatttctgttttttgtactctttctagaactagcgtggtctcttatgcaggacagatgagtgtaaaaagaatgagtggatggatgctctgctgtgtttcccagtggagcgtcctgactgcagaaagctatctatttttataaaacagtgagatacccctgggaacatctggcttatcatcaacagcttccttcaaggggggtaggatctcaaaactttaaaatgaagtgctcatcaacagtcatttcttgtctacaccctcctgaattatcaaaaagcaagcctttccggcgagaatctagtggcttttcttccatctgtgttcctgccctatcctttgttaaggctcttccccaaattaaccataacacgtattgtttaaggcattgccctcttgcctgcaggctctatcctcctctctctattttttttctttaggtacttctggcttttgcagacacttgctccctgagaattcagtggtgactttatgaattgtcctcagaaattctaaatctctgcggcaggatctagcctccagggacttgtcagagccagcagcttctgccagtgcgtgggctcgtctctgcagagggagatcaacctgaaaagatctgtttctgaaatatatgtgggtgaccaagggacggggtgcaggggaattctgaaggctcaggggaaggtcaggtgggtttcagcagtgagagacttgacctgcacagcatctgttatccccatgagccttcatgaccagtatctttggagttttgtctatagctgaaagatttcctctagaaattttgttgattttaacctgtttgcatagaatttttttctgaaatactttgcacattaccatgctgtcttaccccaagaatgatctacgaagggactttatttatctttatatctagtgtgaactctgagatataatagtaggtgcccaataaacattgttgagtgaaaaattactgatttcattagaaaaataattctgattatttcttattgcagtgtcgaaactttagaaaataaaggtaatccaaaagtagggattccctgttggggaaaggaaggactgaaagccagggacctctgatggatacaagcacagcctgcctcctagctccagcacagcctctgcacaatgggagcttcgtcttaatgcttgtaaaatgtcatctcattagcatgttttgtgtttttatgtgatgacttccttgttagtgtttaatcactgttctggaattttaaaaagtcaagattattaattaaaaaaattaatacatataataaaatacactattttaaatgcagagttcgatgagttttgacaaatgtgtataccatgtcgtctctgtctgaatgaagatgagaacatttccatcactttgggaagttcctcatgcccctttgcagacagtgttcctcctctttactccaggtacccactgatctgacttccatcagtgtggattggttttgctgattctagaacttcctatgaatggagtcatttttttctcatcaacatttggtctaggattcacccatatttcaactgagttttgaatactgcgaaagggttacacaagcagaggaagtgtgagggcattgcacagatggagataaaaagatcagagggagttccgaagaccagaattagtttagagtgtcctaggcatgcagtctgagggggcagtggcaggagaagagcctaatgtggttgaaatagtggacagtgttgaattttacctgagccctgtactcttggaaaacagtgtggtctagaattttgaaaaatgcaaaggaaataaactttgggagtgagagaacaggggatgttgattgatttccattatcgtatcacccaggggaaaaccccagcagatatctgtgctgacttccttgggtgaccaaatcatttctgggaacttagggttgttgtcagcattggtgatggttctggggcacaaacatgctctcagccctgttgaccatttccccctgatctaaatgctgaagacagctgtgcctcttatgttcttgagtctttttttttttttttttttttggcagagtcttgctatgtcacccaggctggaatgcagtggcatggtcttggctcactgagacctctgcgtcccgggttcaagcgattttcctgcctcagcctcctgagtagctgggattacaggcatgtgccactacacctggctaatttttgtatttttagtagagacagggtttcaccatgttggccaggctggtttcaaactcctgacctcaagtgatccacccgcctcggcctcccaaagtgctgggattacaggcatgagccactgcgcccggccttgagtctgtttttaacagtgataccgtctattgctgccttgtggtcccctcttccagtttgtgtttttccttagttgaccttgctggtctcttggttttgttcttccatgtttgcagtggactgtaatgatcggaaaaccatgttctagaacgtccctgagagggtcttgagtgtggtctggaggggattccctggagtactagtgcacagtttcctctcgctacgcatcaggtcgggggagttgaatggtgagcctggagtccaggcagggtgcggtattgcttactgcttttcatgagtggtgttccccagaatctgtggttgaggtcaatgtcagctgtttgtcatttccttgttagagcctgatgtaaagttgaggaaacgtgtgtggtctcatcgtggatagaataggggcctggcctgtcgtgaattctgtcaccttgctcagtctcttcacatctttagtcctgataatcccgtctgtataatagattccataatgctgatgaatctggtgaaatctgtttttgttgcttagctggggaaaaaaaagttcttggtgtgaggaatttctcctttgttgtgactgtggttctcattgcattcccctcctcccctcctcacttccttctctgcttaccgttggatttctttttggtaggagctggtggtgatgggtgctccagggtcattttattgggctggaaccatcaaagtgctgaaccttacggacaacacctatttaaaactgaacgacgaagtgatcatgaacaggcggtacacctacctgggtgagtactcagggagagaacaggtaagaaaggggaaatgggagtgattcccaccagattcacaaattattgcttcattgttggaaagaggagttagttggctttgacgcctgttgttctaatgacttacatctttagccagggcatcttcacatctagctccacaaacacaaggtagagaggaaaaccaaggagggaactgaattaaaactgtatgctttaattaaaaagctgacagttgaacctccagggaaataaacattttattttctcattttatcaattgttgaagttcagatggtcaggtagaaatgagtgtgatggagtcttgattttccacgggcgtccctttggatggagtccttgctttctgatcacaaaactggtagcaaatagaaagataagaactagaaattatcatgacagatggcaacctaatgctgaaggttaattaaaggctcagaaaaatttctcttgctttcttaactcttttaatcttctggaaagaagatagacacaatttaatgtagctatcaggcagaatgacactgggacaaggtccatgccaatttaagaacagacataggctgtctttgcttgtgtagatgacaattacaagactcttttctttaatttatgccctaaatgctataattctggattgaaagcgaagctaaatttaggaaggcctaatgatgacacacaatgctctttcgcactcatgatacataacttacagggaaaggccctgactccctttttgcatagcgtcactgggaacttcttgttaaatggggttagggagtcgttgacttgccttttcccttctaactacaagttttttgcctggtagcatagacccaacaatccttctactctggggtgtttgctcctgtaggcacccagctgcctagtgctgttgcttattaagcatttaccctatgccaggctgtatgtattatttctttttaatttctgaaacaaccttatgaagtagctattattatctacattttatagataaactgaggagcaaagaaattatacatcttgccaaggtcacatggctcctaagtagcaaaattagggtatgagcttgtggtttctgagtgcagagtctaaatgctgagctgccttccctgtgggtgcgtctgagagagcacctatcactggtactgtacttctcactgggctgggagcaccttgaagacaaaatgtgggattgtgtctcacatttggtatagtgcctggtgtatagtagtaactcaacacatatttattgaatcagggaatgaagagagagcagaagaaagcccagtttggatgatgggtttggggtctagaacagctcctttgaagcttcgagcctgtggtttctctttgtatacacattagaggctcttatcagctgcagggattatcaaggatccgttcaggctttgatctcactcagaatactcttaggtactatcagtcgccagtctgagagaaatcagccacatggtgaggaagaattgatcatgatatgatgtcatcgcgaaactcaaacaacttacaatcactttagggttagagggtgatgacaagtttggggattatatggcagcctgtacaggatttatgctggccagaggagagctttcagcctgctagcaaggctctcagaaagcaggagacgttgaggctaagcctaggcaatcttttcctttgtttctaggttccttttgcatccatattttttcactgaccaccctcccacccatccacccatccatctacccaaccatgcatctacccacccacccactgacagcttcttttgccttcttgtaggagggagtgtggttaacagcaggggctttagaggcacagattagatttgagtcttgctgtgtgatctttggcatgttgtttaacaggtttttctaattctgtatctgtaaaatggaagaaacagtcatgccttcttcataaagtttttagactgaaagagatacctaaagacatgcataaaaatgttggtagcaaccttgttcatattaaccccagcctggaaacaacctaaatgcccagcaacagaataaacatatgacatatttatataacggatattactcaataataaaaagaaactactactgtactcaacgatgtggatgaatgtcacagatgttatgttgagtgaagttcaagaaaaggcaaacctaatatatggtgatagaaatcagaatagtggctacctgtgtggggcatattgactgggaaagggcatgagggaaccctctggggttatggttctgtggttatagtcacttccttgatctgggtggtggttgcatggctacgctcatgtgtgcattcattgagttttacacgtcagatatatgaccttaccgtatgaaaactatgccttgaaaagaagaaaacagatatatagtatttcatacagtacttgtccgaaagaagacactcagaaagccctctttcctgccctgatatccttgtgaacatgactttttgtgagatgagagccatttcagcatgagaaggttgacagctgccatttttttcctggtagtttatgttccaagagtagggagcatgcttgagaaacattttcctctgatggatgtttttttttcccttcccttctttttcaaccgtgtgcttggtttccgcccatcctgttcaggctacgcagtgaccgctggccacttctctcacccgtccaccattgatgtggtaggaggtgccccacaggacaaaggcatcggcaaggtgaggagaaacatctgtggaatagctggggtcagacagaagaggggagcatgctgtccctggtgcagaggtttgccagctgacattgacctgaacattctactgggtggctggtggggaggtgatgaggaaccccctgactgccccactccattggaaagtttcccttgaaagctcaattagagtgtgagtatactcacactctcgatttcctgcacactctcatctgaggtttttcacagctgaccatgtgtgtgtgtgtaatttataagactgagccctggccttatggtgtccttcaaaagaatggcatttagtgctgtccaacttcaaatcccaaacccttcccaagtttggctttgatttaatggagctaggtccagtctcagatatctttgaggctttattcatgccccaaattattctcgtatttatttccccagtgtttgagaaggaacattgggttcccaagactggttcagcccaaaggctggactggaaatatgtgggtctggctttccctaaactatagtatctgccaaaaaacccaccccctggatctagggctgcctgaattcctttgggaaacatgacctctgaggggcctgaattgtgaactacgcttgttggttctttatcatgaaggtacaggaaatccagattgagtaggtacagatggatcaggaacccacatttttaagaagctccataggttgtctgatgggaaagactgagtgaacagaggaatgaactttggatctggacctttaggggtagacctgtgatagagtctggtcatatctcccagggcttggagaagtggaatctggattctggattagcccagatgagctgagaccactggtaattggagccttcagccaggaggtcaggatgatcagggagctgacgaactttccagttgactaggcttgactaaggataatttctgtggatcctcctgggcagaggttaggagctgctgctcacgtttctggagcatgtgcctccctcctccctaacactgatgctgtggaaagaggttcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacacgacccagttttatagtttttccttcagatgattgtgatgaacttcatagtccctgtcaagtcttaagatgacccctccgcaaacccctctcactggctatctggggggtgcaaggtataaagttaaaaagttgagaatggtacttataattgatagagccagacagcgggactcctggacccagtttataaagtacataaaaatgcttctttcaattagaccacctgagaggcatggggaaactggtcatagtgacaaagttgctgacaattccacattcccagggattggggctagtacagacttgattcccaaggacccctggccttcaggattttgctggatattctagtgtcagggcacaaaagcactcacactaagatggcagttccttatctcatgggaaggttatttacactggttctcatgagacactcttcccacgagatgtaatccaaaaaaaagaacttccatagtcaagtacatttaggaagttaaatgtcagtgatcgtctttgcagtggcgatgcatagttcacatgaacatgctaaaggctctaaaaagttccacagtcaaagaatttacttaatgtttaactccacatttcccaaatgaaactcatttttacccaggcagatcacatgactctaatattacgtgaaatcactttgggaaactgctttgtctacagtactcatctccacctatccctttatcttctgttgtaatgcctggtaaagtcttactgggaataaagtccaatccataccaccaactaattttaaaaacaggaataaaggaaatatttcaagaaacaaaatactagctttttctcagagttgaattgtttacttgtaatttggaagcttcttgggtcttattgtgtgtggcttttataagtattgtggttcaggagcagtggaggtgatgtctgcctcaggattgaaggacccttttttttgcagggctggtaaaatgacagctgacttcttcatgatcatcagctagcataagcacatctgctgtgcacctggctcttaagcttttaaataggactcccaggagagtgctgataaatatctttgatcattgatttcatcctaactagattttttttttttcattccataggtttatattttcagagctgaccgaagatcaggcaccttaattaagatctttcaagcatcaggtaaaaaggtgaggttcttggtataagtgactattttttatttgagagatgtgatcatgtgggagtcagtactttttagaaaattggtttgaaggccctacctgtgccctgtgtttatatggcagtgctgtctgcttgttggtgtctttaccttctcagcggtatgtgtaatctgtacattcatgggattcatactcgctttaggagacattctgtagcaagatgagttatatggggccaagttacagcacagagttttaagagattgtccgtagttcagactgtcatcaaagtgactgcatgccctgtctctctgcctccatcctttctcaacgaatctccacctccagagagagcagatctttctgagtacaggtagcaataaatgcttctcactgagcctgtttcaccagcccaacattacccccttccctaatcctcagccctcaactgtcattgccaaggtgactgttgccacacaaagaaaatccaaacacaggttgcctgattcctcttagaaccttgaagcagaaatagctcagggtgctgccctaaagttagcctgggtgagattactctgcctgggtcctccccaccctgtccctaatcctctctctgctttctgaaagtttccattatactgccctgttgtctaaaattaagccaattagagagtcctgctattaataagcaacagttttcatgagcttatcagtcatgcacttcttgtgtggcttagatcagcaggactgtttggctgagcttggctactctaagggacacaagtttaggctgggagctgtgggggtaatttggaggtcttggtggaggccttagtgggatctgggaagaagcataggatgtctgggacatgggaggaggccatgtgcctcctcaattctgttcctgccgagttagaactgctgtacgccagcctaggatccttccatgttgttctcccattcaagtagacctttttgcaattttaacaatccgaataggtacacttagtgtataattgtcattatcttttgaataaaaaatgcatcaccaaacttggttttgcatttttcctcagaatggctctgccttcccgagaactctgctggcttgtgttattttaacatttccaaaaccccaaagcaacagcactggaaaatgactgtgagccattctgcaaaagggttttccaagcacccttaaagttagaaaagaaataactctgtgctacttgtgatttacaaaagagagtttcaaagagcaagtagggtatgagtggaattaaggctaacattttagatcttctgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcccaggtagctcggaccacagacatgtgccaccatgcccagcaaatttttgtatttttttttgtagagatgggtttcaccatgttgcccaggctggtctcagactcctgggctcaagggatccacccaccttggcctcccagagtgcgggatgataggcatgagccaccgcacctggccaaggattatttaaaatgaattgtggagtttctgagtatctttatgttcagttgtagctgtgcccccccaaactgcttttccttccctgccctactccttactgtctgtgccctggggaggtccggttaattcctattgccttcgagtaattaacaatctgtaattgtgccctctctcctccttgaaaacctcttggtttggatgagaacctatgctcaagttgatcaggtttttgggggtagatctgagagtgggtggtgcaaggaggatgagattaacctttgagaacccacttgtctaaacttcctgaagacttctgccattgagttccaggacaggttcaggcctgaatgtctgcttggatgtccttatcataccaagatacatcaggttccctgagaagggacagaaaggcccaggtattcaacttcttggcttcgtagccatttgactttttcttttctttagggctcttctggccctaacctttgcaccattccataggcaccccttctttctgccactcactcacagtcctcttgccttcacttccttctactagtgtctccaactagatttaccctgtcatcatcgttctgcttttgaaataggccatgacctttctttatacaacttattctacttcttgccagaagaaatgagacattcatgtctttctgacttctccattacctcctacaaaaggacatgaccccaggctttcaaaggatgcctttagatttatccctatgtccagagtcacatagacaggagggttctaactcagcaaaccaccggttcacttctgcttccgtttggctagaatttggtcagatagttctgtatcctggcttcctataagaagaaacaaagcaaaaagattaaaaaaacaaaaccaaacaaaaaaaacctggttcttgtctttattggttgactttctccaaatagtacacttaagaaatcaccaacatgtgtgcagttcagatgttaatacagacacacatctccacatttccaggctgatggggagctctgatcatcggacacacaccccaaagcatgtcattgccatattgaagttttattgaattaacggagtatgtgaagcatttgtatttcaaaactgagataggaaacttcacatatagagatttctaatttaacattgatgaagatgccaagttaaatagtcctttggaatgaaacaaatagttcccctggggctcagccagtgagcgcagccagcagcttggctctttgggtctttgcctgtgtcttactgatttcttttaccaaagctcagatggggagattggcaaggccactgaaatagtgactggcaactcggtttctttcctcctcaccctttgtgatttcaaccctttcctgctccgttctcctttgagaatgggtaatcagaggggaggaagatggccttggcatatcactggggaaggatttctgagcggccactacaaagccctcctgtgaccctgttagctgcaggaaatagattggagtgtcctctacctctctccctcaaactccctgggtcagctgccaacaaactccaacagtaaaagaaaaggcttgttcatgtccatcaacccaggggccttttattagaaaacatttattttaaaagaataatgctttttctccttttcttttcttttcttttcttttcttttcttttctttctttctttctttctttctttccttccttccttccttccttccttccttccttccttccttccttccttcttttcttttcttttcttttcttttcttttcttttctttctttctttcttctttcttttctttcttgacagagtcttgctctgttgcccaggctagagtgcagtggcatgatcttggctcactgcaacctccacctcccaggttcaagcgattctcctgcctcagcctcccttgtagctgggattacaggtgcctgccaccacgcctggctaatttttgtatttttagtagagatggggtttcaccatgttggccaggctggtctcgaactcctggccttgtgatccacccgcctcccaaagtgctgggagtacaggcgtgagtcaccatgcccggccttcttcttttatttttttttaaagtagaggttgcaaactgacagcctttggaaagaatacagcctacaaatacttttgtttggcttgcacagtatttgtttattgtttttacacacgaagaagttgcgagcatttaaaacactggcactttaaataaagttttaaatttttggcttcttttggaaaatggaaaggttgctcctctctgggtcagcattcctcttggtggcagttagctgcagctgggttgaagctgctcctttagccaggcttgtgggctccagtttgccacagtctccaccactccctattgttatgtagacaaggaagacaagtgtcacttgccacattaattttttttcttatgcctgttatatcacctgcctggatcctgttggtatttgggtttgagacccctaattaagctataattaaaagtcaatattatcttgctctgttccctcatcagttaaacagtcttaaaagttgtacctttttctgtcacttcagctcatgccttcctaaccaatctttcacctgtgcataggaccaggagagaataacctatttccccatgtaacatttattttcatgcctttcttgtgttgtgagatttcatattcctacttgcttggccttgtcaaatgtctgatataaggagcatttttattatggttgtaacataactttgtgtcctcagcttgcatttttaaaaacagcacctcattctgtgggcatcaatctatttatcttccccttgataggactccaggaatgggggactttgggccagttagctttgtctcacattgactggggccctgccttgctgctggaagttgggtatttcactctttgctaggcattctggtttagggggcagcatagccatccagcctctgagggatgtttctttttttttatgtttttattttttagtatacattaagttttagggtacatgtgcacaacgtgcaggtttgttacatatgtatacatgtgccatattgatgtgctgtacccattaactcgtcatttaacattaggtatatctcctaatgttatccctcccccctcccccaaccccacagcaggccctggtgtgtgatgttccccttcctgtgtccatgtgttctcattgttcaattcctctgagggatgtttctaaagccaatggggtggaggaaagcgagggcatccttgtgtgagagcagacactgaatgctttgttgcaactcaacttggttgcagatgggctcttacttcggctcctccttgtgcgcagttgacctgaatggggacggcctctctgacctgctggtgggggcccccatgttttctgagatcagggatgagggacaggtcactgtctacatcaacagaggaaatgtgagtacaatactgggcaatgtgcggatgggtgtgggggagggacatttgtccagccagcagtggccgagcacccctctgggccggcactgggggcaatgttacccagaggagatgaaaatatgtgatatctgtcttgaataagctcaatggcccattaatggaaagttatatacaatgttacaactgcagacacccaggggccaaggaagaatcttaataattgtcttttgagtgcttactatgtaccagggactcttcttcctgctttctgcgagagatttctatgcaatatacacatggtatcaagggtgcccatttttcaggtggaaaaactgaggcccagagaggttaggtaatgtgtcccaaaccacacagctaagaagtggggctgggatttgaacctaggcaagctggctttagagctggcatgctttgtctcaaggttatgccacctctctgggagcatatgcacattttcccagggaagcagaggaggacacaatggctggggaatcttgaagaaggagtaggagttagcagacaggcagggtgggctggagcagagctcccagtgcagagctgggcaagtgggttggggtgtgaggtggcatcaccactcatttcagcatgggggggcaggggactgcatgggaaccataatctttttgttcgtttgtttgttttgaggcaaagtatcactccatcacccaggctggagtgcagtgacgcagtcttggctcactgcaacctctgcctcctgggttcaaactcttctcctgcctcagcctccccagtaactgggattacaggcacttgccaccacacccggctaattttttgtgtgtttttagtagagatggggtttcaccatgttggccaggctggtctcaaactcctgatttcaagtgatctgccctacttggcctccctaggattacagacgtgagccaccacgcctggccaataatcttggtgtcccctattctgcagaaccatgaaagggacgtgacatggacagaaagatgcctctggccctctgtagctaatggagggtgggtgagtgggggctgggttgggggacagcagtgcatcgtggaagcaggagaccagtgagaaagcagtcttttcaggatctggaagtacaagtgttcaagtacaagtattcagcaagaacaacatggttcaatgaaaacattctggtgccgcctaccttttctctaacatgagaaaacgcttatggagataatcagtggaaaaatgggatgaaaactgcatgtacaaccagtcctcagaaatatgccaaatacatagaaaatgtgaataacagctctctggatagatgtttagttttatctttatccaaatagtgagaatataatttcatatttaaaaaaatcgaagtgtactgttaagcagtggctgagatgctaggtatcccagttgggagagggcagaggtttagctataactaagtgggcagatgccagaaaggaaggaagcagtgaaaggagagccagggattgttagagccttatgttgcgtctgaggttttcaggctcttcaggaagtcagatctaaaaccagggaggtttgggaggcccaggtgggaggatcacttgaagccaggagttcaagaccagcctggccaacatggtgaaaccctgtctctactaaaaacacacaaaaaaattagcctggtgtggtggtgcttgcctgtggtcccagctgaggctgaggtgggaggattgtttgagcccaggaggtggaggctgcagtgagccgtgatcatgccactgtactccagcctgggtgacagagtgagaccttgtcaatcagttagtcaacaagccaacaagcaaggtgcagtggtggttgcctaggaggctgaggcgagaggatcccttgagcaccggagtttgaggtggtagtgagctatgattgcaccactgcactccagcctgggctacacaatgagactctgtctctaaaaaaaataaaatatctgggagggaaggtgcttattggtacctgttgcaggaactcttggcacctgcatacccactgacattccaggaagtcagggcagggtgcagggagaaatgaaggggacattaaataaatgagtgctgtgggcattcagtggtgcctgccattgtatttgcaggagactgagacatttgtgtaggagtcaggtccaacagccagactgtgtgtctaaatcagaaggtggactcttgaagcacaagaactcccccaggcctccactgggcatgatgcacccacaccctcccctgccaaccagtgtttcttgatgttgtatggttattctaagtaccagagtattctcatttctgttgaacatcagccatttgaataaagatcggaaggcagtgtggagtagtggaaaaaattctgactttggagcaaggtggacctgagtttgaatcttggttttgccatgtcctagcctgtgtgatgtggacaaatggcttgaaattggtggcccaatttcctcatctgtaaagtgagaggcatcataagatcttccttatggagtcattgtgtgatttgaatgaggagctggctgtacagtacctggtacataggagcaatcagttgctggtgttcctctcctcttccccactacactgaaagaaagaaattaatgcatatttgtgttttggggtggaggtttcattcacccaagaaatcatctcaccttgactgttttcaaggtgtaaattgtgtttatagtgaaaaagaagacttggtcatgataaaagccagacactcgtgggatggcctgtaggatatagtgggcccagactgcctctgcactggggaatgcatacatcttctcatgtctcaggacatcagattgcattgtatcactctggtcttcatgtgtcagtgatttggggtgagagtaggtatgactttttcccccaagttagatgacttttcctgcctttgtacaccattaaccccctccctctgttggttagtattttctcaggaaattcatacctgagccatgcatgaataataggcacagtgacgtctgccatcacagccaccctctggccaagaacgactgggtgcttggattttctgaaccatgactccctctatcaagataactcatatatgcactttgcaaaacagttttataaacttgtaccaaaaggcacaggaaagaaaaaatagaaaaatgtatacccttttaaaacaacattggggaaaaagtgctatgccttaaggacgtggagagcacatgggggaaaggtgggtagggaggtttgcttgtgtgtagtgtattaggacaaggcagagagtgtagtcattggctaccatgacattctccttccctcaaaaatgcatctcaggctatgggagaccatcctgctaagcaggtaaaagggacgcattttgccagcaggagagagaagtttgggttcctgtaattctgcccaggtgtttcctgtcaatgagtgtgctctagcagggcagcattcaaactctggttttttattgatttttattgtttgttctgtttgtttttgttttgttttccattttctcctccatcctgtttcccagggagccctcgaggagcagctggctctgactggggatggtgcctacaatgcgcactttggagagagcattgccagcctggacgatctggacaatgatgggttcccaggtgagtgagtgctcctggtgcacggagcccctccaggtgcagcacgctgctctgtttcagaggggcagcctgctcgctgactgtccatctctagtggcatgctcctgggtctactgatccccttcgaaggcccatcaatgtgctgtggggagataggacacgtttagaggtgctctccctgtagacacgcagggctgagcttccagcccactggagttttgcctctgcataatcccttctcaccagctcagtgttctttgttgtttgcagtggaagcaaaccttggggctggtccatttgggacttcttatggcaagaagtttgaatagcttcatcctgccatcaactctccttgtttctgagcctttgatgctccatcatgctctaccatgttgatggggaaatgagtgaggagaaaattagaaacccagacatcttctgcctgattatagcagcagctagattgacttttgagagtgtacgcgtgtgtgtgtgtgtgtgtgtgtgtgtgtgtgtgtgtgtgtgtgtcttgggaggcatggaggcatatgtacctaatgtctaggtctgtttggacagcagtgttcctcacagcctcttggcctctctctctggcttgtttgagcctcttcacctcgctgcatacacagcatacagacgtcgggaggcagagcaaccatgtcaccagggcatgtggtggtggaggtggggcaacccttgcccaggccagccatccagacgtctttgatacctcctaccactggctacagtgggcttcattttcctcccccttggcctcacttctgcagacacatgactttgttagaagcaagggaaaaaagttaggaagatctaggttttgttctaggagttgccagtttgtgagagtaatgttatttcttgtgtgtgaagtgaatgcccttctgtatatttcctttatccaggaatggatttattatcaaataataataaggaatggtcctttatccaggacctcagactttctcagttacacaatagccattgtctatggaattctccctgatggaaattatggcacgtagtttatatttgcatttcttttattggatgggtcagtggtttttcttacgagcataaggtagaaacttttttggaactaaattcttctcagtcagcttctatagttttcactggactttttttttttttttttttttttttgagatggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccaccacactggcctacttttttttttttttttttcctgctgagggatcttgtccccaaattaatgcttgaacaatcaacaaccaataatttctggtatccagggactcagacatgacaaccagaattagggaagctgcacttgtattattaatgtggctttttaacccatagctgtttttttaccctcagatgtggccattggtgcacccaaggaggatgacttcgcaggggcggtctatatctatcatggtgatgccggtgggatagtccctcagtactcaatggtaattagtgtgagagtgatatggcaactgttcatacattcattcagcaaacatgtatggaaccttcattatgcaccatgccctggaggtacaaagaaaaacatttttcttgccttggccttcctacccttttgtgaaagatacaattaatattgcttattaaatactaaaaaaagcattcttagaatcccaagttcgctaacactcagggatgcattttgcctaaagaagataattttcaactcttactcagagttggagccatttatttaagaaaggaaaggaagctttctctttttggtgactactttgtcaaccgtctatgctaaggcaaaggaatatgttttaatatataatctagaagaaaaatggtccatggtggaggggcctgaaactgatcacagactgtcgtcccagctggcctcaaaaccaggagccagttaggactctgcgcttgcgccctatacttgggaacatggaagtggtgagttctgttttttgccgtatcagcttggtgttcaatcttgctgatggtgtcaagcccagcccatgggaaaaaaggaagtcatgctctcagcagaagcattgtcaggatatttgtggatgtctgcctgtggagtggcactggctctggtctttctcccagtgggtcagagacagaaggggacacacattgagaaatttccaatcaacaaatatttatttattgaacacttactacatgctgactacttcctactcatatgtatttgtattttaattttaagaggcagcaggtaaatgcaagtacaacttctacatgaataattgtccttggcagatagagataaactagttaagggtggagggttggttggttgtcattcgtgcctcagatcccctctctactggcctcctgctgagctcagtgcctcacctgcaggagacagggctttgggaggcgctgcgaagaggagggactgttttttgggtgcctactctgccctttctttacctttaatcctcgcagcagccatgtaagatgggtctgtttattatccaccatttatttatccacgaggcccaaggaggttatttaacttgcccaaggtcataagtggcagtatggccacagaatctttgccagtctgctgcctgaaacttgttatcgtaaccaccatcctcaactccacattgcaaaaaggaacgctcggaaactcagtaggaaaacttacgaatatggaaactattttgccatgaggcatacatagtctgaggggcatttatctatccagaccatcctcttttcattagaagtacataacaggagattaataaacttcggtgattcagcccacaaggcaggaggaagagagctttgggcacagtttgggggccacatctgagtcacaagagctgccctaggctgcggcagggatgctcttcccagggtgacaagctaaaagtcacccaaggagccccgtgctcgggcagcggtcagggtcattctccacgcatcctccgggaagcttgttttcctggacctcggaagctaatcacacagtgaggcaacctgtgagagaccccagcttcccctcctccggggccctcccagtgttttgtttggttgctgggtggaatccctgtagagaaccacagtataactcttgtggttagcgtggagcgtctttagtgggaagcagggatagcatctggaccagcctgcctttgtcagcacgcaggctggctcctttgctttgacaaagagaagtggttttgggctcttaaggaaaaaaaaagaaagaagcaactatgactgtacgttcccaagctgctaatatgcatatgataagggcagagatttaaaagaaaaaaaattctttaatggcagattcttgcaggcccaggtcctggacagagcaggcattgtgtgggtgaactagaggaaggaatcagaaacaactctgggcaatggaatcactttgctttggcccagatttgtattatttctgctgggtaaattgtgagatcagggcctacacttcttccacattgctctttaactctctctcgagtttaccacggagagtgtttattttaagatccttgtgtgcctttcccaatgtgagagccctctgggcatatggcggcccctatgatccttctcttgctggaggggacactgcatagaaacctggtcaagtggaggtttccagggctcctggttttcatttagggttattagcactgggcagacttatcttcttggcttttagcataatggcctgcagatgtctgtgggataacttaagcctgcatcaccaccccagatggaccaccccttcgctctgcccctcgtcccagccacagcataccttagaaatgtagatccaggggcaggctgctgctagagttcttggacttcagagccaagagggtctgcttcaaaacgtggcttttaagaaatgtgcagacacacgtacatgtttgtttagacagagccatgtgggatgtagggctttgcctgttagtgtgaaacatttcttcagtgtttcctacagtgttctgatttgtactttggtgcttggacatttcctgttggatggcttaacggaggatggcaagcagccttctctgatcacttctaggagggttatttgcagttatcagctgctgggggtcagggggcatctctcgtgcctccatctgtagatcctgtgaaaactcccccctccttgccttcgtgacttctctgcaggatgactcgggaaagagaaggataaggaaagaaagtcaaagtgagcccctagatagctgtaaacctggttctattgtactttgaaaacaaagcatttctcttgtcctccacagtgaggacatcaggaagtaagcctcccctgggggaccatgcagataaaggcagaaggagtaggtcagaccccagaagatgggacttttctgattcaagaagttcagtatctttgtgaggaactgcgccacacgaatgttgatgcgcagcttcagtgtgacaaaggctgtttgtacaataaatattgttgaatcagtgctgcctgtgtggatatgtgatgaacttaatgatgaataagaagtgagcacagccaggagtggtggctgtaatcccagttccttgggaggctgaggcaggaacatcgtttgaggcttggagtttgaaaccaccttgggcaacatggcgagaccccgtctgacaaaaaaagtaaaacagctgggtatattggagcatgcctatagtcccagctacttgggaggctaaggcgggaggatcacttaagcccaggagtttgaggctgcagtgtgctatgattgtgccattgcattctagcctgggcaacagagcaagactctatctcttaaaaaaaaaaaaagagaaagttttttgtttttaaaaaacatataaagtaagcatagatgctagtgtgtcccatggtgaagttgtgaactctggttggttgagggggctgttttctagaggggagggcagggcatcttcttcagctgagtgcttttgatttcctacagtttaagaagtgttcaggaccatggagttctagatttactgggtaaaactgttcactcctgtctgtgaagctccagaatctatagatcatctggttggctggatggagaggtagtttccacatggccatcttttccagctggacatgttaattacctgtctgtctagggaaagactctgtaatgtgtgcctcttaggagcagagtgttaaatatttagtacatatttgggaagaaagatacaagctaaatatgttcttagaatttcagccagctacacctgtgtaaaaacaaacagaacctgcattaggaatggaagttaaactttatccattttgaatttcaacatgtcaaaacattatcatggtagtctaggtggatttttttcattaacacagaacttagaaaaaattttaaatgatgacgtttggccaagacaagtaataataaaggagtgtgtggccttcaactgcctgctaaagacttgctgatcacattaggattactttttttttttctttcaacaactttaagaccaagtgtcctagggaagctggaataaagcagtcacagttcttatttgtgactgtggtcttttcctgtgactccatttccctattatctgtttcagaaactgtctgggcagaagataaatccagtgctccggatgtttggtcagtccatatcgggaggcattgatatggatggaaatggctatcctggtaagctgtttttctttaaaggcacatgagataaatgaagataaatgcatgaagtagaataattttcagtctggttagcaatcatcacatccatttaggattaggacaattcacacaatagaatagggtgttttgcctggtgttcaattttaaggtgaaaataatgttgatatttattttggggttttaaactgatctactctgaatggcttagcaccaggagggtggatttgtgtagtggtttctggggcggtaattctaatgaagaaaaaaagcactggccacatctaaaatggttgaatagtgaaacctcatgttttcctttgtatttaaccacattcaaaggcttcttactcttgagagggaaaaagagcagcacccccaccgccccctgcccctactcttgaaataaaatgatggagaaagatttggagttaaaagaaaaccaagtcctcttgcgtgtggacaaagcagaccttcaccattcaatgctggctggcttggctttagagttaattattgcctgtggtggttgtggctaactggataaagatacatgatttcaaacccaaccccaagtgatatctggcctaggtcaaattgcctgggtggtggagtagtggttcttcaggtgtttcaagatggagtggggtaaggtaaggaaacaacagtaagaatttgaaaaaatccagaatggtcatggaattcaggaaacatttctctaaattttatagtcatcttgcttttgagaaatatttctttccactaaaatttaagaaaactaacgcagtcttgtatgaggacaccacattgtgtatttttgtacagataggagttttggaaattcctcaagacaacagagccaggaggaagtaagggaatagaaagaagtcagtgttgaagcttttgtcccaagaaagacccttgtgggcctttttaagtttgagaaagcagttcttgttctggaaaatttgtggccatccccaaataataccttatatgggtttagcatttaatatgtacaaaatgcttccacatgcaatgtgcatctcgcagtgaccccagcaggtaagtaggatagggtgttttccccactttataaacaaggatgctgagactcattgtgaggggctgcccagagcctgcagtgcacggggatccatgcttcccagtggttcagctacttttctgtaaatgtgaggtgagcaaggtgttcacagttcacaatggatctgaatttctgatcttgtgtttttcataagggaaattgacaaattcatcaggttcttttatttttaaacatatagcaaatttaaagactattgaagaacaaaattgatacaacacccaagtggagaaattttaggaacactataattcatggatttgccatttgtttttccctaatgagggcatcatatagatgctcagtgcatttagtgatgtacagattcagaccctcttggactcagatacttggttctgtgaagtagtagtgggaaccccagggccagggatttatatggccgggttggggtggtagggagaaaggcatagaaccactggaagagtaagtacttcctaaattaaagttatttaggaataaacattaccagttaaaccagggtcttggtttatagcttaccaagtatttccatgaatttactgacttaaatatctgatttcatatatttaataaatatttactataaatctagtgggtacttaatgaatattatataatgactaataaatattttctgatttaaatgtaatgaaatattatcagcttttgaagaaggccctggggataattatcttcattttacagacagggataccatgagatactcaggtcacatagagtgaggggtggagggtgacaattccatgttcttcagaacctagagcattttccaagagtcactgaattctaggtatgtctttctctaattcactgatgtgaaaagaagtataagccatatgtgtaatctaaaatattcctgtaattacataaaatgataaaaaaggtgaagttaattttattaatttttttagcccaatatagccaacatattatcatttcaacatataatcaatatgaaagttattagtgaggtagttaatggttttctgtactaggtctttgaaatgtggtgtgtagtttacactcacagcacctctcgactgagactagccacatttcaaggccccagtagcctgcgtagggattggctgccacgtcagagagtgtggcttccattcttacaagatcattgtatagcccagacagtggtcgtctgagggctctccggcctcaaggctgggtctccatccttgtgagcgcattcccagggcgcggttgtgtatgggcttcagcaagtttctgaacgctgtaaacttctcattttcagatgtcactgttggagccttcatgtccgacagcgtggttcttctcaggtgagaggccccactcttgctccttgaattgtgctgttcagggtgagggatggagccattcaccattcatgggctctttcctctgtcctgttccttgtaggctggaggtgcttagtaagtggaaatgctaccttattttctcattctaattattctctatcccagagtttctagctgtggccttgaatggcttgcaggtatgagatgataacatcctgggagcttctaggtaggggttggggtagcctaactcttaagcctaaggtaggggttggggtagcctaactcttaagcctaactcttaagctatttgcttttggccaagaaccttccataatgtgccataaaaatattttataatttcctgcgggtgctgggaagcactgttcattctgtctcttcatctgtacaccctgcatttgtacctccagtcagtccacaacaccctggggaccgggagcctcctgcccgttagacagcacgtcattccctgttggctgcagaggtgagggacatgagctgaggcccagagcttgctgaggcccgtgcagtctgcatctctcctgcaaaggccagtgggccgccgccaccacccgtgaaccctctccaagtatttctagctgtatgagtcagaggaggcagaattacactttggagtgggagccaattcttaggttttgttaataacctgatggcagaactttctaaaatagactaataggatctcagagctggaagggatcccagaggccatgtagttccacaccccagatccttcttattcagcggtaccttctgctggtctccactgcagggctacacagcctcctgtttgagtgagatgccccatgagtgggagcccagttacttctaagggaaccagcttgccccgggtaacattaaatcttgaattattaaagaggcagaagagccttgaggttgaatgtgaactcaggggccaggtggccgggttccagccctgactctgcccttactaggtgagtttcctgggcaagtcccctgacctttctgtttcaggattctcctctgttggccaggacagcaatacagatgctccttgacttaggatggggttatttccagataaatccattctaagtcaaaacatggtagtttcaacttaggatgggtttatccagatgtagcctcatggtaagtcaaggagtgtgctgcattcctatggcttttgcaccgttgtgaagttgaaaaatcataagttaaaccattataagtcggggactatctgcagtacatgtaaaatgttcagaacagtgcctggtttaactgcttaataaatcttagcaagtttgatgtaaattgggttaaatttgcctccctaaaattctgcttctcagtcttgtgtcttttatgtagcaaccctttagtatctgaagggggcaattgtgtcccccaagtggtgacttcactaagataaggcctccctggttcctgtaattatttcccatgtgactggattttcactttctttatcagcgcttcctctggataaaacagcttttgtggctccaaatgattgaggttagatttgtgaatctggttgctctagttggtgctttcatgatgtcatctttgctctcttcattatcctgagcatcttactttggtttgtcaggattcttctcaaataaaacacactcctcaacttttacagttgaaaacaggcttttttttttcttcttttctttttttgagatggagtcttgctctgtcacccgggctggagtgcaatggtgtgatctcagctcaccacaacctccgcctcctgggttcaagtgattctcctgcctcagcctcctgagcagctgggatcacaggtgcacaccaccacacctggctaattttttaatatttttagtagagacaggtttcaccatgttgatcaggctggtctcgaactcctgacctcgtgatccgcccacctcagcctcccaaagtgctgggattacaggcgtgagccattgcgcctgacccaacaggccctcttaaaaccggggccatctggctgaaggtccatcatatagactctgctttctcatcattcttgtgttttttaatcttcctgctgtgagcttaatccaaagggtattttctttttctcttcttcatggtgagggacagccttctccaggagtttgctcacatatggatgtaaagtaaagcgaggcagttacacaatgggtgggagaccccagactccagcctaggatggagggttgaatctggtgagttggagctcaacagggacaaatgtaaagttcttcaagaagaactccagggagagcacatatcaagagaagagacctaggagaggagcctggggagccctgccctgaataagagcatggaaggcccaagaagagtggtcgggccatgacagctgtagagtagcatgcaaggatgttgtggtcacaataatccattatcttattcattcagctaaggtgcattgacctgttgagatgcagccatgcatcagatcctggggatttgatgggaaacctgacctagcctgtgaccttagattatagccagagagccatatgcaagtgaataataatgcaaccaatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagatagtttccttgtgcctctgtctggtcatacccctctcctgatagacaaccactgttctgacttctatcaccatagatccatcttgcccattctagaatttcacattggtgggaatatacagtatggactcttttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgattccagatggtggtaggtgctgtgaggattctaaggcagggttacttggtcaggcagtggtgtcaaagtcagcaggaagggccaagcagagtgaggcctgagacttgttggaggtggcagggggaggtcaggggtgcccttggctgtggtggctctagagaagtgatggggcaaaagccagatggcagtgggtgggtgagagaagaaacaagaaggacagtgactcttgactgcttctccagaagcttggctgcaaaggagcaaatgggaccagcaggtagttcagggaggtgttttaaggacgggaagctctagatcagtgattaggccaagaacgtctttgagccattttctggtctcccaagtcccttaccctcttggaagagatcagaggtggtcaccctcagcttcgccctcatctatgtgaaccctgatgccctaaccctgtgcctacacccaagggtcctggagaggttgaagagacaagagggaggatgggaggctgctccagggatgagggatggggggatgaggttggtgagagtgatggaatctggtacatgggctgggggcgaggggccctcatcttctgagccaggccccaagataggaataaggtcagagcaaggttcagttccggtacatgggctgggggcgaggggctctcatcttctgagccaggccccaagataggaataaggtcagggcgaggttcagtttgggatgtggatgaggatgaagcagagggtgaccaccctggtctattccaggaggacaagggaatcagggagagcagggaaggcttcaaagacaggctggagcccctaagagaggaagcaaggtggggcaggcaaaggggttgctgagcatgtctgaggggccagcaggctggatgtctgcaggggcagccgttgataaagtcccaggattcagctgagcagcagtgaaggcctggaggcatcagctggctatgttaagtaggggcttggctcagcctggcctaactgatgttagattttgagttactttaggttttgggtgggactagaaaagcagggagagctaggagaccacgcatgtgcaagcacacatagatatatattgcccatcgttcctaaccctcctaagggcaggaggccagaggtatgtgggttaggaatgctatgggctgcagctaagagaaaacctggctgaggctttcaactatatgacctcaaattagctccctggaggtaggtggccccagggctggcttagtaacctaacaatggcaccagtggcaccaggggtgaaggctctttatctgtccttgccttgcagaaggccaaggcaccttgagcaacatgtcaaagggcatcccaactggttgtattatttaccttgaagtgaagtgtcaggatttgaactgtcagccctcagggagaagtgttccagctaccaggtttttttttttttttttttttgagacggagtctcccgctgtcaccaaggctggagtgcagtggcgcgatcttggctcactgcaagctctgcctcccgggttcacgtcattcttctgcctcagcctcccaagtagctgggactacaggtgcccgccaccacacccagctaattttttgtatttttagtagagacagggtttcaccgtgttagccagtatggtctcgatctcctgaccttgtgatccacccacctcagcctcccaaagtgctgagattacaggcgtgagccaccgcgcccggccgctaccagcttcttaagaaaaaaaaagcactgaaagcacttgtgatgctgtccttgggtgctcctttgcttttatctcagaggctggcaatttgtaggcaggactgtgagacgcagtctcccctgcccccaggagtgtggctggcccactctgccctcaggaagtttgcttccctcagattagctccggggcaggtcctgtgtcagggtgataggcacacggtgctctcccattgaaggtcacaggaagcgatcagagaggcctctgaaagatttctgggcttttcttcatccaaaaacaatacttggagttgaaacaaaaaggttgaagggaactgatccgacagctgtgggaaggagatgtacctgtgaaggtccctgtggtccatttcaaaggatactgtttttccaacttccactgaggtcactgtgtctgggctgcccacgtctgtttcctgcctgccgcactgtcttctgcagagctcttttgtgagaggaggattcggcctcctccctgacgaggtggcccctggggatgatggggcgggctaggcttttcttctgtaccatgaccaggcgcgtcagggaccaggcaaggtggagaccagctcttcatggtacttctgtccatctgtgaggctttggacactcgtggttttcagtctcctaggctggagtaaaatttgtatttatttaacaagggtgtttgcacatttattatgggaacgagaggatgaattcaccggatcccagcccttgcagggtgctgcaggatggtggggcaggtttggaaatagacaatgactgttcaccttagtaagtgggggccagaggtgtgtgtacagagctggaagcacagagagggaggatgcctgtcaggggtactagagaaggcttcctcagggtgggaacatttgagctggctgttgaaaggtcgacggggttttatagggtgtccattggcatctgcacaatcacactggccaggggtaagagatccactttccgatttatttctagtatcctataaggatgaacccagaagaaaatggaaagactaaggtgttggccttctttcaggcactgctattgtctgacttccgtttgtcctgtggccagatttgctctggaagtcccgcagttccactgcatctgttatcactactctctgttgaccccatctcccagcatggtggcagcagtggagtcccctcaccctatctgtgcctcgtgtctcttcacttcctttgttcacccagattttccttaacgctttcttccattggagttggtgtgggtcatcattcccatccgccctatcaccctgggctctctttgagggatcattgtacacaggggcatcattgttctcaagctactaatgccccttaatcttgttatgtcaccccagtggtgtgaaggccagggctccttagaggtaaaagggtctctttgtgaggcctggaggggagaaggttgagcagtagcttaggtgaatgctgcctgagcagatgtctgcagtgggagcagaatggtgtgatttactctttgtttttgtgggatgtccttggggagcccaaggactgtccattcatcaagcactgggagatggtccatggcagggaggagagtatggctttttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactggatggggctacaacattgcagttcatgctcataatggcagcaaatgcttgagggaatccctgagtatgcatctatttcttgaatcatggcatctgctataggaaatcctcttaaatgtattcttatctccctaataaaatggaaattggtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtctagttcttgtttggttctgagagctgctccttaccacgactaagtcaccttcctctcttgccctgcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggtaatgagccaccaagtcagggctcaggatacccgtttagctggagtgggctagtgggatatttccgatgttccctgtcgctgttcctcccagctggttttgcaggcagcaggcacacaggctggacatcctttccctctgaggttcctccccttctatttcctgcttatcaacatgtttctaatgtcacacaacctccagctctaggacaaataatgttggaccccaagcattctttttgcaaatatgagggctagactgaagcctcattggaccacaggtcctatgggactggtggagatatagtgcctggagcctggcccttagggaacattcgagcagttagaaagcagaagtgacaggactttggaggctccttattgagcttgtagcatcagccagatgtcaggggacttataccatttactatggaattggagaccaaagatggatggtgggattcggatgctggtgttacagaggcttaggtttctaaaagaggggtgctgctttggcagctcagaattgaaaagaggcaggcattgtcctgacagctggtaactgtccctgccatttgtctggctggggaaaatcaacttgctagcccagctctagagactggattaaaccccagaacaagatagaaccagtgttgattggaattcagagcacgtgatcacctgaaggaaatgaatctggagctttatgcatattactaggtgcttcatttttatttaaaaggctgatttaataatagaaagaaaaactccaggcaaacaaaaacactaacggacctgaacctactgacgttcttagatatttttaatgtcatgagtgactccttttgctactcacagtgtagcccctggcctagcattgtcagcatcactgggaacttgttagaaatgcaggactttgggctccgctttggacttctgaatcagaatctgcattttcacaagagccccacaagattcctgtgcacatttaagtttgagaagcactgctctggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaacgattaaacatatttattttatcattttttaaaaagagcttagaaatttcaacattgaatgaaaccataccataaaacttgggaactggttagtgagggaggattaacaacattttcttgtgcagctcaatgagaaagagcagctcactcaagatcacacagatattgttgaagccaggagttgaatttggatcttatgatacttagttttgctttctaacaactatttctcaccacctccataattgtttaagatactacagtcttaaggaaaaaagctttctgatagttctgggactcgtgtgtcctccacataattaagcagtctgtcttctgtccagtgccagctcatcacgtagttggactctgttaaaaaacatttttaaagaatgaagattaattttgatacacataagaatgagaactattctagaactctcaaaaagggcaaacgagtaatagtgtctgtgtatgttcatttgacacatgcttattatgtatccacatgtgccaggcactggagatatagtcctgccctcatggagcttctaaagggagttacaaagagtttctactattttggccttgaagcagtgttagacaacgttcacttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagatgtgggtgcctcctcatgctgttcccgaccagtggctctttctggggccccatctagcatgagcctttcacagactgctaagcacaattagaatgaaggtctaggcttagccatagccccagaagtgttggggtaaagtggaagaggccggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttatactctaagggtgtgtttccccgataatcaggcttaaaggggatggtaactggagaattttgatatctcagtataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagttgggaaggtcagtcttcagatggaggaaagatgggcacttccaggacacagataccctccactcccatccaagctcagcagagggtgctggccaactctgtcatttccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttattaagacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggaccagctcattagcgggacacaagctgctgtagcctctgtaaatactgtaggaaatacagactttctctgtaggaggtgaatctgccttggcctctgaaacaggcagagtccagtcaggaaaacaaaaaccataccagttattttaacagaggaaatttagcactgggaatgggttaaacaggtcatggacgacctgggagtaactgcaggaagcagctgccgcctccaggtctgcaccagtggatctcaaagtgtggtcccagaccagctgcattagcatcacctgggatctcattagatatgcaaattctgactagaaactctgaaggtgggacccacatctgtgtttttacaagcctccagatgggttcaatttgagaaccactgttcaaggttatacttcgggttaaccacttccttggggttatcagaacctatgagcttggagaaggggccctgcggagctaggacctgaacctctgaggaggaggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctctccagccttgcaggctccctctgatgctccatattagcagagccgcacagcgagcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattctagtgggaggggggcaggcagacgggacaaaaacaaccagctgctctcttgctggcttttctagatgagctccgggccccttgtgtggcatgcactgtgcttagcactgggacacagacagacacagacttctcactccgactgtgggctcctccaggagcaggtttacaacgtatttcataaagcactttaaaataggagttcttcctgtccctaatagtattattcatcacttcattcttggcctgggaacagcctgtggccccttggagcctcctggctagcataggtgaaggtggtgaatgctttgcccaaggggaccctgcccctcacccatggacggtgcttgtacctactcactggccaggctgaagcctaaacttgcttgtcaatctctggaggctgggaatcaagctggcagttctgggctttcaccagagtgtgaaacgaaaaccaggaaggggcgctctctgagtgattgcattttgcactcagacccagtgctcctgtgtttccatggttagcctgaaactcgggaaggagaatttgttagaatttcacagctgaaatcttgttctgacagagagcaggaattaatcaaaacttgctgggagagaccagagctagagttgatgagagacagctggctccctcctggcccaggcccgtgcaggggggctcctcgggaagcagccgggggcagggcagggaggtggctgaaagtattactcggggctgatcagcttttccatcaccatgacatcattcgacatggcagggacacaagctgccagaaggaaaaacctaaagatgtgaaatgtgctgttggagcaggccctaatcagaactagcagcctcccagggacagacaggggctggccaggctggcttacctcatggccggctgtgggcaacttggacagcctgatccacccaccttcccagggccctgaccgcggagcccgggcagctgatcggctgcttcccagacatgtcctctgcttccctttccaccagaccctttaccagtgggtgctggtaaaactgccagttccgctcagggctttggaatgagtggtcagcatttcttcttgcctcctcaggcagggtctctcgttgtgactcttgctttcttctagaggagacagtctgatgtagaagtaatttcctttggggtaatttaaaatgtcaaaatttaaatcaaggaaaagtactaattaggcagttctagagatgaaatgcttccagaatgattgcacttggtgaattggataatgcggtatgtctgtgattgtatgttttaacattttagagaaatctgaaagtttaatgtgctggcatgcacacaccccgctggagaggagcagcagttgccttgtcctcagctcagtttctgtgaactgtgggttgtttctctcttccttgagttgcaagagatcagtacttccggatcagtacttctgcagtgagatgaaactttggaggagtaaagttggtgtttgtaaattatctagcacagtgcttggcacacgttgcaggttgaatttatttgcttttccttacttaccctgtgttaatatgggttctccccaaaacagagcctgggtcaaggatctgagtgcatgtggttgatacacaaatgatcccaagaggtaccagtaaggaaatgggacagtgagacaggaaaggaaggcagttgcaggcctcaggcttctccagagaaacagaatggagagagaaagaaatggattagttggttgattttcaggaattgggttgtgagattatgaggtctgggaagtctgaattcttgggggcaggccagtaggctggagactcagggaagagttgatgttgcagctcaagtctgaaagcagtctaaaagcagtttatttttttgggaaccttagtctttttctcttaaaaccttcaacagatgaggcttgcccacattttggagggtaatctgctttattcaaagtctactgatttaaatgttaatctaatataaaaaaataccttctcagtgacatctagattggtgcttgaccagattctgggtactgtggcccagccaagttgacacataaaattagccatcagagcagccaaatagagggtgtcttattgagcaggttaccactgtgggcagctggagctcagtcctgctggggaaccctggcagtcagtgtagaccgtgccccagaattaccccacatcaaggggcaagggagctggggccctgcattatggagggctgctctggggacttgagttccctggcactcctggcttgccaggcacatggacagagccactagagaaagccctcaggagaagagatgcaggtactggcagttgcaatttgggccggacagcagagaaatggtaaaagccaagaggatatgggtgggggagcaataccatcagttccatcttcctgtgttcctttccacccaggttttctctgagctcagctagttcatctctggtaagatagtccagtctcgctgttctctccattgtctcccttcctgagggaaggcagccattcacctgggaaggaggctggtcaggggaccccgaggagagtctgctcagcagctgcctccaccacattggttcacccaactgtggcctctggcttgtcttccagcaatgtgtatctgtagccatgactttgcttaagcgaacttggaaattcacttcatttaaatgtaatctttcttacttcagggcagttgttcagggaagttgtgatcagtagaaagtaaattggctagagttcagttgtagatctctgcacttgtttggacctgctatccatgcattcaaaaaaatgggaggttttggtcaagtaatgtacaacatgcagcaagaacaagtgtggtgggaatagcctggcaccagagattaagggagtcctagattcagctgtttgatgggtggccctctggcctggagcaagtcttgttcccttttggggcctcagttccctcatcttaaaaaatgaaggtttttgagcttagtggtctccaggattgcctcaaagctttgccagtctgaatctacccttttcttgctattgtccccattggaattggtgtgtgacacttgcacaggtgccagtgttttctgtgtgggagcactttcctgtatgcattattttcttcttaataatggcacctcctgagagtatccaggtctcagatcccttctggtgacacagccttgccttgtaagtcaactgtttgctggcgttaaacaagttggggcagatggctctgctgactaggaatttgccagctcggcatggcaagatccctgagatggcagaggcccagggaggccattagaagcatcaaaaatacgccctgtggcaggtgcagaatgcccattcaggtcaccttcctctctgcctgttcatacctcccctggtggctgatcccattgatgtcattaaaagccggagccttccctaatgcctgacttcacttacttaaatgccagtgggctcggggctacttgttactgatgcaaagcccccagattctaagaggcaggtgtgtggagacagggcagggctgggtcatctgccttctgttgcttagccatcttgccttgtcattccagggacagagattcctgttctctcactttaaaaataacatatttccttgaatccccaaaacagttaaaaaataaaaagggttacggaggggatgacctctggcacagaaaagcagtaaaataggtgtattgacactgaagtcatatttctataatgaaatacatacctatctatttacttattgactctgaaataacagaggtagatccttccaggtttatctagcctgcatttgatactgtgatcatcttttttttccttctttctttcttcttttttttaaattcaagactgtgttacaaaagttctgccatctggcatacacattcaggtatgggggtgagttattctttgcaggagaggacctcagtacaggccctaccgtggtcatagttttgttgaaaggataggcactacaaaatgtttgatcaccacactcggctacctgggaataaaggcaactccagccttcatctgggttcctgtgcatgtaaactacctgaaggcaggagtttatgcctgcgttgttcattgatacatcccctctacctttagcggtgcctggcctatagttagtgctcagtaaacgatggcgggcacatggtctggtccatgtactgattatagagcacgactcaactttgttgagatgagttaaaattatcagacgagatggttcccttgtgttgggcataaaccatgtgctttatagaagtcagtattacacaaagccttgataatttcagcagcttctggtaatgttctgtaggtttgtcatgatgttttgcttgtcaggacactaacctgtgttgggtacaccttgttaatgggcatattgctggctcagttgatacctcatgatggcatgaggtttaaatcagggagagccgtgaagtatgacacaaggagagtcattagaaaggcagaggacatcatgcttctctctcgattctttgagcaccctggctgtgtgctgctttctgagcaagtctctgcttggggctgcagtctcctgccatggaagggtaggtatcatatgagatgtgcatgtgatcctgtgacaaggaaaagaggtggcctcatcacagtgtgtcggtcctttctgacattttgacctctcatttattggcaggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaaggtcagtcctctcctcctttttatcctcaaactttgatctctgcagatgttcacttggagctggtggaaactatttttattatgtattatgtgtgctcttccaaaattttatttcacagggaggagcatatccatttcttcttttcttttaaagttggcctctgacagcccttttatttatcttactgtgttgatttcagcctttaaggggggtcgtggtggtctaggagaccagtgatggtccctggctttgacttgttcttttgagaggtttctcatcctctcccctctatgaggcttggtagccttttcagaggagagccttggaagcatgtgcctctgggtctgcagtgatgctggatcacactgcacctgatgcctttctcagtggtctactacaaattagctcatggtcacagttaaggcattttaaaactggttggactagattcttcccccttgactactttctatttattttaggatgcattttttggcaacctttcccctcgcactctaaataaacttgcaaatgtttttctcctcttgaaattgtttgttaaatacactttgctgctaattcaggaggccaggctttgattagctacagagtggcccttgcagcaggcgctggcagggtggaagacctggcagtgcctgatgctgcaggaatggccagacactgacccatgggcagggtcagagagcggaggaggtggaagaatgcacttaatccaggccacatggtgggtggaatgagcatgggttttggagacacatagatccagtgtgtatccagctggacacataattgtgacctctccctgtctcagtctctgcatctctaaaatggacacagtagtccttaccttgaaaggtggtcatcaggattaaacattacacaatgaatttacttaaaggaccttgaatggtgtctgataaatagaaagcaaccaaattattattatttggttgggctgtatataattgccaatattctttttgacttacaaaaatggaaatttcatatagctcaacccaatattgtttattagccactggatttctgactgatagtttgaaaagtctgcagattagagatgaagtgtcctcctgttagtgccagagcagaagaataacagctgcttctagatgcttcagggctgtgtatagagagatgccccacacacccatggcccagagcccatgagtccatgcccctcagatgcttctcagtggggctgggctgtgtcttctgccaggactcctgcaggggcctgcccagaccagctgcctgagggcttgggatgctggccatttataaagctgctcctgtgcctgttaagccatacagccccgccccgtcagtcttagattacattggcttgttggtgcctttggtggggtgtgaggctgcgcagtacaggctcgtatgcaaacactgtcaggcctttgaatgcctgtgattggtgtttttatacctgctggggacagggcatcttctctcgggcctcttcttgctaggtctgttcacaaaacctttcctttaggtttctttgcagcttcttgctttggctgagaagttatcctttgttcctagttaccaagggtactggctatgagatgccacgtagagtggcaatagtgaagtgcaggccagaggcagggctgtttctatggtggccctgagggttactgggaaggatcagggttgcgcaaggggttggtcctgctactttctgatatctagggttgccagacttagcaaataaaactatagaactcctaattaaatctgaatttcagatcaccaatgaataattttttagtatgagtgtgtcccaaatattgcatgggatatacttatactaaaaacattttgctgtttatctgaaatttaaatttaacttggcatcctgttggcagattcaactctgctgatcttcctctacccaacaagtggcatttcttcactcaagcaaaacctggctgccaagaagagagattgagatgatggttagaagagtttggaggctgagctcagggctctcgagtgcagatccagcacagaccttgacgtgattattttggtcattctagggagagcaaaagagcaggcctgcttcagtgaattgggacctagagtcatttggatacagtggttgcttggccattttctcatgcaaggaggtgggagcggagaaatacaccagatagacacatgtctctgagacctttatggttcaagaggcaacattgttgccaaggtacactcaaggtggctgatactttatagccatactttataaccatgagaatgtttatttctggcagttactgtctgggctgtagcagaggactgggcaaatggcagagtgcacccgtaggatgagtgctaatggcctagctagctgtccacagaggaggcagcaggcaccgccccggcttactggctgtgggaacacagctatggaagctgaggcaggaagcaaggatgaggggaaggggagtggcagccgggccacctcctggagcaggaactggggcctggggggtgttggtcaggggtcaagagcaggatgcagtctctactgcaagtggagctttctcagtggagctggctctcggctttatggacaaatcaaagaagataaataaaagcattctggcttatcacacaccatatggctagcagacagtggggccagcatgaggggctgggcctgctttgtttaggctatctttaggtatttttttctttttttctttaagcctattccaatctttttttttctccctctccttttccctggaagttttcttgccatatatggtgataagtgactttatcatggaagaccgcacaggctaacacctgttttccaggctaactgtcttgtaccagactttgttccattcaccgtattggagggcacctccggagggtataggattttgtgataaggcacatcctcctgaggggagggcaggtactttctcacggcctcactgtggtcagcagagctgaggcagctccagccacttccttggcttctctgcctcagagttcacacaccccggcttatcttccctcttccccgagaccagcccagttttggggatggggcccctcccactagccagtcaggctggaggcctctggtggatctcacagtcacaggcgaaagcccaacacctcccctcagcatcgggctctccatgccctgcctgaccttacctttctagacccatcttctgccaccacatcccctgggccccagctcttgtcatgacctgcccctttcctcctggaacctgctccttacacttctttgccttggttcttatgctcacagaagtcagaggcctggtttgtgtcatattcatgtagaaccatctaccacctgcatgatttttacatttttttggtcttaaactcatactgcctgtgatattttctttcatatttttctctttaaatcagccaacttttggtctcaaataaaataatttaaaacagaaactttgtacctttctataagcagaaaaccatctaacatgtccccaaaacagaaagtaactgtaaaaataaatatattgaagacacaacagtgtcctagaattctagctggatttcattgtttgtcaaagttgctgataaagcgcccactccattcatgtgttagaaagggaaatgatcaagttctagggaaggcttaaagacatactagcaccgcgctggaactttcttcctgatgcaaccagaaggactgcaggggaattgactgggaacaacttttcaaatatgagagttgttttacagagtcatgcctatgtgccatggaaatccaccttgtgggcccagtctgggaagccctggccatgctctgctttgatcagatgtgccttgccccatcctgcctgctgaaggcttgctgttgttcaaggctcagtccacaggttttggacatcctcagtggcagctactgtcctaggccctggggatgccactgtcatcttcctgacttcttggagcttgttccatgctgcctgactcctgctttggggatacttgtcaggcagaaccttgttggagtgactaattgggttagctggagtgtggggtcacaaaggcttctgatatggagtggggcctgcttgcctctgtctggactgactgctgggaagtgatggcttgagatgatggagaagagaatttgggatgcatggtgtgtgccaaagaataaatgcaggtgtcctgttgttactccatctgtttctggtttatgtgttcttacctggatgacagctgtgctcatcctctaatcctgtacaataccttgagagcacaggccttttgtgagatcaaatgcctatgcatgacaggcaaataagcaggctcttcaggaccagggaaacgatggcaacagttctgagtctgatgcagggatggcagagaagcccaggcagagtgcaggggcagtgatgtcattccctattgtgaggatcagtgacaccctctagaggcatttagggaactttttttgaacagaaccatgtgtcagacactgtcaagaaggccaataacggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcataccctgggatctgcccaggtgttttggcctgtttccattttcatatccaacaaaatgcgttgggaccatggcttcaatcacattacatgctgtgagtttagagtgttggatgctggttttcagaggtgatcaaacctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacaccaaccttagatatgaggtcttctgaaaacttttaaaatttgtttattttttgaatcagtagtgtgtatagttaaaatttttaaatggttataaaagttgtcaaagaaaggatgtctttcagctatcctatttttctcccaaaggcaaccacagttccattttcttaacgtgtctttcaaaagcttgtcaataaatatagaaatctgtgtgtgtacctccttttattttatgcaaatagtagtatactgtgtgcacactgtagtaaacttacttttcttttaaaacatccaacagcagaatggaggaacagattttggcaaatcgcacaaaatctagctgtaccagatgaaatacaactcagcaataacaatattatgttattatgatacacacaataacatgaatgacttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagcggttgtatggttgcatttattaaaacttaacagagtgcacacctaaaattagtgaatgttatgtatgtaaattatatctcagtcaaacttattttgttaaaaaaagtttcgtggagattattccatattggtgcatatagagctttcctgttctttttcagtagttctttttcactattccttgatttatttaacctgtccaggtggtcttctatatgtcagttccagactaacctgatctgatgcttgtagactagttatcttagtttgcttctccagaagaggctcctcttctctcccctagatccatagtatcctggctgaggacccctgagagggcagcatggaggggccctggtgctctctaaggtgaccttggacatatgtcctacagaggacaagcctctcagctatagggtgcccaaggaaaatgggagatttttcttgattcctgcagttggctttgtgcccttggcaggctctcctggtctgtaggtagcatagatggcctgaatgtttggtaaggggtgctggaaactagggcaagaaaagaggggaaggttgggatgcatagaactgatgtgtgggaaactaccttcatcatccagctcaggtgtgaagccgctgctcatgcgatatgctctgctcacacagatggcactaaggaaccgggaagctgggctttggagaccacgctggaagtcagctcactgagtgtgggttgccttgaccatctcctctgggaggccatgttgtgcatagctggagaacaaactggggatgaatcaagaagggaaagggtgtggtgaatgttcagcatgggagctgatatctccgatgagcactgtttggccattgatttatttcttgggtgcaatgaagggctcttaatcttctgcatttggacacttgccacagaggacattgtgattagcaaaggaaggcacaaaaattctaatccaaaggctttgcccgccttaagtccttttttgaaatggagctgatttaaatatgtaagtatggtcacagcattgacacttcagtggttatcgtaagcttatttgtacagtatgtgagatgcagtttgtagcaattgctatgggtaaaatttttattttaagaggtgactttctatttacagttattcatttacactgggttcatctattaatatatactgttgatgcccttttaacactggtattctttgaagtcacacatgataatgtgttctgttttattggttttgtctttatatttgagatgtgattataaagatcccttctgcctcaaaccttgaacttagatattcattataagcatgattcccttcaaagtaatcaccttctagtcattcctgttttgaaatttcttccatggtttgtttattcacttttatcatggtccatttttactctaggagttaattcaaattttggaagcagcaagatttctctgcaatcctctctagtagataatagtgtgtttggggaaaagtgaggtataataatacaggaattagtattaaggaatgtagtaattaaactccttttgaaaatgattttaaaagaattcccatgatattcaggtaatagcgataaaagcagctaacactaatcgagcatttagtatgtgctggttactgtgagtcactacatgtgagatagttactgtttttatcctcatcttactgtttcaaagacaaggcatagaggagtgaagggacttgctcacaaccttacagttgacaagtagcagaggtaggatttaaacccgcaagtctggctcctaagacttgggtttaaaccactacattgtaacacccctcataaatacaagctagaactattagtaactagtacttattatatgccagatactcttctacaggctttacatgaagaaagagaggttaagtaacctgactcaggctatgaactagtgagagacttcactgcctcttcataatagagtcctgggaccttctctgtgttaagcatatggcccccagaggtgacagcttttgggggtttatgttctagagcagtgatgtgctgctaatgtttaacaactagctcttggaaagaggggacatgacttttgtagcattttgcaaatttccctggtgtaaatattcttatcatgtctgatttcaagctaccaatgagacatcactgaatgtggagttaggaagagatgcacaatagcacacagttgtttagtatttccaatagctctaaatatctttaagagcatagatgatagtaaagtatggtaaaataattaggaagttatgagtgttgagtatttattacatttatcttaatataatttacttatttttaagtttattcaatttaacttttaataatggctgtgtttaacaaccctggctcataaactttctgaaaatttaacagttggcttttggaaacccactgcagcaagctccagcacacaactgaatatgttgagggtttttttgttgttattgttgtttttaattttagattcacaaggtacaggtgcttgtttgttccatgggtatatcgcatactggtgagtattgggcttctagcatgtttgttaataagttggtcatatcactcaagtcatgcctgatacacagatgtttgattatcagagtcttttttctttcttgtttcctgtggctttttaagttgatgaataataggaaagtaaatttgtggggtcagttaaaccaccagacgacagcttttatgtttgtacattggttcagaggtactctgtattttgactggatttattggatagtgtaattgtttccatttaaaacaatggaaaagatttcatttaaatttattgagatcttatttttcaccctcattccgtgcacatttgggattctgttcgccagcccctctgcactctgaagatgcacagcagcctctctgtactctgaagacgcatgaattgctgactgttgggcttgcttggaggggactgggggttattacctcccacaggactgtttaagctctggaagttttcctacctcctgcaactgaatttagtcttaattagtacagagtgaactagctgtgaacaatctggttttcttgctttgtgccttgatcatgtgagacctaagggctggtcctgcccttttcttatccattgctttaatcagaaataacatatcaaggtggcccaaattgtgtcactattctttcctttgtcttctccacccattcccacggcatccattcctaaggtcatttggagaattctctgttccaataagtgggatccacatggctcaaggagcaacaggccttggaatcactctttgagtagtagctggtccctcagtctaccccaaagagctgcctcgccagacctccccacctcccggacatacagactccagatgtggaaaaagcccttgccatctctatcctccaacacagagctttggtgtccgagacacatccaagtgacaggcccaagagggcctctgaatgaagacggatgagccgtgtggacacagccacactatgttttcgtgaaggcataagaccatgggccaactttctgggcatccagggctggctgcagaggctggagtgagtggctttcaaggcaagactgataatgaaagtcgtgtttgggtgggaatcacaagcaggggaagtgggggagccagcttcccttcgtgctgtgtgtcacaataagataggacacagatgcaaaagcagatcgctacagctggatctgggtaaaggtggcagtgacgcgtcggtgcagagaattcctgttttgaggaaagattcggagccagctaaggttttctgagggcccgtcatgtctcagactgtcacacttattcctctgtcatgtatgcttaagtctgttttagatgaccccttgtaaagaaaggaagcctggcccctgaagcctcattgcgtgggataaggggactaacatattctgtggttgtaccagcaaattattatttatttcttattttataaaagtatagattttattcatgcctatattgttagagaaaatcattatttttagtcaacgtattagtattaatatcatggcctcttttcttctcattttggaaggggaatatttttagactctttaatgagagagtcattttctcagtaaatatttgattggcctgaagttaagtgggtaggcgtaaaaaattatggaagtattggacttgagcaaacttttgacaaatagcgctctctttctctcttgggcgtatgcgtgtgtgcatgcatgtactccagctctctgtgtatgttacacacacacacgtttttcgcataaaacatttttattttgggccaggtgtggtggctcacgcctgtaatcccagcactttgggatgctgaggcaggcagaccatctgaggtcgggagttcaagaccagcctggccaacatggtgaaaccccgtttctactaaaattacaaaaattagctgggcatggtggtgggtgcctgtaatcccagctactctggaggctgagacaggagaattgtttgaatctggtaggcggaggttgcagtgagccaagattgtgccactgcactccagcctaggagaccgagcaagactccatctaaaaaaaaaaaaaaaaaatctttattttgaaataatagcagtcttacaaaaaagtcattaggatagcacaaagaaataccgtaaattcttcacccagattccctaaatgtcatttgctttgtaattttctatctattcgtacttcttacctgtttgagagtaagtcggagacgcgatgcccccttatccctaacatcagggatatttcctgagaacaaggacattcttttacgtaaccatagcacaattattgaaataaggaaattaagtgatacattactgttagcttatctgcagaactcactcaaatatcaccagttatcttcatgtccttggtagcaaaagaaaatcccgcactattgcatttggctgtcacatctctttagtctggaaaagtcactcagccttgctccttcatgtccttgacatttttgaagagtacaggtcagtttgtctgtttcatcatgattagattcaggatgtatattttctgcaggaataccacagaatacttgtgtcctatatatttaaaaacatatacatccaacatcactgaaggtatgtatttttaactcctcctttaaagtggttttccaaagttagttgccatccccaaaagggagcttttagacattgagagaggtgattatgaaagtacgatagcttgctcaccacctctctcctctgctcctgggagcacaggggagtttcaactctggggaaggtgatcatttgggtcattagtagcgctttgagtaccatggtgtctgcagggagttcccagttcttactgctgtctgagaataaaacataatatctttggtcttcacagaggtatcagacaggaattccactcagcttgcaggaattgagaccccaggacaggggcttaagcacatcaagataatttctctctcttctagaggaagagaagttgctgatgttggttcagtgactcgaggatgttctctgacctttcacttattcaggaaatgtgcattgcatacctattatgccgtaggctggggggccctcagctctgctgtgaagagacaaggatccttgtccccctgggagtttatatcccagtagggggagacagacaatagatataataagaagaaaattaaggtgcattagaaggcgatgaggctatggaaaaaaagaaagaaaatagagcccagtgaagcgggtttgggagtgcaggcatggggttatgggggtcagggtgacctcactgacgaggtgtgatttgagcaaagcatggaaggaggctggggagttagcacagcgggttcctggaggagggctcagaccagtgtctgagtgtctggtgtgtctgaggaggagcagggagaccagtgtgggcaaagaggtcagagtggcagtgatggttgtgagcgggtcatcttgggcttcctaggccttgggaaggatttgcctttactcagagggggatgggagtgtgtgagggatctgggcagggtggtgacctggcctgccttccatttttacaggcccctgctggcggctatgttgggaaggcctgtaggaggcggtagagcagcaggaacggggttaggagactgagcgttacccagggaagagggtggctccactggggccatagtggtaacattgtgagaagtggtcaaattctgcgtgcattttgaagggggatcctacagcatttcctgagggtttgattgtcagttgtgagggaataagatatcaagggtcactccaagcttttcagcctgagtacctaaaaggatggagttgtcactggtggtgttttcaacggaaggtgcaggtgagcaggttgaaagggggaagatctggagtttgtttttagacacactggtagatgtttaagtgtgtatgcgtatgtatgagtcttcagtttgagtagtagtctgagtaagaagtatcaatttgggagtcgccagcagacagatggtatttaatgccaggagatttgatgagatcacccagggtgtgaggggagatagagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacgcattgaccatccatattttaaaagaggttggaagatgtctaagtaccagctagacatcttataaatcctatcactatagagttttgctctccagcagaactttctgtgatgaaggaaatgttccgtatcagcactgtccaatatggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcactagtcacacagatcaagccacacagccaaatggaaatacaaataatagattgaggtcacattgactgtttcacgttgtacttagacatgctgattaaaacctgagttgcaagtgtgccatggaacataatctctccctctagtgttttggaacaatcacacacaaatgtttatatccacatacaggccccatatacaatgggggaaacagaacagaagaaggttggatggttcaccaagttgagtgggtccttcaaaggatgtcaccatcttggatgtgatgttttctgttttcagtggcatagaactagataaaaggtggcagtgcagaggatggaagtggtattgctcagtgggaaagggaaggcattttaggtttgagacatattacaatattgccttttagcgtagaaaagccctccttcctgatgctcttgctagtgctgggtggaaagattccctttcaactcaacatgtgtgaagcacatgaactgaagcactcttcctgcttagcatggcaggggctgggccaggccagggtggaccaggtcttgctctgatcaaccacatggtctcaggcaagttgcttcacctttactgctgagcttcagtgtcctcagctgaaatggggagcagaatactgacttcttagtaggggtctggtaaacactgggccccttttcccttctgctctaccctgcaaatcttttcctctttctaactgcctctgcatttggaaggggtcaagactcgtttcatagttttttgggggattaaaaaatgattagaagcagatggtgagaagaaaatagaaagtatggagcaaataagaaatgtgggaagagaagagggcaaatggtaaggcagctctcggagctggcacgttctttctctctggaccagagcaagccagagcctctcagtcatcttcacgggctggttgacaaggactcctcacgttagcgtgcacacgaagaacctgggaccttgttcaatgcagatcctgatacagcagatctgaggtgaatttctagcaagctccctggtgacgctggtgctgctggtccatagaccacaaagcaaggagctcgaagacatagataccaaaagttacaggggaaaacggacaaagccaccagctggcagttgatgcaggtatcagaagcaagtgggcctcggaggggccagatgcctctctcctcacactgaccgtgagagcgagtgctcctcatcaacaacgtggggccaggcttgagtcagcagcactgactttatgtgacctagtgcagctcgccagcccacgctgatgtgtgttaatggagggggtgccccttataggagggtggtgtgggctataatttcttctgcattctctgcctattgcttgaaggacagtgttgtcagcagtcaactgactgagcttgacttttcagcagtttttttaaacttcactgcagtgtttttggacacagctatgtcagaaatctatttccccttctcagagaccaggaagctcttgaggtacaagctcttattaagcagaaaattttaaagtggttttccttctccttttcttgggtctgctttcttggggcaaacagaatacgagaagccagcttagaaattgcatgggtccttcctgcattttgtgagaaaatggtggcctcctatatttcttccctgacaggttactgtgggccaccagcctccttggtgacttctgttttgcagatggggaatttgttgattgtagtgagtacgctgtgtgcggcagaaaggattctgtcacctacagagagctagggaagcgcccaggctgaggaaacccaccccttcgaagcagccatccataggtagcctgggggtcttttcacaagacagccctagccccagttcatgggagttggaacaatggtgggtccaatggtggatgaatagtttattcacatgcatcccaggagatttgtgtgaagagggtgacagagagttgcttcttttaaaaaaaatgtattaagggctatgtaaataaaaagaagaaattaagttgtaacagtaacaataatagctatcttttattgagcatttactatatgctacatgttttacatgtacatgaagtccttataaagaatacaattacatatgttaatatgtgattatatacagaaaattgtatcagaattatatctacatatataaaaataaaataaaatctcattttaccattgagggatctgagatttagagcatttaatttatttaagatctcacagctggtaagcagccaagtcttgggtttgaatcccatccagcaaccaactagttctatgactttgaatgcaaaagatgatggcttttctcattattattacctagttagtctgagaaagagaaaactccattctggatggcccatttctgggtggattggtgctaggtttctcctggtcttggacgaggttgcacttttcagccgctcctgtgcacgtgtgtccgtgctctgaggtgggaggaaagctcaatgtgggtctgtgagtccagggcaggcaggagtcctggggactggaggttctctgcacttctgtttgatcttccctgcctgtctgtggcctctgcagtttaaacaatgactgtcacttaaacctcttctgaagagcttgaagtctggtccatgccttcagcccaccagcgtgtgttgagtacctgttgggtacacagctctgtgtctggtggaggggaaacaaagattaaaaagactgggccctgtcctccaacagctcaggttatttcatgcctgcattcggggcactgtcttacttggcctagtcccacacttgtccctcccaccccttgcttctctattttcaattcacttctgtttctacacacatcagtgatgcagtgtcctatgtacaggtgtgcctgggacagtcctggtttatgcctgttgtcccagcataatcattaatagttctctatttcactctcaagtgttccgatttggatggcaccctatttattgagtgctcattgtgtgccagacactgtgctgggcccggggcagatggagactcgtaagccataaccgctgcctcccaggagctagtctgctggggcatccgttctgaataccatgacttggcaagtgaagcattcccatgccttccagactcctggctctgcctgtgtgaaacgtactccatttccagagccagctgccgagctttttcccctgggctgactttccaccaccctgacctgcgattcctctctgctaaccctcctctcaccgttctccccagggtgggctgtgggccttctggtgctgagctccctcacatctgagctgtcttagcaccttctttccgcctgtatttgtgttacttggatatttgtgttttatcttctgtaccagagcataggttattttaaagcagggagcttatggcattcaacactgtcaccctgggaataggacccccaaaacactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgagcacacacacacacacacatatacaccccataaccattttgaggtcatttaataagggattgctttctggataatctcgctccttgggtataaatctaatgtgaaagggcaggggtcagatatttaccccaaagggttggtgtgaggataaaatgaggcattgcttttaaagtgctaagctcagcccactgaaaaatacgcaaatgcatcagaagagtcctctgtaaatccactgagctggaatttccaagcaggtgtccttgctgcctcttgttagccttttgtgagttaattctttgtttaataacaaagagctgccagatggtaattttggaggctcagatacactctgttgcacgtgcctgtccagcttacttaaaatatgtcagaaagaatgagggaatgactcaaacaatttcaggaaatggttcaaggctgtgtaacctttaaggaaaaccacacggagccattaccttgtgttgaaaggcagctccctggctccctgggaggcctggtggcaagcagtgagacacttgatttaggtgaaggggggccccaaggcagtggtgcctcccttccttctgcccagaattgaggtgttgtccctacagtggaaactcaagagcagcactgtctgatagaaatataatgtggtcacatctgtaattgtaaatttccttttttttaaaattatgctttaacttctagggtacatgtgcacaacgtgcaggtttgttacataggtatacatgtgccatgttggcttgctgcagccatcaactcatcatttacattaggtatttctcctaatgctatccctcccccagcccgccaccccccgacaggccccggtgtgtgatgttccctgccctgtgtccaagtgatgtcattgttcaagtcccacctatgagtgagaacatgtagtgtttggttttctgtccttctgatggtttgctgagaatgatggtttccagcttcatccgtgtccctgcaaaggacatgaactcatccttttttatggctgcatagtattccatggtgtatatgtcccgcattttcttaatccagtctatcattgatggacatttggattggttccaagtctttgctattgtgaagagtgctccaataaacatatgtgtgcatgtgtctttatagtagcatgatttataatcctttgggtatatacccagtaatggaattgctggatcaaatggtgattctagttctaggtccttgaggaattgccacactgtcttccacaatggttgaacgaatttacactcccgccaacagtgtaaaagtgttcctatttctccacatcctctccagcatctgttgtttcctgactttttaatgatcaccattctaactggcatgagatggtatctcattgtggttttgatttgcatttctctgatgaccggtgatgatgagcatttttttttctagtagccacattgaaaaagttaaacaggtaaaactaatttcaataacatatatcagtttgctagagctgccataatgaagaccacagacttgtggtttatatgaacagaaatgtatttgcccacagttctggaggttggaagtccaggatcaggtgtccacaggtttggtttctcctgaggcctctcttcttggcttgtagatgactgccttttccctgtgtccccgcatggtctttcctctgtactcatatctctggggtttctgtgtgtccacatttcctcctattctaaggactccggtcagattggattagggcacaccctgagggcctcgttttaatttaatcaacccctttaaaggcccagtctccaaatacagccccattctgaggtactgggagttaggactttaacacaggaattttgggggaacacagttcagcgcataaaaatgtatattatttagtccaatatagccaaaatgttattatttcaacataaaatcaataaaatgttaatgaaatatttgccttctttcctgtactagggctttgaagtctggtgtgaatattagccccattttatgatctcattaggcacacgtgggtagtggtgaccgtatcagacagtgcaggtctagtgtcgaacctcctaatctcttgggagaccttgggattgtcgtaaggaggcctgagtgaattcataaaacatatgcagttcctgaatcaactaataagtaaaagtataccttttatcacctgaggttctggtaaatattttggtattataaaggttgctttcacacttacaaaagttaagaagcatggttctgactttcctaaactggggtttctagagcccaagctccattagcatggtgatgacggcctgcaaaatctttccagcatttcagaaagcctggtgggatcacaggggttgccattcagctactgacaaggtcagcatcattgctttcagctggcgttttagtacagtttttctggtgaccttgtgctgatcaaactttccgcgtggctttttatgacactgtaacaattactggggtcatgcctggagaggtggcccacagttcatgcacaggctcgagtacaagccttccggggactcatctctcagccctgttattattctcagggatttggagggtgcagaggtagatgaagtaagcaagcactattgtgcttcctgtgttgaagtcagggaataagaatttcctctgtgccacaaataatgctccccacctgtatagaatgcctgggaaatgcaacactggccatccttcagctcttctgcttacagctgttgtgctggtgggtctcctcctattctcagagcagagagccacgaatggggcactcggggccgtgacaggcatcccttagctctggccttctggttgtgggcagactctgctgtgtccggcagcccatccagcgttggatggcatcagcaacctgaaagccctttcttaggctgaaccagagtctacctccatgtaatcacacactcccctcctatttctgccccggagcacctacagatatctgtctgtctgtccccatccccactgcctacttcctccagactcagcatcctgagttcctttgggttactagttcattttggaacttattccactattgaattatccgtattctttggttttatacctttattcctctttagttgaccttttagatacttttctaaccatgccccctccccgctgccccgaaagatcagggaaaataagaagaaattcaaacccttgttttgctcctcatcagcgacagtggtagggaagatgcccacggcacggaggttcagtggttgttttcattctttcctgttagccagtttcctcaaattggtcagtataatcctacctcttggagcgatagctggctggattcttctgccattttggcagttatatattggtctggatttaaaagtgatgtttattccatagctctcctgaatctgacatttgttcctctttcatcctatacttccctgggcatgatacccttctttccatcagctgtgttggagaaatgtggcatgtggcagatgtatccttgcttgtttaattaatgagccaaacagtccagaaacttaggttacaaccaaggtagtctggcaagaaatatacatgaattcaaagaggtttgggataattttattaatgataaaaccataaagaactcagaaaatattttaagatgcttggcatcaggaactatttcatttgtctccatatccccagcaccacgcagagtaattgacattgactaattgcccaataaatgttcactgaatgttaggagaagctggagtatttccaaaatgaacatatgctcaagatattctactagaagtttacaatgttatcttttacatttagattagtgatccattttgagttaatttttgtgtgttgtccaggatagtttcaaacagttgtgcaaaacaattctgtttgttggttatcatgggtagactaatacctgtcagatcatataacccgacagtcagctggaaacacttggtcacatgagattgcctatctacattttaaatttggcttcagagggagcagccagcaactcccttcaaccccctaaattttggattgtcctaatgaaatcttggactgaagcagtacatttttaaccaggctttctcaggagatttggttcggctggcactcagcccacactttgcttaactctgagcaaaggtgtccgtgggtggataatcccacctccccattctggatgtgccagcacttttcctactcatccccagttatggaatgtctaattctttctcattttctcctgtcactaccatgctgcagtgagcatcttgggtcacctaactattaattctggaggacagattccagccgtggctttgctgggtcaatgttacagccatttatgtcccctcagatgttgggttggtcctggatgctgccctgtaactccatcacacccatctgaagtcctgcctggtaggcagcagacactgggtgtggcttggtttctcatacctttttatttcagtccctggtgtttttgtcatcttgtgtggcagtggcagtgctccagctgatcatttttatgggacagtccttccttgatgagacccagatccctgtcacttgacaacataaagaatattattcttcataccagcatttcccaaagcattttttcaaaggatagtaacgacttttatgtcaaaaaacaaaacaaaattttgaattcaaattaattttggaacataattgaatttaacgcaggctttttattgcaggacttcatggagctttagaagcccaggcacgcaaggaggatgcactgtttggcatttcctaaatgtacttgaccacggaacaccatttttctcctgaggtttaggaaatggtgctatgatatagattagttttctatgaataacttggctttatgccttcatataccttttctctctactcatgtagaaactcttcttcagcttcatgttttaataatggaagaacttagtgatgtttcatatgtagagatttttctctaggtccttctcatcgataagacctgtttcaagatatggcaagccctagttctgatctctggggtcctcaccatttatagacttccattagtcctgttgtgacttaattgttttgttatatttttggtggcctcctacactatggaagactttctgaaagcccatatctcatgctaaatttagctggatttttaacagccttgattgattgctggtcttaatggaagaaaatgtgatcctttctcttcctcccttgtcattaaattattactaatctatgaccagaggaagcagccactgcatacgtgggtgtatttttaaaaattgtgacacatcatcaagatggatatacttgcccctttaattcaacaggcacctgttgaatgcctgtgcatgcaaacatgatgctgggctgagccctggggcttcccctgaagagctttggagcccacagcagaactcccagccaggctcatccaccactacagccacaaccatccctacctggagaaaggggctaaaagaagcccatgggattaacagacattctgaaacaccaacccttaggaaaggagtagaaatgggagttgggattaaaagcagaggtgaggttaaagggtttgaacaaaatgggcctgatcttgggcttctgaagtcctgtatagtgtaagtgctgacctgagggcctgtggctctcctgtagtgagggaggatccaactggagtatgacttccacctctgcatggccagcctggtgacgtgaagcacatttcttatgtcaggttcccagtttcctcttctgtaaaatggaggcagcatgggattgtaatgaggattaatggagctcatttacctgaacgccccagagggtgcttagcaaatactttatgcttcttgtgggtccattactttcccttgcctgtttttttagggaccctggagtgttaccttggcttctgattaaaagctaggttggcagatgcaagcacacatgcctcctatagtgttgtcctagactggggtggtgttagtggtcaggcaaataattgatcactctgtgttctcaagacaagcaatgggtaagaagacaaggccacggaggtcaaagatacagaaagataattgccatatatgctatgcagccagtgcccctacctcatgtgattgtagagtggttcttacactagggtggcatagaatcacctgaagggcttgtttaaacagatcatgggtggtgggtacagcatttcaggtgcggaagatgaaaggttctggaggtggatggtggtgatggttgcagaataatgaaaatgtacttaatgccatagaactggacacttgaaaatggtgaaagtgatacatcttatattgctctccctgccccatcacaaatagattgctaggctcactccttatagattctgattctgtacctctgaggtggaccttaagagtctgcatttgtaacattcccacgtgatgctgctggtctagggaccccagtgtggaacccttgctgactgggttgggagtgacgttgggaactgtttcgccagaaatactggggacccttgagtggtaatggaattggttgtatattttagtatgatagttcttatagatgataaagacctcagaaaaatctcactatgtccatgcccaagagttccaccatgagcacatgccttgagggcagtgaccctggctcctattgtctctgtctctctatatctataacttttaatcttgaaatagtttaagattcataagaagttataactcataagaagttttaactcataaaaagtcaaaatagtacaatagtccccccttatccattgggaatacattctaagacccctagtagatgcctgaaactgtgggtagtcctgaaccctttatctgctgttttttcaatctgataactgagacagctagtaagggattaatgggtagtagtgtaatagcatggatgtgccggacaaaggtgtgattcccatcctgggcagtatggcatgagatttcatcacactactcagaatagcatgcagtttaaaacttgtgaggatgaggggaactactctatggaaagattcaggtaccctttacccggcttttcccaatgataacatcttacatatacatagtacattatcaaaagtaggaaactgttattggtttaatactatacattcttttaaaagagtgctcaactcaagattaggaatctatttttcaactaccattagccccactttggcaaggccaggtgggataagtgctggggctcctatggtgggtgtgctgcagtcttcagcagagcttggctacagaggagaaagatctaaactggaccaatttcatatggtcattgcctctggcttgtggctgatcatcttgttctttggaattgactgtctcatgaaatagtgagtttcttgtcaccagagagatttaagcaagagccatggaatccctgtccccagcactgagaaggaacatgaaccatgtattccctgaatgtcttattccttaaaaatcctgtgattctatcaattgttttgttagagtttgtggctgacattgattacactatgagtcatgtgacattccatgttgatgtagttgccaaaatgctcgccttcctgggttctgctttcattagtttgagagaggagctgagccacagaaaaggggctggagtctgctagattaatgaagatttgggatgtgtagtctgttttcacactgctgataaagacatacccgagattgggtaaattataaagaacaagaggtttaatgaacgcacagttccacatgactggggaagccttgcaatcatagcagaaagcgaaaggcacgtcttacatggatggtggcaggcaaagagagagaacttgtgcaggggaactcctctttataaaaccatcagatctcatgagacttactcactatcatgagaactgcatgggaaagacccatccccatgattcaactacctcccactgggtccctcccatgacagtgagaattgtggtagctacaattcaagatgagatttgggtggggacacagccaagccatatcattccgccccggccccttccaaatatcatctcatcacattccaaaaccaatcatgccttcccaacagtcccccaaagtcttaactcatttcagcattaactcaaaagtccacagtccaaagtctcatatgagacaaggcaagtcccttccacctatgagcttttaaaattaaaagcaagttagttacttcctagatacaatgggggtataggcataaggtaaatacactcattccaaatgggaaaaattggtcaaaactaaaggctaaatgcccccatgcaagtccaaaacccagcggggaagtcaaatcttaaagctccaaaatgatctccttttacttcatgtctcacatctgggtcatgctgatgcaaaagataggctcccatggacttgggcagctctgcgtctgtggctttgcagggtatagcaccccacctggctgctttcactggctggcattgagtatctgtggcttttccaggttcatggcacaagcagttggtggatctaccattctagggtctggaggatgggggccgtcttctcacagctccactaggcagtgccccagcaggagttctgtgtggaggctctgaccccacatttcccttccacactgtcctagcagaggttctttatgagggcccccgtgagggccccactcctgcagcagatttctgcctgggcatccaggcatttccatgcatcctctgaaatctaggcagaggttcccaaaccttaattcttgactttgtgcaagctgccaaggcttggggcttgtgccctctgaagcaacagctcaagctgtaccttggccccttttagccatggctggagtggctgggacacagggcaccaagtccctaggctgcacagagcagggggaccccaggcctggcccatgaaaccattttttcctcctaggcctccaggcctgtgataggaggggctgccatgaagacttctgacatcccctggagacattttccccattgtcatggcgattaacatttggctcctcagtacttatgcaaatttttgcagccagcttgaatttctcctcagaaaatggatttttcttttctatcgcattgtcaggccacaaattttccaaactttaatattctgttttctttttaaaactgaatgaatttaacagcacccaagtcacatcttgaatgctttgctgcttagaaatttcttccaccagataccctaagtcatctccctcaagttcaaagttccacaaacctctagagcaggggcaaaatgccaccagtctctttgctaaaacagcaagaatcacctttactccagttcccaacaaattcctcatctccctctgagaccacctcagcctagatttcgttgtccctattattatcagcattttggtcaaagccattcaacaagtctctaggaagttccaaactttctcacatttcctgtcttcttctgaaccctccaaactgttccaacctctgcctgttacccaatttcaaagtcgcttccacattttcagatatcttcacagcaatagccccctcctggtaccaatttactgtattagtccgttttcacactgctgataaagacaacaataccccactcctggtaccaatttactgtattagtccatttttacactgctgatagacactgagactgggtaaattacacagaaaaagaggtttaatggactcacagttccatgtggctggggaggcctcacaatcatggtagaaagcaaagacatgtcttacatgggtggcagcaggcaagagagagaacttgtgctggggaactcctcattataaaaccattagatcacatgagacttattcactttcatgaagacagcacaggaaatacctgtccccatgattcagttacctcccactgggtccttcccatgatagtgagaattgtggaagctacaattcaagatgagatttggatggggacacagccaaaccatatcatgggggtagagttgagggaaggagagaacattccagggataggaaatagcacatgcaaaggtcctgtggcatggcctttatgtgtaaaggagatattgataaaccttggtatgaaagactgtaggtctctgggtgcaaagtaatggctgagcatgaagctgaattagacttggccactagcttactttgctgttgacagaatgttggtacagattgagcatccttaatctgaaaatctgaaatctgaaatgtcccaaaatctgaaactttttgagtgctgacatgacaccacaagtggaaattctacaccttacctcatgtgatgagtcacagttaaaacttttatttcatgccccaaattatttcaaatattgtataaagttacctttataggtcatgtgtagaaggtgtatataaacataaatgaatatgaagtttagcctttagtcccatcctcaaagtatctctttattatatggagatatttcaaaatctgaaaaaatccaaaatctgaaagacttctggtcccttatatttcaattaagggatatgcaacgtgtacttctgcagctgccttgagaatgcatatcattgaataatgttagtgggaggttttaaactatctgaagatcacacaactgtgagagcccagctcccctgaaatgcgtagggttggtcagtgattttgctatgcgccaaagcagctgccttgatccctcagagccccggcatttctgcccggggtttggccacccctggccttggctgacttctcatggatgcagcaaaaacccagtaggatgcacctctcaagtggttggcagcttttactggacagctttagagtcctgtgggttattctggttgttgctattcttaaatattgagtgtccaaaagattcgtgaactgcatctcagctgggtgggaccctttgggacaggagtaggggaataatgccgtcgttaactgcaaagaggagttttgggaccaggttgtcttataggtttattttgaacaactgataggcttggtattgctggaagtggatagatttgggttgcctgtgtctagcaggtggcttccttttccagtatgttgcccactggtctcatctatcagactcacttgagagtatttcattattcatctaataaaggagtatgtgagattcccagaggaggaggatctacttctgtacttgacctgggtgaggaccactgggaacatttgcacctttcaccattgcaaactttgacatgtgagagtttccagaaatacagagattcttattttaatcctttttctttttaactgcagaagggaaataataatgggatagaataactgcagggagtagagagatgagaaaacattagaaaaaatagtacagaagtagagctggatgagaatccaagttatgagaacctattgatgagaggcatgcagaaataaaaagcccaaattcagtgatctaaatcagggctcagatgaggctgtttgtattgcacggtaggaatatatccagaaacagtgggccttttataaattaagcctgccattctccaattgcttaagacactgaggcccatcaggccagaaacatatgacccactttttctgagaaggaactttccctttaggagtggtaatttagaagaaaagaacaagcccaatgaatagtcccttatgggaggcatctcagcagaggccctttttgggggcaggagggattgcatagcaatactgcctacccagagttgttgttcccaggctagggtccaactcagggcagggagatctactggaggcagcgtatcacacactagttgtccaagagatggagagagagtgcaaaatctgagctgtgcttatgggaagctcggagtctcacaaaactacacccatgctgcccatggtttatgtttaatgaatgaaatgatgattaagataggacaattggacaaaaaggctgggccttcttaggtgggtattgagtgggaagtgattcaagaggccagacattctgtctggacattagctggaagtggggctggacaagatgaactagagccctcttgtggtcccatcattcaggcctgtagctttcatttgagaccagtggttcttaaacttttgcagggatcagaatcacctggaggacttgctaaagcacaaattgctgggccccaccccagcgtttctgattcagtgggtctggggttgggactaggagtgcatttcaaagcactttctggagatattgatgctgctggtcctgggaccacactctgagatacagtaatctagaccatgaaggaggtctggatcctggggagggaatccgctttctgctttcttaggcactaggaaggcaaggagatacttggggctggaaggtggcaggggagcatggaagggaggagtccttgtccatcgtgtctcaccatctgaggagctgtcatcctttattcatcctgcccttctgcttgccctcagtctcagaaattccaaaagacagcttatgaccctgcatttttggttaaagaaaggagggaactgaactgtctgctctatgaattctgggctagtggggatcatggggattttgtaaattattttggtagcccgttgagttttgtctcaggatttcagcggaatccaaaccatgtgacatggaccattatcattcagctgccacctcctggatcctgccctgtaaacatgcccaggggtctctgaggatggacgcgtgtcattcacacaccaagtgtgttagagacaacagaaaaccttgtttttttcctgtgttctggtgaaagtcttttctgtctttccctttgtttcttcgagggagcttgagtggcaggattattattaagagtactttttaagttcccaacaattagataggaaatgaactgaatgggagttcacattttatcttcaggaaaatgaccgcaagaaggccttactgtggggtggttaagagcatggcctggctttggaatgcctggattgggaatccttgttttgtcacatcatcgctgtgtgatcctaagccagtgatgtgacctccctgcacttcaatttcctcacctctaaagttgggataatactacaacttatttagtaggattgctgtaaggaccaaataagataatatagctcatgcagttagaattggacctgtcacttacagatagaaggcaatacattttagttcttactgtaagactgagacatccaaagacgtctcatactgtaatgtgtgatatttatgtatatgctttttaaggactacaatccttagtttcctacctactcaaggttatgttttgtagatgctaacagtgtacattctagagaaaatcagctggagggaggaaaatggtacagttctaaaattctttaagcctcgtttaattttttacctgttactgctttcatcatcacctctcactctcattttctaataagcctgaaaagcatgatggagtcataaatcatgtctgtaaaatgaagatgtgtagactttggtaagatctcacatgtgatgttaataacaataccttacatatctggcctcacacttcacttaaactgtcccatttaatccctgaagtggtctcattagcttctgttagtcccattttacagtttgtacagtggagacttcagagaagaacctggcccaggctccacaggcagttaatgacagagctgggatttttttttgtggaggaataggggagacttttctggtaaagaccagaaaacctgctagacaaattctaaaagagccataacactcagagcggggattttaacttcatcttctgcttcagggaccacattgttcccagtgtgtttaaacacctggctggtttttcacttggggttctcattcagattcgtgattctgtttactgagagatgatgtcccagttactctagctctgtaacaaatgactccaaaacttggggctgtgaaataatcattttattttgctcatggattctgtgggttattcagactcagtgttccatgatatttggggcctcagcaggggtgattcaaccacaggagctagagtcccctggggtgtctttgcccacgtgtcccacaggtgcatggttaggacagggacctcagatgggctgtcatccagaacacctacgtgtggcctctcaatgtggtctttctgcctgggctgacttgggtttcctcagagcatggcaacctgattcctagtgagatttccgagagagtgcggttgtctggcacttctgtgatctggcaatagcttcaaggaaggaaatatatttttacattgaaagaagagaatatgagccatgtgtgccaggtacggggagccacctgtgaagatcctgagtagaggcttaggtcactgtggacacagtggcagcagtggacaaggacaagggatgccgggtcatgcattcaccccacaaatattccatctatctctgaactaggcagaatgagcagggcaccaatctaatggctcttctggataatcacttcacatgggaatcctaggactccatattatattcttatcctgttgaaaatttgaccttttaaagatttatttatatttagctcaggccttaaaaattccatgtactatctaaaaagggaaaagttcatcccagtcaatgtcctgtcttgcttatgtttaagttggataggaagaaaaaaatccacaccaggagaagattggttgtaaaagtttattttacatttatgtgaagtttatttttggttctgatattcttcatagggtagatatttcttttaagactgttaatagtgtatttcctttttatttgccactccccaccaaaataaaccctcttttatttttgaatcagcttcatatcttcagaacgtccaactttaaataatggttggagaagctccaggttaagtagagagtaaaatcctattgctttctgacctttgggttaggatcaagtgtggtgtaataaaatatcagtcccaagagtcacctttgctgatttttttcctattattctttcctgttattccatattcatgcaggtcttgcagccaaggattgttacattaagatccaatctgaaattaaaacttatggttttaaccaataagctataaagctgttgaactcccactgggatgtagttaccttttcctaaacttcctgcattgtctccttttagccccacagttgatttcttattgagcctttggaaagttccttgccgtttcacagccatttcccgtcagagtggggaatattgactgtgcaaaccacttaaggtcacaggcaccacagctgtgtttcttctttgcagaaggggggtttctttgggtggggctgtgctcagcccttccgggtggtgaaggtctgaggtcacactgggagagcaggtccatatcgggattggggctccagcaggatcagaatgacttcacccagacttctggacctggaactcattctcagaaccttccagaagaccctgccctggaattgctttcaagggtctttttcatctgtgtacagagtatatttccttggaggcagctttgctgaaggccccttgagtcaagggtaatagggtgggagcagctatacacagttgcatttcagtgtttgatgataaaatggtgtccgttggtgagcatcttggtggtgaggaagtttatacgaccacagatgcttctcaccccaaggtacccgtgccctgtgctgctggtgccactcatcctagggcattcctgcttggcagtagcagattctagattgtcctgtttgctggtttgggggctgcaggggtctgcagagtgccgcaaggaggaggagtcccagatcactggttgaccttcagcgggcatttaacagcatattccatcaggcctcacctactagtgttttgttgaggctgctgtgtaactttgactttctctgctgtctcctatttaagagtaaataaaggtagtgacagtcacaaaaatagcatcaatgatgacaactagcgtttactgagtgctgactatacccaggcaccattctaacctctttacccaagttgtctctgctagtcctcaccacagccctgggaagtgtgtgctgtcatatacccatgaagaaactgaggccaagaaaggaaagcagctctgcccaaggtgttataagcagagagcaccgagacaggacccaagcccaatttgtgttgactggggaatcagtactcagttctcttagtctttggctgttttgttgagtgcccaggtcatcctggtagaagggagacagtgacccacgtgaaaaaggatggctacagatgcatggctgcatggctgtgcgtcatccaccctggagtatctgcttgccaaaaatagggctacctgcaaaatgctttgagcactgtggaaaccagccgttacaactccaaacgtttatttttctgataataggtcaaggttttcataattgagttttaggggggctaattttagactttctgaaaatcagtctcaagaaacaaaacccagagtcaagtaaaaggatgcttttggaactgatgattctcagaagaagccatgaagggctcggccataaccccgggaaagctcactggccagcagcctggagccagtggagcttcaggtggctttaattcttccctggatgctggtggtctccagagacacaggggtaaacaggtcagcgtccttgtcctcaagggcgtcatcctccagggaggacatagctggtaatgacaaaatgtgggccagcgccttcttgcagctgggcacacagggctaggggaactgagaggagaaaaggatgaatttggccttggcttggagcagccttttaacagaaacacgcgtaactttcctgcagatgcacttcctgtgaatgaagagtcttgatatatatttttctttaacaagagaaagccaggcttttgattaataatttatatgtcaatgttgggatcttcattttgttatgagagatttcagttacaacagtgtgaggtgggtggtcaggaaacattccccctgggctcactttttgcttagaaaagtcctgatggagaggttgaggtgggaagagagtgagggggaagactccatggagcatgacaggcatgctgtgcctgccacagccaagcatggaggtcccaaccataatgtgtttttgagacaggatctggctctatcgcccaggctggaatgcagtggtgcaatcttggctcactgcaacctccgcctcccagctcaagccatcctccctcagcctcccgagtacctgggactacaggcgcaccaccaccatgcctgcctaattttttgcattttttgcagaggcaggggtttcgccatgttgctcaggctggtgtcgaactcaagtgatccacctacctcggcctcccaaagtgctgggattacaggcatgagccaccacactccacctccaaccacaattcttgttttaaaaaatgaaaatagagtgaaacagaaatggtagaatcaagtcaccttgctcattcacagtcatgtgtggctaggacaccatgtggtccagtctgacacaggctgatcctttcccctcaggacccatccttggggtcgtccagtccttgggctctgttcctctgatgtggcacaggtggtcagtggggcagggaagacagaaagatgagggccacatccacagaagtcatttccttcctgtggtacagacatgacaccaccctgtgggatgaatggggattcccatgtttgctagttacatatggccaagcccttcagcctttctgccccacttccagtttctttcttgggtgggaatgccttgagcctcagttaattgtttgagttttcttgagtataaaaggaatcctggctgggcattgagtgaatacaatcataaaacccaaatgatgctgttggcctcatctgagctgagagtggtgttggcaccttcatagctgacatcaaatggatctccaagcccaaacactaacagtggaaccagctattgctgcttctggtgtatcatccaaatgggttttcccagccatcttctggtgcatttctaacatacccttaaaaggcataaaaaagtggcatagatgatggctggaaagattaagttctttctggtggcttctttaattttggaataaccagccttccttcaacccccttacatgcattagaaacttctgaactgtttttgttctgtttttaattaggttgtggtacaagaggagcaattaataaaaccttccatttccacatctactgtgaaactctgtgacttcttcccgtgtgatgatggctaagtgcgcagaacatgtgaaatttaagtagatttgtggaaacagaaacacatttttatttagtcgtgagcgtcacttggagtataaatagagccctttatgattcgtgtgctggtctttcttcctggagggcttcagtattatctcatgctgtcatctttatgttgtattggaaaaatctgggattctttttcccttggtcattatttgctttttaaaaaataatgtagttttaaagaattcttgctatttaatctcaagcccaaacatggtttttagtgaggaactgatacttaataaagtttgatatttttagttctagaaagaattgttttggggggtgggaggctgcagttgagaggtacaagaaatgttcaatgaggggaagacactctactgtggttccatttgctctttgaaaacttgtgtttctgttggaaagaaaggtttgattttggaagttttaaatgtactgcatgatgttgctaaattttagttcgttgctgggaagttttggatgagctcatttcataaggatttatgtgccttataggccagtgtggggtaaggggtggagaagcttgcctccttcagaagggtcttcattcctagagggatatggaatgacccactgctttttggtgggaaacgtaaaggccagtcagcttttggatgaattttcaaggaagacagcagctgtccatcttcagtcttgacttgccattcccttaggagttccttcctttcacccatctttttctccccatggcttggccatgccacagtggtccctcggcttcaacagtcttgcttgcttacatctactaactgggcaagagagaccattctcccattggccctggaccaccactctgatttggatttagatgggctcaggaattttgtttggaatccttttggccttaaacaaaataatgatgagagaaatctgcctcccataagtcataatctcagcaggctcctgtgtctgagctatttctgtatccaggtccccaagagggctacagggaaaacttcatcatgatgggagggaagaaagaaggtaaagtcctaagatgtttgcttcctattccttgtaaggtttagccatgtatagtcatgtgccagtcacctagggctgagaaaggggagcaagcagagagggagaagaggaagaagccaaatgagatggttcgtaattgattagtggaagttaaatcatgttaaggataggaggcttgtcccctccatcatgatttagtatatcatccttcccaagagaagttttgagaacttgtcctctggtatccaggaaatggcctccccagcagtgtgcatagtcccagggaagccgtctcatgagcccctccttctcttgactcctctcctaatggtcacatggtgccaccactctttcaagccaagtcaaattgcatgcagcagaaaacccaaataagtttatgcagtagaggtttattctcacaccgaagtaattcagcattggtatggtggctccatggacttcaaggatcaaggatcctttcctctttctgttccaccatcctcagaacatggcttccagtttcaaagttaccttatggcccaatgtggctgttggagctccagccatcacatccaaattccagataggaaaaagaaggaagagagaagattacaaaagaaaattatctcccagctaatttgtctttatttatggagttttcctggaagcctcacattatggtttctgcttgtatcttcttgaccacctcttctccaggggagactagaaaatgtcttttaggtaggcatattgtagattggaataaagttgagtttggttaaaagggaaaagtagagaatggatattggttaggcatatagtctctgccatggtctagaatatatgaagaacctcatgtgtgaaccttaatatattctgccaaatattctgtttataatatctaaccctcctatcagatcctaggccatttggaagccaggagcttatcctctcctctttgtatcaagccaggggcccacatgttggagttatagcccatctttgttcaattgattcagattcagcccttgcctcccatatccctcaccatggatatgcagttataaatgatttcttgttaagcatttttaaaaggttaacttcttcccagagagcttttacataattatccatttaatgtgtttttaatgataaagaatctaatagttatcaataatgttggaaaagtaattctaggcatgaaaattagcagtatggtacatatgaagtacataccaagtactacctgattccagatattaggaaaacaagacagaagggtttcaccactagtcagtatcagtagattgttggggagaaatctttatgaaaaatgccacttttcactctttttttcaagtttgaactgactgtggaaagatgggagatgtctgagaaaacttgtgtcagtacttcatgtttgtaaaaggacagggaatccttctgaaaatctagttacataaatttatgttccaccacaagaaaaatcagtggatggctggaaggcggggctttcccttttgctctggaagggaaggaaactctgacagccagacttctcagtcggaaagtgtctttggtgagccttactatgtgactggctgattcactttgtccgctaagtcttgggagaggtgatgtaaccagggactgcaacttctagggaaaggggaaaaatcactgttggccccaccctctagcattggaagcttaacagggctttggcccacagcacatggaagtttgagctgtgttttgtaattcttttttaaatgttcgccagagcatccattattcttcctcattttctcttctcctcttccctccttttcttctttcttaccttttctcttttttatcctggatgtgctcctgtatggccattctaaatcaactcaggtctgacctttggaaatacgtacagtaataaggaatcctaggggcttcctgctgtatttctgtttttgaatttgattaacatgagctaagaggttgagtagaaagaacttggactttggtgtccaaaagacacgggtatgaattctgactctaccattactggctctgtgactctggacgagttgctttacttctctgactctctagaatctcacctggaacttgaggttaattcctgcttcaaagcgttgttaggaagattgaacaaaataatgtgtgaaggaaaacccagcgagagggatgaagagcagagtgtgctgggctacataggctaaactaagaagtttggattttatttacagtgctctgggaagcagggaagtgacctgatattgtagatattttcaaaaaatcactctgggcctgtggagtgaatggaggacaggagctggagtggaagcagatagcccagctaggaggcaagaacagtggacaagacggctggactagtgtggtcacagagggaacagacggaagcagtgattcttgagaacttttggaggtaaagacactaggagtagctgaagtcttagatgtgaaaaagggagggaaagagaacactcaaacatggatcttaggttgggtcttgagcgcgtgattggtgaggactgtttgacagtgtagcccaggactgtgcatggggatgacacccacaagatgttggctggctggctggattcatgactatctggaggaaagagagaatgcgtgttcttaggccatgttggatgctgaatgcagtgggacagacccggttctatttcttgctttgaagagattgtgttccaattatctgccctgtttagatggcagcttccagaatcaagttggtcagttttgagcaagatctggaaagcaagacaatgtctcaaaagcatcaggacccctgatatccaccttgttaacaccgtagatgacttcggtgccctccctgcagccgtctgctttaattgtcagaacaaagtgaaagcgaactcagagtgggacttgggatgggctttggaactgagcagcattctcaaagctgggtgctgtagtggcatgactattacaggtggggccaggaccccacttccacaaaattcaattggatacatctggtaggaggtgttcacctggaaatctgggtcttaaaccactttgagaaacactgtcctggaggtaagcagcccctgttctggttctttttcttccactttttaaaaaggaaatcagtttggtggcaaaatctccccttcctgtccataattcagactacgacagcaattagaggcaggcagcctcccctccaaggagaaagaaaccctccacgtgttttatgagtatattcctaataatgacaatagcagcaaacaaacaccatagtggtgatttcatactcatgaaattattgtcatggagttagagcctagataaaagtgtttggcaagtctctaaagcatatttcaagagaaaaaggaggccagaatttatagaatctaaaaatagcagttgaagtgcagctgtgtttagcttgtcagagaacctgttgagtcaagatgggcaggggattttatttctctggccctgaggtcatttgtcttgtttaagaaggggcagcaaacatttccaaatagggattgacttttaaggggaggaagatggctaaatgtatatggtatttcttgttttctgctcttactcttcctacctccaaccccattccaaatttcctcttaagaaaaggaaggagagtttgtttttctcagtagagtaagtagtgactgcctaggtggcaggattttggatggtagtggtgatgttacttattgatggcacatttgatgactgttagtccatggagtggtgggggtagactaactatctggtcttagtgggttctgtacaatcccattaagttgaaggaataaacctgtagttggagaaataacagtgtgacttctccaagactgattggctgacttttggaccctctttgtcccatttctagtcaggaattatgtcttctactgttccacaacccacaaaagaagatgtctgttccacttctggcctaagcaatcctcaagcctctatacttaacaacattggaatgtcaccatcttaaaacttgtcaaccagtaggccttcaaacctcctgccctttaatatttattgaaaccttggtggaaatgaattctgtttttggtggagtgcgtgaagttatttccctccattagtttgtaggccagaggttgaaaactagtggcccgcaggctgagtcttcctcaccgtcccactttgcttgcctggcaaagtgttaacctatacaattgccaatattggaaaactgggatactttgtttacaaatctttatttctggattctcctgggttgctctaatatatattcttggtttagatttcttttctggagaggtgtccccagactgctgtgcataggtccttgtcctcccagagtagctcacctgtgggtcatgatgagaaatagccactgtattttatttgaggataataagaaaggggttaaataaattgtatgttgagcacctagaaaacatatgcatgtgcatgatgagcaccctgtaagcattagctattattgctatcatcatcagcatgtttaatgtattttctgttgagggttccattgaggacattgttcatgacataacccaatgtcttatgaggcctcatgaaagacatgtctgtcagatctcagttccagaaaatagctgtccttcttctgaattactggttcatctgtaccttactcatgcccccaatcttatttctatctttgcactagctttgcagaagctcagaggcaactatgtagttcatgtctagcaggaggacttggattcgatttgttgatcccttggtttcacatgccataatttccttgcttctctacttttctcacttattttgttgtgagcattattgtaagcagccttaaatcctgttggaacaaggctgggtgtaaattaaaaaacaaatcaagcatccattcctctgagaggttatataatcactgagaataggcttccacatcaggacaggtttcatgtcttagccttgggactacatgttttctctttcccttctggacactactgacctctcattgtcatgttggacttgattctatcagttgtgctcatgctttcccttgaatctagataacctgtaacttctgttacagaatgagatggcttatttccctgggtagactgactgtattagtcagctattgccacataacaaactgccccacaactccatggcacacatcaagaagcatttatgttctcatggatctgtgggatggttggacagttctgctgcaggtctgcacgttggctggggaagctgttctccatgtctcttatctttctagaaccagttggctactggggcaggttcttctcatggtgatggcaaaaatgcaagaggggcatgcagaaacatgtgagacctcttaaggggtaggctcagaactggcactatcacttctgccctcattccattggccagagcaagtcatgaggcccaatccatcagtagagtggggaaatagagtagaaatagatcagcctctagtgagaggaaccttagagtcaatgacaaagggtaggagtaccaggtggtgggtagggggcagctgataagtaatgcagtctagcctgtaatcccagcactttgggaggccaaggcaggtggatcatgaggtcaagagattgagaccatcctggccaatgcgatgaaaccccatctctactaaaaatacaaaatttatctgggcatggtggcatgtatctgtagtcccagctactcgggaggctgagtcaggagaattgcttgaactcgggagacggaggttgcagtgagccaagactgcgccactgcactccagcctgggcaacagagtgagactccatctcaaataataataatattattattaataataatacagtcgatcacaggcagtgtaattatttgaagaccataaggttgggcatacagcatagagtatctagcccttagtggctatgttggctattctctacttcccctctccagatccattctccaccattatccctcctgctttgtgcccttgggaggctgaccttcccctctgccttttagttgggttcagtcagaggggagcactggaaaaagagggtggaagagtggccagccatagtgaccatggctctctacggaaggccatagcttctgtcaggtggttagttctaataacttaggggttccagtgaccactccccaccttgctccttccgacctagggcattaatggctccctgctttgccacaggggtctcttttaaactgaccccccttactgttgtaaatagtcccttcagtgaattctttttgtctccctggttgaaggaaacatctgcttctggccaggaccatcatggatacagtaggtgctcaataagtgcatggttgattagcaggcctccttgtttttcctctcctctggcctctacatcactaaatggtcacttctcttctagcctgaagagcccatggaatgtcagcttgggaatccctccctctttccccataacttgtccaaccaccatccctctcccaagaacctggcacagtaaattcattagagcgaattcaaataaataaggttttacttttcttctttgggatttcttagcatgcccgttgggacaattagggagggattctttcaagtacaacattttctctagcaattatgggggttttatctcccagatgtgatttatgccatattacactccaagaagggaacatgaagaatgtttgtggctaaaaaagtctcaacacaaggaaactacaggtgaaacgtaacaatagtaattgccttactttatttgcgaaggggtggtgaacactaatatgcctgactccatagagcagtgtatttggttttcttaagcaggaagaagggggcccccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttgggaagcactgggctctgcttatgattctcacgttctggtctgtgactgaggagatgtgccatgatgagagtgatgatggtgatggtggcagacaagagcatgtcacatttagaaatactgtaactggttgctgaggttttacatatattccttctgagcttgttttgtctaatattgcctgtgccaacagtattttaccagaattgaatgaaaagaaaggtaccagcagatttttttagatgttctaattgataccagaagcaaagacgtagaaaccgtcatgttataaacatgaaagccccaagcaaacagcctttagcccaccctttgagaaccactacatgacttcttgataagattctttcaactttaccctatgcctggatcatgaaagaggtgtttctagaaagctctgcaaaggactttctctgacagacggctctaggcagggggaagctctgactaactgatctctggagaggaacacagatgttccctcctaaaaaaggacatgctggccttgctttcttacaggtcacgaagtctcttttaggaatgccatttggcatttcaagtttctgcagcagttctgcagaaagccatgcctagaaaatttataattactctgataccagatggctttgcggccttcagtatcaaatgcattgtgattgtgctatgagaattttggggggaaaattccaaactttattaattattgtattggggaaaacatcatgttattgaattttaattagagttgctgggcagcctgggctgccttttaacttacgggtcacctggttattgcctgtgaggctcactgaggaaatgtcttgctggcaaagctgagttcgctcagaatgtggactgttccatttttctgttgtccaacacttgctttgtttgtgacatttagctccttttcttcctttccatcccaaatccacaccctttcttctgtcttttgcaaaatctatgacactgttgaatgaataatataagcccaaggacttggagggatgagagctgtgatgcccacatgttttagtgttggcatgtttccctcatttttggggatgccttgggttgaagctgatttttcagcatccctggtttagcatatgttgcattatgtatctgggaaagtagcatatctattttctcattttgcattacaatagcatctagtaacattcaagcctcaattaattgaaccaataattattatattaaaaatggtatgtatgccccagggcagaggttaggctatggtgggcatttgagaccttagggccatagaccccgaaacatgcattctccagaactgagtatgcaactgtttgctttcgaccttacagcacaggctttgggagaaaacagttacgttcaggtcctaactccagtaatgaatttcaagcttcttgttattgtttttcttcctgaaagacaaagggagttttatgccatggtattttgaggacaatgttgaatcaattgttatcaaatgggaagatttctgaatgctgaatagtttgtaatatccttcaaaaaaccaaaccaagaacccacccacccattcaccatttatctctccatttgtccacccacccattacccacccatccatccattcacccatccatttcaacattcaccagttcctacaaggtactgagtactgcatttatttgctaggggtgcaaaaataaagtctaataataataataaccatcatttattgagaacctactatgtgttgagcagtttccaatcttcaaagcagttttgtgatgtaggaattatgttctccgttttatgagagaacagaagctaatttacttgcctgggtcaccaggcagtcaaggcggagcaggcctgaggcatccttgcaacattagaaccagaacaacatttcattcttttatgttaaacggactctcctgcctggacccaggcccacgttagcatccagagtggcatgcagtggcagaattggagctggaacagccctcatttgttgtcttctctccttgggaaatcttcctgctatcagtgaaaaagggagagggatcagctcttgtttcttggctttgctctttacagcctcttagaaacttgagttctatctggattcatcgtgtcatttgatggtacaggagtacaaatggaggtccacttagcgaatatctaaatatttaaagattacaaatcaaggtaactgttcagtaaactgtgttccatcctaccttgacaaatatacctttataacaacttggaagccctaggttgaattttgatttctcaggcctctcagagtttagtgtagaaatggatggcttggggagagccagcccccagcccacccccccacttccctttccatctgactccatcccgcatggcaatgggccttctgtgcatgcgtgtgtggacacccatccaagcttcgtccaccccctccccacagaggctgcccttggacctcaggtagggtacactcactcatggtgcactttacagtgcaggggacaaaccctggagtagagcccaacatggaccctgaaggaggacttagggctgttggggcagggatttctgttgtcctgggcacacagagcatatctgcaagagggagatgtggagactgaccttggtctcacaaactcattgccccttgcaaagaaataaccaggagggtctcctgagaatggggttcagagtaagggcccctcttgcctgggtcttacccagggtgataccatttctgccaagtcagaggatgaaagggacttcggcggaagccatatgacccacctctgtcattttagggagactgagcatggctggtaaatctcagtgatggctggagccctgggggtccttagtttcccagcaagtgccctgtcctgctcttgcctttctgagcatcatcctcgtggcattctggagcatgaggacccaaggctgggtctgagtggatgactgtagttacgtacacaggctctgctgcagggacaggattacagaagatgtttacacaaagctgtagctttggaaacaggctgtggtgcatatcttagcagccccactgaccagcttggtgatttttgttcaactggagccttggcttcctcgtctagaaattggagataaaatggtatctgtaggtagagttgtgtaggtggaagatgagatgtttgtagaaatcttcatacagcacttggctttcccaaagggaacatcagcgaattgtagccactgtgactggagctgctactattgttcaccaggtgtcctggaccccactgagaagacgctgccattcgttcattcactgattcacccactcaaatattcatagagcacctatcatgtgcaagtactattctggtagcatgggacttaccagtgaacaagagaagcaaaattccatgccatagtggagctaacatcctagcaggtagaggcagagataaaccataaacataattaacatggagatatagaacatatggaatatagagtatggaaacacgaaagctgataagtgctatggaaaaaggtggataagggaaaggggtttggttgacccaaggtgggctgtaattttaaatagggtggttagggtaggcctcatgaaagaggtttttaatcaagaacttgaaggaggtaaggggagagaaccatgtggagggatctgggagaagagcattccaggcagcggaaacagccggtgcaaaggccctgaggcaggagtgcctgttgttccagggacagtcaggaggccagtgtgtctagagcagaatgagggtgtaggtattaagagacgaggtcagagacatgacagaggcctgaccgtgtagggcctagtagaccattgaaaggacttggcttttactcattgcaaagtacggaggggacaaatgacatgaccttctgcatctcctcccacgccttgggcccacaggctgcctctgcactgttagtcctccctgacttcctgccccaggctcactgcccccatccatgttgcacacccctctctacctgcagccgccatcccctaacaggtagaggtgtgccctgggtccactccctcaagtcccagctgcattaccagccaaggatgtgatgcatagtattctggagctcctttttaaaaaggagttacattgctttgggagttcaggacacaggcagcctgggggtgcttgcttcatttctgaaaaagcaggttgtggccaccctttcatgagccttgactctactgggctctccctgctccccatggagcctcatgctgtcctcaggccaccctagccccctgttctcctggctggctttatcccgctgagcagtgggacagaggacaggaagatgagaggaagatattccagagctgggtggagagtcagggtggagtagagctgtgtgagggtgtgcatgagggagccaacaggaaggagggctgggttcttgttctctgaccaattcccagtcatggctctcccatggggtttcacagctcagtccgaagacacattgttcctgtgcatggtgtagccaagcccaaatatttagctacggccacaccagcccttgttctgcttataactgtggtgtagacctcagtccagacaccctccaagagatacccaccctgccccttggcactggcttgggcggccttgtctggtgctggaaggctctcttgggttctttgccaaagttcagatgtccccctttcccactctgtgggtgggccctagtgggggatggatgagggctaaggcatgctttacccctggctcccaggcacagagatgagggtggcctctgggtcagagggcttcctgttgagtcagagcctccagccgatatgcctactgtcccacccctactccacatagatgcagggcaccctgcagctttgtttcaggaggaactctgccagtggaaaccccatgtccttagcgcagccctgggggttatcagggtggctcagatgcaggaagtcctcgcctctgctgtcctgctctgccccaccctgtcctgcagaggggaggccctgcccatgggagagtctgcctccactgggcagtgctggcctggaggaaacttccatgccacccctcctgcccctgggctccagggctctcgatttttggggtaaacagaggtgctgggctctgctgaggataagctttgtgatctgggaaggatccctttctcctcattttttccccacctccttttcatcatgtctgtgtgaaaacgaaagctattgtttatgtaaaaggaccatttgcctaatgtccctggaatttatttgctggagcattttccattttcatattcagtttagaccttggctgaagtagggaggttatgtaactgggatggaacaaatctcattggcatctggggaccctagtgtaccccacccttagccattcctgcagtggactgagtgcccccctggctgtatattcaagtcgcctctgtggctgccagagttggggagctggggagctggagtgatagagaaggagttggcagcatttagaatggagtcaggaggaagatttctctggggggttggattcatagatctgctttggggctgtctcctcctcctcagctgtagacctcgggggtccagactttccttgcacacaaagcctaggcctttcctatcagcctgtctgtggaccttagccaacagcctgagcctcactgcttgagccttggctggattagggaaatgtctctggcactttccttcttggctgtctgtggaacctgtctctacattctaacccatccccagcagcactggccttgagggccatgtttctacccctgattcccagcctgagcgccttgggtttctcctcagaagccttgtctgggtctgcatggaattactttgacaaaggatgggatgtttttctaggttatgagggcctggacatttgcctgcctggggttttaaaagaaggcaaatatatagagtgggttttggagccctgaacttagtcatgggtggataggggtgggctgaggagggggtgcaacctctgccttccctccccacgcccccatattctgagatggtagagaaccctttcattcctccagcctgtctctttcatccctctatggactgagacatctccctttacaccagttttttacttaaacatgcttattagcctccattaagaaaaaggtaaccctgtgtatacctgtattaacacaatgctaactgctgcaacaaaccctcagttttcaattacttgacctactagatgtttgttcattgctcatgtgtcagtcaaataaggctattcctcgttgaaggtagcttcctccacgtggtgattctgggactgcagttgctttccattgctgctgctgcaattccttaggacctccaggatttctgcctcctgggggcaggaggagaaagaagcagtggagaaggcacacccaccccttaaacactccagcctagaaatgacccacatcccttctaccgactttccattggtgggaactagtcacatggccacagccggcctcagaggaggctgggaaatgtgggtccaggctgggcaccaccttgggaatgactccacatatcagtggtaggagatggagaggagggggtgtacttgggaaacggcgaggtcaagtcagcagggtggattgagaatatgtagggggacgaagccaggagtccaaggaccccttgggtttctggtttggagaacagggtggatggtgcctctgaaggcaatggagttaacaggaagatggacgatgctgagagggaaggctcatctgtcaagtgcccagcaggggtgggtgctgtaagaatgttttgtgaatgcaggaatgaggagaaacagtagtgaatgaacttgagtcccttctgccaaccccttgcagctatagtggagaaaaactgtttggtagctgtactccatagcctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcatagatgctcaagtccctgatataaggtggcatcgtatttgtatataacctacatatatcctcctgtatactttaaattatctctagattacttataatacctacaacaatgtcaatgctatgtaaatagttgttatactgtattttgggttttttgttgtattgttatttttattgtttttttcctgaatatttttgatctgtggttggttgaatccatggatgtggaacccatagatacagagggctgactatcccataaattgggtgggttacacaacagaaattaatttgctcacagttttggaggctgaaagcccacaatcaaggtgccagcatagttggtgtgtggtgtgggctctcttcctggcttagagacggccaccttcgtgctatgtcctcacatggcagggagagagagggagaaagctctctagtgtctcttcttatataccatcatgaaggctatgacctcctctaaaccgaattatatcctgaaaggcccatcacagtgggagttagggcttaaaaatgtgaatgtggtgttggaggacacaattcagtccacggcatccagtggcgatgtctccccaggcatagagtcctcttctgtgttgggtattgtctctctaagctgcggggaaagggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaagggagagccagctgagggtgacaccttgggctgcagccacaggccactttgccactgggctcacccacgctgctgctgccacacgtggggccaagggtgacaaggctgccagggagcctgggatcggagttccagggccatctgagctctgggtcagcagcagtcattggagcagggatctggggaggcttttcacgtgggggttgttgagataggggtctggccccattcctgcctgactggcagtcttcattaatgtacgtttataccaggagcaagtggagctggggaggggactcacatctctgtctgtgggaagcagggcagagtgagggagagtatggcctgctttctagctgatatctccccttgctctcagcaagctcctctgcctcttcctttccttctggtaaagcataaggagaggactcaacagtaaggactaatatttgacagtgaggagcagatagagttttttaggcaggggtcactgttaaggaagtttgtattttttttttaacttccaaataaagcttgaagtgtctgagaggctgcataacagaggtgaagggcacagacttgggagccccatggccaggatttgaatctgaactcttaggcaggtccctgaactgctcagccctcagtttcccatctgtaaatggtgataacagtaccttcctaaggtcattatgaggactaaatgagtaaacattgatacagtgctaacaacgcttaatagagtacttacaacacttcacttaataagtgccatatggtgggtgttaaatatatattttggggaacggggtctcgctatgttgcccaggctagagcgcagtaactattcacaggcacagtcagagcccactacagcctccaactcctgggctcaagcagtcctccttcctcagcttcccaagtagctgggactacaggcatgtaccattgcacccagctaaatttttaaaaattaagtcttgttgaagagtgagtagaaaccagagtggtgataatttctggttctccctagtcatctccctcaagaatttcccagttacttctcctggaagatccgcttccttgttttgttgtttttgtttttgtttttgtttttttttgactttgagacaggatctcactctgacacccaggcgggagtgcagtggtacagtctccgctcactgcagcctcaacagcccaggcccaagtgatcctcccacctcagctttccaggtagctgggcagtgtcagcagctctcctatggccagctccaccaccaggtcagacagtacccttggcaacctgtggaccaggctggggaagaagaaaatctaggaagaaaaggccacacaaggaagaagtgcagatggcaggggattccggtggccagggaccagatgggagtccgaaagctacacagagcaaacaaccaaaattgaaagcaaacagactctgagttgagaaacctgttctccctatccagagcatacaattcagaaaatgccggaacagcataaacactgcaaaacaaatccagctatgtaatccctttattttagtaattagaggtggcactgggaatgctggtaacagtggagtttgactcagatccccttgacctcacttggcttttcctccatgttccaacaacttgttaagtctgcttctccattccattcctttcccggcgtggtgtttgggtttgtaggcaggatggccatgtatgcacaaagaaagctttggggcagtttcctgccacccagtttttatgaacattctctttgccccatgtgtggcagcagaaggcaatccagccctcagcctggaccgccgaccttgtgtgtttgtctccctctgtgcctaggcccgagaggccattagaagccccatttgtgtgtctcagcatggcaggaaggtcaaaccgctgcttcctggttggaaatggtttcttcattgattcatcaggtcagtcaagcatttactgagcacccactggagccagcattgtgcaaggtgctaggaatacagtgatgaggaaaagcagacatagaccttacccttctgaaagttccactaaaaatcaaataactgtgaacaaatgtccccttcctgctgtgatacctgccataaagaaacatgttactattaaagtataaccagatactcacatgtgacattctcttgttggttttccctgagtgcaaaagaggtggtgagtctttctaaatcctgagtcaagatgcttgaccacttattaggacttggacccttagttttggacccttagttttggacccttagtcccttatcaacatcgaaggtacagaaggattgacatcagagaggcccaggaagtttgacattggagagaggcgtttttggagaaggctgatgggctggggggtgttttccgacctgagccccttggaggagagaaaagggtgttcttcctccagcccagagaaaggaggagaccagacaggtctagctcctgagagctagcctgactttcttccagagtcttggagagcacaaagatgtgtgttgatgtacagcttaaaggggagttaatggagccctgagaatgtcctgctcccccggaggaggacatatgagtgcatctcagggtgaaagctggctaggagctatttaaaaggggttgtaccttaggtgaccctagggagaggtgatgggaccatacccaaaacacaaggggtctggggccagcggaggagaccttgttccctcttgggagttgcaggggagtgtcccaatgctcaggaagctccagggaaccttcagtgtgcctgaaaaaaagtcaacctggaatacccaccaagctaagggaggtcagcgtgcaatgccacaaagccacagaagtctctagagcgactcagctttaaacagctgccatggccagagaaaagccaacacccaaagacaccagttccaactaggtgtggcttctcctcccctcctctcctcccctcaaaaggtgttctaagcagctgctgggaaagggggtgagaggaagtgactgcagcttttttatctcccacttcccaccctctagcaaccttcaaagcctgaagtagggccaagttggaagaggcgaggaagtttaactttaaatgaaatttggagtttttcactaatacgcaggactggtcattttgatactgaatgggattattctggagattaaagcaatggaaagacttttcatgatctaagagtgatccaagagatagtgggacctgctcaaggtttcatccaggaggccagggagaaagggccaacctcagtatctaagggttaagggtgtgcaagagagtgcaatcagtattgcatttcagcagatcagccaagctgcaggataggtgacagatatgaaacgataaatgtggaggcagggagaccaggtaagaagtctgcggtggtctaatggtggaggtgaagagaagagggcaggctgcagaaaaggcaggatacgaggtagaactcccacagtttcctcatctctattgtacatagtaatcagggtctaacatagcttccctttcccacctacgacctatgaggtgcacctgtccgtagtaagtactcagtaaatgactggtgaatgaatgtgttttaaataaggtatatagtgagaaaagtgagcattggagtctatttcagttatgtgttacaataataatgctgcagaacaaactcaaaacctcagtggcatataatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcatattcacgtggagactgagaagcacgagaaggcagaattgggcccttgataagatcatcctaacacagaggcagatgtagatttgaaccctatttgcaacagtcactaatcatgtgatcttcggtgatttattttacactttgtggcttaatgtctttatctgtaaaatggggctaggaaaatttatctcactgggtagtcaggattacataagagtaataacatctcattcccactataccatcctgagagggtaaataattctgcctatgacgcaggtatagaaataaaaaagactatgaaaagattaaaaagagctcaaatgaagggaagataattctaggcagaagaaagagcatgttcaaaggctgtgtgagtgaagaggtgggagagtgtgctgaaaggtgggcagaagcctctctgccctgggggaggggatggtgccagggagctctaattgtattttgctggcactggggagccatggaaatttctgtaggaagggagagatttattttattccacaaacatttatttggcacctatgatgtgcaaggtattctttaagatgcttgggagacagtagtgattaatcaatgtccagtgggagagtcaggggggtcaggaagatcttggcacagaatgaggtcagagtgagagaggtcaagattggctggccaggggtattagccctgagatacactgctgctctatgggattttgcccctcattcacaagcagagggcctacccttaggccccaagtgtgtcaagccccctctgcttacaaaactttatttttcacaaccaaaggtggttcataatggtgggctgaggaggaagcaactgaagtaggggaagctcagaagtctctgagggtccttcccaccaggaatctccccacttgaacctaaggctgggacactttggcatgtgtgttttaaaggatccgtgggtttgtggggagggctgcaccagtgaccagttaagcccagtgggtgatgcctttcctttgttacttttcatgcagacatctggaaagaatttgtcaagaattataataaagaataccacggaatgaaagcaaatgtggtgagaagcagagttgccttaagactgagaagccagcaggaatggctgctgctaagaacctcattcttataggaaggattcagttctttccctgagcaacagaagtgcataggtgcacggcatagtgtgtcagttagcatttgctgagtaacaaaccttcctcaaatttaatggcttaacacaacagccatttattattgtgtataagtctctgggttagctggatagttctgctgatctgggtggggcgtggctgattttggctgggctcactcatgtgttagggttcagcttgcaggctggctggaggctggctcagtcagatgttttagagttggctgaggtgacagtgtggctgggccaatgcctatcatcatccagcaggctggcctgggcttgtttacatggttaggaggttctacaagtgagagtggaagtaggcaaggccttttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcacatggggctctcaagccatgattctttacttaaccttcatctataaaatgaaaacactgatagaatctatctcacaagatcattttgaggtaaatgcacatgtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactatgaaatgaggctttcagtaaacagaagatgggcatttcatcctttctcattactgagccttcctcaagacctccttaacatcctaacattataaatacaataattttagaaattacttagtcaataaaaaataagcacttattgtatacgagactctgttctaggagccagagatacagaggaataaggaattaaggtatttctcccatattcaaggacttcagtttcattacctgtccagaaaactatgagaaccacccatcacctctggttatagattcttaagtgggatgtcaagccccttccctaatgatctcagtttaacctgctgtcctattcctctgtggcctattcctgtgctacactcgagccaaggtggcctcttccctagccccacacatactctttgtttttccattcttccaagcaggcccggagaaggaatgggctccacgatgcagggcccgcggtagagaacagccaggcagagcagggggcctggctggatgtggccagcatctgcaggggttcagcattgagatatgacactgtcacctccatctcaagaagcccttacggatgcctcccttcccttcatgactcactgtgatctacaactcctcagagccagccttaaagtggtctgtggatcagtctcatctccccactggagctccatgggcagaaagcactctttctcttctgcctacaacatcctcctcccatcggtatgcaccccttcctaggagccccacaggcaatgacaggaacccccaaccccatgtgtgcacatatacacattcccacatgtgtggggaatgagaggctacatagcctgctccatcctcttcttttaacctgcaattactgggtgaaaagagtaggatatagtaaaatgcaaatgctagtttagtaaatggcataaagacattgaagtgtccctggacatcagtcacgtggctgtggaagggagacttagggtgtggctttccccatggaccatggtgggtctttgggatccctctcttccccaccccagtcctttaaagacccaccagcgactttgtgagattctagactcctttccctcgtacctcctagccttattggatggaaaagagggaacagtggttcctttctttctgccacgcctccaccttccattggagactcctatttctccctccgtgacatctttgctgaacagaacagctcttaaaccagaccttatctgttccatgggtgcagaagggtgcaatgtgaacagaaacagcaagtctctggaaaagagctccttcagctgcaaagaacacagaggtcaggaggaataaagctaatgagagagcagagagtcctttgtctccccaggtgttattcccagagggcaactagggaaaatggagatggggtataaacatctgaattcactgttaaacactccatgaactgttgataattccctagaagcagcatattcctgaggtagcttcatatgatctccagaagcaacttacatgtagacatttttctgagaattccagaaagaatattgataattttcagacaccatggcttccacgcctcatcaacatgagcagtattagtctttatctctgacatcaatcaaacttgaacaccatcagcatgggctttaatgaaattctcacatatgtatcagaacttgtattttttcctttagtcagtgtcttgatccatttgtgttgctgtaaaggagtacctgaggctgggtaatttataaagaaaagatgtgtattcggctcatggttctgcagggtgtacaagaagcatgatgccaggcatccgctttgggtgagggcgtcaggctgattctactcatggtggaaggagaaggggagccatcgtgtggagatcacatggtgagagaggaagcaagcggggagtggaggtgccaggctctttttaacaaccagctgttgtaggagcacagtgagaactgactcactacctagagaatggcaccaagccattcacaatggatccgtccccatgacccaagcacctcccatcagacccacctccaacactggagatcagatttcagagtgagacttggtggggccaaacaaatcatattcaaaccatagcaattagaatcttaaaatcaaaattgatggctttatttttctaaaaatgggaaaatatctccaaaacattgttcaaaaacaaaacaaaacaaaacaaaaatgtttgttcttatatcccatcagtttattcaactaacattcactgtggactttttataaggcagtaactgttttatgaataggagatataaaactgggtgaaacagtgaggttcctggccactgtattgtaataatagaggcacatataccaaagagctaaaatacaggcagcaaactctagggactgaagtaaatttccttaatttaatgaaatgtatcaagcagaaacccacaataagcatcatacttaaaggattcatttgaatttttttatttatttttattaaatcagatatacttttctagtttttttaatttttattttttgcatttcttgatcatttcaaagtgaggtcagttacagagtgaatgggttcatcctgtcattgtaaataacagtttttcgtttaataatggcattttgtattaccaagaccttgcttcacattaggtgttttgtatacattatctcatttaatcaaaaccagcactctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctactaccctctaatgttctgtgagggtggaacacctaacctagaatttccctgtggatcactcacccccaatgatggcatgtcttgctctggacccatgatataatgatctggatacagccaaagtcactaagcacgctacaccctagcctttcaattcctttattacttcatggagaatcatgtatttcagccactcaagtatctttaaggtctaggccttatcgaatggggtttagtcactcagtacagtctgccctttgtactcatgagttcagcattcatggatttgaagaactgtggggtgaaaatattccaaaaaaatggatggttgcatctgtactgaacatatacagacttttttcaatatttcctaaacaataaagtatagcaatgatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccccatggacattgaggaatgactgtgcttcccctacccaacagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtaactcctttcacatatctcttcccttgccagaggaaggaactgaggctcagaaaggttcaattcctcacccaaaggtttccaacccaaggtttctgacctggagccctgctctttcctccacaccctgctgccattattttgtcttgttgggctggggaagggcaaagagggtgcccactgctggatgaaagaagcagctacattcccattcaaggtgtgctgagcccagtcctaactgctcaagtctttcttaggtcttatgatggaactgaaaagcaggctacctattttatccaggaagcagacagaggatacggatgggcaagcacttctatcagatgctggttctgttgtaagacatcatcaaggttcctccaacccctgctcctcatcacactgcacagccctttggcagagacagggagaagcttgttgtttgagacatctggagttagaaagtatctgagctttaaatggagaaggagtggggagaaactgacagtgaagtgtagacatgaggcttagagagatgctaactaagtagtcatgagtcgaatctcccatttagtcagacacatttttctagtttttctagttttctacccttcaaaatactttgtgttaaactcaattacagagatagatccttccattcatcaagtgaattttagaagccacacctttgggtgggtcttaaaagcagttcatgggaatctataggctattgtgtataactggagggtagcagaaaacaagttccttgtgagatcagacacatgagctaaacatttaggaaaaccttacagaagcaaatctttaacggaagggtttccacactgagggccttgtgttgcttttgggaatggtgtagaaatcacgtgcttagtcttgaattatgattcacctttactgaatgtcccttctcttttctttactcactgtcgaacaggaacccaaaggatgtagtttttggcagatgtcctttgtagggttcagtatttctcactcacccctttaagaccctaaagggagagttattaatagtttcagaaagttgagggaaatcatgcagaggttctcagatgttcagagaggcttcctctccccttccatgaaagttctaaggctcatgggtgaggcctaagaaaggcatgtcagttgtctatcaagttcattagtttattcagcttatttctgaagcttttgatgggccggctattcagaggtcaatgaaatagacatgagtactcttcacagaccttaccgtctaataggaatgatagcaagtgaatgtataataaataaataattaggggttgattgttacgagtgctatgaggggaatagccagggtgacatgtttgagaaggggtcagtactgctaagtgttggtcagggaagcattgcaggcagagggaacagcaaatgcccatggtttggaggcaggaatggtgttccaagagtagtagggagcctcgggactagagtttggaggatgagcggggagagtgggaggagatagtgggaaagtctgtggagccagttccctgaggggcctggtgggccatgctcagtgggggtttcatttgacgagccatgggaaggcttccagcaatgggggatgtggttttacttgtaccttaagaagatcacactgggtcttgtttggagaatggacaggaaaggagcaggagagcaagcagagagtctgaggggcaagaaatgccctgtcctcccagcagactggagcgaattctaattctgcctctgctacttcattcctatgcaactttgggcaggtttcctaatctctctgcctctcaactgttcacccctcataaaatgaggacaagtattttctcatgtggtttctaggacaaataagtattcgtaaagtcctctataaacttgggccatatgcttatctgagctataatatgattcatattgaaaggagggggactcctgcaatgttgggaaaacgactcagctgcccctatataaggaatatgttattacagtccgagactaaaaagatgcttttgtttctttactgccatcagtgtctctctaagggagggcggctggttaaaaatcacatggtgtgggcatttataggggtaataacttgaaatgattaaaccctttttttttaaagcttcatgtctctgttctccatctgtaggtggtgcatgagtatgatatagtgtgcatgtgtgacatgctgcgagtgtgaggaatgccagagggagacccacgaaactgccctgcaggcagaaggccacatgctctcagcaccagtcagtggtgctcgctagtccggcagattgctgtattcttgcaccctgtaccacaacattgttaggataaagtttcataagtcttatatggctttgaacaaagcaagtctatttttcatcatagtatgggttatttagaattcatatgttatgaggaaatacactgtttcaaatgcagttttctttgtggtgtctcagcagatactgagttttgctgccctgtcatccaagagggcctcaaggtgcccagagagaccaactgaaaaatgttcactggaacggagctgcaatggtggaaacgttctgtgtgtgccctgttcagtacagcagccactgcgcggctgctgagcccttgaattgtggctatcagggtagaagaactgatttttaatatattgaattatgagtcatttaaatttaaagagcacagctgtattggacagcacagctgtagaaggatgttttctctcatggaaaaccccaactctgagccccaggggtcctatggatccatgagctcacagactcccctaacgtccatgaagatcatcaccaggatttgagggaatgctgtggtgcatactttgtgttggacagttatgggggattgcttttgccgtctcagcatttcaccgctgtcctcggtatgagattatggtgatgttgaatgggggtcattagaaggctgtccacagaggggatcagcccccctcaatgaccactactccgagcatgggctttcttctgtttgatctcgttgggccctcagctgtgactgtggagaacagcaagtcctcagtgagagtatttgtcacttcctactcttggtgtttaatatcatccctctggcacagatgcttgaaaatcaatggtttcttgacacatcttggcttgtgtgaggggccataacaatagcagggctcatggctcctttttttttttttttttttttttaaagagatagggttttactctgtcacccaggcaggcaggggtgcaatagagtgatcatagttcactgtaacctcgaactccaggtctcaagggatcctcctgcctcagtctcctgagtaactggatctatacacatgtgcccccgtacctggctaatgtggcttcctttatgttcagcaaggaactctcagtgtttgtccatttccttaggaacatgagtgtttttggaaggcctttgatgagtggcagttgggtggatggatgagctaatacatccatcatcctatctcaggaggatgcttggatttgtgtttagaaattgggtaactcagttgttcatggaggaaaaagttgaacattactcaagtgcagatagggaaacagtgtaagaacaaaaaactttttttctatctacaagtgaggaaaaaaatattgacagtgtgcccaagcttcatggtaggatgggtgttaattgggaatggcatgtaattctcttctggaatccagtgtctgggcaagtcctgcctctcagattaaggcaccagcattcagcataagagggtcctgcctctcagattaaggcaccagcattcagcataagagggagtaattgacattctacatggcaaaagacccttgaaagataacagatgaatgtctcatggccagtagcttggtttttttgcatggtgtagatttagaatataacttttacagggaagaaaggggttaaaatgtctggtgccatctgtcacagtaatgagttgtgcaaagcccaatgaaccttgtagaaacaacatcgtgcccagaaatagcctagacctcagagtgacatcagggggcagggacctgatagatgtggtcctgcaaaaggaccgaaggttcttctttaacaattcaaattgaataggaaccatttttaatttgggggtaactccgtcttcaccattaatggccattcttcaaagctactttcattcctgtgagggatggccagacacgagaaagccaagcagggattttcagttacaggtgagcatccgatctgcagccagggctttttctaccgggcacatctttgtgcgcagcctggtttgagctgatctgcacataaacaggcactctgggtgtggatgggggcatctgtgtactctttatggctatatttccagaatatgcttttaaagactgtggtcacatttaccttggttagggaagatagtgacttataaaaacctcaaacatttatgtttccctttccaatataaaaagtgttaataatttacccacttaaaaggttaagatcaaagagatcataaacacacatgaatactatttcaggaacataaaattcagctatttctactaacagaaagtgagtttatgggataccaatgcaaacaaacatagatttagtggaaaatgactcaaccaagtaagatttacaaaacaaacaaaactgttttcatcatctttggttgtagttttataaagaatgctggttcatggactccagacacttcattgaaactgtgtgaatcattttaaacaggtttgtccttgggccccagatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatggtgtgttttatacgtctagaggatttttgttgttgttgtttctttgaggttttctctgaaacttcagattaaggtagtccttgaagtggaggctattaagacctagtgttatctgtttcagggaggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccatgctctatgcttgcccgcctcttccatcaggaacactcacacagtcattctcctcacataccccactctcatctgctgcccctcacacctgcccttctatagaatgttctaccctttaatagggaagggtttcttcttcctatgaatttttacctcactttgtgtctttttaggtttgtattggaactatttgcaaacaggtcttggcttatctaaagaaaaattgtaagctccccatgacgcaagacagtatcttatttacctttgaaaacctcatcacactctgccctgctcagagtacaatctaaataaaagtctattgaatgactgaagtagagtttcttttttaacacttatatgcacattcttgtgacaggcacagtgaaagatttatcaaggaatgacatggtccccacccatgacactgttaaatccataatttgtgatgcattgtttttagttatctagtgctgctgaacaaaccactccaaacttaatgatgtaaaacaacagcaattttatcatgctcacagacattgtgggcaaggaattcgggacagggcacattggggatggctggtctctgctccatgatgcctaggacctcagctgggagagacttgaacagttgggggctggtgaatccatgtctaagcttcttcattcacatgcctgtcaccttggcagcatggcctagaagcctgggcttagctgggcctgagacccccagcattctcttcaaggttggggaattggaccctacatttgatgggagaattagccagttcatgttgcagaagagcatgtggagtcggagatactttacaagcatctatggaaaatacagtctgaagtgaatgcccaaatgagtggcaccaacactgattattactgggtgacagaggcacatggagaaaatgtcatgagggaggaaatgctgggatttgccttgacctctggctgggggacggggagggatgagaggtccaaggcaagatggataagtgggaataagcagccttgttttggggaaaaagagggacagacctagaatggctggctgggtgaaatggcttgttgtgtctcctaaattagattttacatttttgagggcagagctacttaatattgtatttaccccagaggaagattatttttttcattctctaaattgtttaattaaaactcatagttcatgttaaatttgttcaaactttccatctaatggtgaggtggtaaaggaaataaaacttaccaaaatagaagagggagaaatgaaaaggaaatatgatcaatgatttctgttctttttacttcctacttgcaaagactctggaaatgtaatgatggttcagagtgttctgctataaatcctaacagcttaaacaatctcctgggatcatattggcaaactctaagatgatacaagtatagacttagtttgtctgagcccgaggttcagtgtttggagaaaaataatacctatgtcgagataatatcagataacctataaaagcaggtagcccagtcatgcacattggtgatcaatcaatgttagctgaatccaaatattacgagtgcagatgctgaaaggaacaaaaggaaatctcactcagtcatccatctgccagtatttccaccctttcccgcaaagaggagctcagtgtctgtctctgttattgcatcaggatctcacattatccagtaaacccaaatgctgtaggtaagagatgtaataggtggtatttattaagtggttttaataaagttttgtggataggtatgacaccatttcttttgagcttaaagatgcttaaaatagctaaggttaaaaatgagggaagatctgaaaagaaaaacagtaaagagatgtgagatgtaaacactgaaaggaagtaagggtagagcaaaaaaaaagtaaagcatcaggtaaatatttaataaaatgtttatacatgtatattgactgtaggtgtagggttagtctattgaataaagctgcctttcttaggaatggtggtctcaaaatgcaccagtgccttcctattggctgaatgtccacttctgttctatgcactgtgctaaagggtggacatgctgagatgagtgtgagtggcctctgcaccaaagagttcagtctaattctgggggttggggataaatatgttagccagtaaatgccatttattgctttagatgtcatctcagaaggataaggagcagtggggacaggaggagcaagccatctcctgggggagtcaagaaagatgaggacagagagagaatgtcccttggatccaatatggtggccattagtgaccttgttaaaaccagtaggaatggggtggcaagaaggagagtagaacagactataagaaagaatgagttttgatgaaagtattggaattttgatgaccttttttattacaggtttgggagcaactactttcttcactctctaaactgcaaatcattcagggtaattgtgctggttcagttagcccccaagctgagaagacaggcccactgtggtttgagtaacttggaaatcttgtggggtcagtgttttgactctcttcattttggtcatggttcaggattttcacacaccactaaggtctaggggaagcttctcagctttctggataccctctcagggctcatgaagtggcaggcctgccctgggaaggtcaggattcttctgtaaaagcagagaacactgcatggagcccagagagcccactctctgcgctcttcccttcctatgggctcacacggggaaacagatgctttcctataactctgagcactgaagcagctttgctctgccttggccgaaacatctatccaggaccaaattcttaaaaccccaggggccctggggtgattttcagcccaggccctgaacctgtcataaaatgtaatggatgatatatttttaactgctgagaccagagagttcacataacctatgaagactgaaacaacataatgtttctgcagttttgaagcatttcaaaaaccagaggatggtctctctcattaggcattactagtaagacaaaagttcttaaccatttctgtgcgtggacgcctttggccgttgggaagcgcacgtggatcctttctcagaatatgcttttacatacatagaataaaatacatagaattacaaagaaattcagttatactgaaatggagttatcaaaatttttaaagaccactttatgatataataatataccagctttttcttgatgcatgaaataagaagatctacagacattttgagtactgttaagcataaacaatatttcaaggtgtctacaactataatatagtgtgtaatatctcagatttctatcgacggtagagtcacaggtctttctaatacttttgtggtttgatgcctacattttataatggaaggaaatgctaaatttcagttagaggttaataaaaataaagaaggaaaattcttttcctctatctaaatccacagatgccctgaattctcttcgaggttaagaacttctggtttaagatatgcttttggttgacagtagtaaaacaagccaaaagaagttgaccatttatgtgatgtgcagtaataaattagcaattcagagttgaggagctcattactaatctgtggatagtcctaatcccagcccttttctttctgagctttgccttttgtaaatctcagtgcttcacacacatcagacaaagatattttgtgagtggctctaaaaatgggggcaaaacatgaccctgaggaggcctggggctgatctgagccttaagacttatttgtggagaccttgtgctgttctttttttttttttttaattatactttaagttttagggtacatgtgcacaacgtgcaggtttgttacatatgtattcatgtgccatgttggtgtgctgcacccattaactcgtcatttatcattaagtatatctcctaatgctatccctcccccagccccccaccccacaacagtccccagtatgtgatgttccccttcctgtgtccatgtgttctcattgttcaattcccacatatgagtgagaacatgcggtgtttggttttttgtccttgcgatagtttgctgagaatgatggttttcagcttcatccatgtccctacaaaggacatgaagtcatcattttttatggctgcatagtattccatggtgtatatgtgtcacattttcttaatccagtctatcattgttggacatttgggttggttccaagtctttgctattgtgaatagtgccacaataaacatacgtgtgcatgtgtctttatagcaacatgatttataatcctttgggtatatacccagtaatgggatggctgggtcaaatggtatttctagttctagatctgtgaggaatcaccacactgacttccacaatggttgaactagtttacaatcccaccaacagtgtaaaagtgttcttatctctccacatcctctccagcacctgttgtttcctgactttttaatgatcaccattctaactggtgtgagatggtatctcattgtggttttgatttgcatttctctgatggccactgatgatgagcattgtttcatgtgtcttttggctgcataaatgtcttcttttgagaagtgtctgttgatatcctttgcccacttgttgatggggttgtttgttttcttcttgtaaatttgtttgagttcattgtagattctggatattagccctttgtcagatgagtagattgcaaaaattttctcccattctgtaggttgcctgttcactctgatggtagtttcttttgctgtgcagaagctctttagttcaattagatcccatttgtcaattttggctgttgttgccattgcttttggtgttttagacatgaagtccttgcccatgcctatgtcctgaatggtgttgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgttttcgtcaggtttgtcaaagatcagatagttgtagatatgcggcattatttctgagggctctgttctgttccattgatctatatctctgtttcggtaccagtaccatgctgtttggttactgtagccttgtagtatagtttgaagtcaggtagcgtgatgcctccggttttgttcttttggcttaggattgacttggcgatgcgggctcttttttggttccatatgaacttgaaagtagtttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgcacattgattttgcatcctgagactttgctgaagttgcttatcagcttaaggagattttgggctgagatgatggagttttctagatatacaatcatgtcatctgcaaacagggacaatttgacttcctcttttcctaattgaataccctttatttccttctcctgcctgattgccctggccagaacttccaacactatgttgaataggagtggtgggagagggcatccctgtgttgtgccagttttcaaagggaatgcttccagtttttgcccattcagtatgatattggctgtgcgtttgtcatagatagctcttgttattttgagataggtcccatcaatacctaatccattgagagtttttagcatgaagcattgttgaattttgtcaaaggccttttctgcatctattgagataatcatgtggtttttgtcgctggttctgtttatatgctggattatgtttattgatttgcgtatgttgaaccagccttgcatcccagggatgaagcccacttgatcatggtggataaggcttttgatgtgctgctggattcggtttgccagtattttattgaggatttttacatcgatgttcatcagggatactggtctaaaattctcttttttggttgtgtctctgccaggctttggtatcaggatgatgctggcctcataaaatgaattgggaggattccctctttttctgttgattggaatagtttcagaaggaatggtcccagctcctccttgtacctctggtagaattcggctgtgaatccatctggtcctggatgttgtttggttggtaagctattaattgttgcctcaatttcagagcctgttattggtctattcagagattcaacttcttcctggtttagtcttgggagggtgtatgtgtcgaggaatgtatccatttcttctagattttctagtttatttgcgtagaggtgtttatagtattctctgatggtagtttgtatttctgtgggatcggtggtgatatcccctttatcattttttattgtgtctatttgattcttctctcttttcttcattagtcttgctagcggtctatcaattttgttgatcttttcaaaaaaacagctcctggattcattgatttttttgaagggtttttgtgtctctgtttccttcagttctgctctgatcttggttatttcttgccttctgctagcttttgaatgtgtttgctcttgcttctctagttcttttaattgtgatgttaggttgtcaattttagatctttcctgctttctcttgtgggcatttagtgctgtaaatttccctctacacactgctttgaattgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgaatttcttaatcctgagttctagtttgattgcactgtggtctgagagacagcttgttataatttctgttcttttacatttgctgaggagagctttacttccaactatgtggtcagttttggaacaggtgtggtgtggtgctgaaaagaatgtatattctgttgatttggggtggagagttctgtagatgtctattaggtccacttggtgcagagctgagttcaattcctggatatctttgttaactttctgtctcgttgatctgtctaatgttgacagtggggtgttaaagtctcccattatattgtgtgggagtctgagtctctttgtaggtcactaagggcttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgccattttttgttttccgtttgcttggtagatcttcctccatccctttattttgagcctatgtgtgtctctgcacgtgagatgggtctgctgaatacagcacactgatgggtcttgactctttatccaatttgccagtctgtcttttaattggagcatttagcccatttacatttaaggttaatattgttatgtgtgaatttgatcctgtcattaggatgttagctggttattttgctcattagttgatgcagtttcttcctagccttgatggtctttacaatttggcatgtttttgcagtggctggtaatggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgcaaattcttttctttaagaatgttgaatattggcccccactcccatctggcttgtagggtttctgctgagagatccactgttagtctgatgggcttccctttgtgggtaacccgacctttctctctggctgcccttaacattttttccttcatttcagctttggtgaatctgacaattatgtgtcttagagttgctcttctcgaggagtatctttgtggcattctctgtatttcctgaatttgaatgttggcctgccttgctagactggggaagttctcctggataatatcctgcagagtgttttccaacttggttccattttccccgccactttcaggtacaccaatcagacgtagatttggtcttttcacatagtcccatatttcttggaggctttgttcgtttctttttattcttttttctctaaacttctcttcttgcttcatttcattcatttgatcttccttcactgatatcctttcttctagttgatcgaattggctactgaggcttgggcattcgtcacgtagttctcgtgccatggttttcagctccatcaggtcttttaaggacttctctgcattggttattctagttagccattcatctaatttttttcaaggtttttaacttctttgccatgggttcaaacttcctcctttagctcagagtagtttgatcgtctgaagccttcttctctgaactcatcaaagtcattctccatccagctttgttccgttgctggtgaggagctgcgttcctttggaggaggagaggcactctcatttttagagtttccagtttttctgctctgttttttccccatctttgtggttttatgtacctttggtctttgatgatggtgatgtacagatggggttttggtgtggatgtgctttctgtttgttaggtttccttctaacagtcaggaccctcagctgcaggtctgttggagtttgccagaggtccactccagaccctgtttgcctgggtatcagcagcggagctnnnnnnnnnnnnnnnnnnnnaacagtggatattggtgaacagcaaatgtagctgcctgatcattcctctggaagttttgtctcagaggagtacctggccgtgtgaggtgtcagtctgcccctactcggggatgcctcccagttaggctactcgggggccagggacccacttgaggaggcagtctgtccattctcagatctcaagctgcctgctgggagaaccactactctcttcaaagctgtcagacagggacatttaagtctgcagaggtttctgctgccttttgtttggctatcccctacccccagaggtggagtctacagaggcaggcagacctccttgagctccggtaggctccactcagttcgagcttctcagccactttgttaacctactcaagccttggcgatggtgggcgcccctcccccagccttgctgctgccttgcagtttgatctcagactgctgtgctagcaatgagcaaggctccgtgggcgtaggactctccgagctaggcacgggatataatctcctcgtgtgctgtttgctaagactgttggaaaagcgcagtattagggtaggagtgacccgattttccaggtgccatctgtcacccctttctttgactaggaaagggaatgccctgaccccttgtgcttcccaggtgaggtgatgcctcgccctgcttcggctcacgcttggtgtgctgcacccactgtcctgcacccactgtctgacactccccagtgaggtgaacccagtacctcagttggaaatgcagaaatcgcccgtcttctgtgtcactcatgctgggagcagtagactggagctgttcctatttggccgtcttcgctgttatttttaagaataaattttaaaaggacaaagtaaaactccaagttgaacttaatggcaaggaagtgtcaaaatgagactctgcatgtaactccccatgcctctccactactgatatggatctgcctggtccacatcatcctggagtgctagggtgaccctagcactgtatccagctcttctcacctctttaggaattttaagcccacaaattaagtatggaatttattacatggtatcttgcatttcagaagcagaatctgagatggggatttttgccagagatttattgggggagtgctctcagaagtgaggaaaacagaaagggacagagaaaaaaatgttgagtaaggatgtggtctcaggaaaagtctagcctcagcctgatcccgtgcagaagctctggagcagagcttatcccacccagcagcaagggggatggggtgttatcctgctgcatctgccagctagggaatggggcaggtattagttttctaggccacttcaaaaattacaaatttagcagcttaaaacagcataaagttactatctcacagtttttgtcagttaggagtctgagcatggcctgcttagcgtttcacaaggccgtactcaaggtgccagccagatcttttatgcggcttggggtcttgctccaggctctcatggccgttgctggaattcactcctgcagctgtggagcccagggtgacttgcttcttcaagactagcagaagactctttttgctgcttctagtctcttagctcagccttccagtctcttagctcagccttccagtctcttagctcactgctctccaaggattcttgacacttgcactccaacccactctgggtcagaagctattcctccctgtgaaaggggtcacttgagtaggccaattcacgccatcctttctgattcactcaattgagctgattcagaactttaattacatctgcaaactcccctcacctttgccatttaatgtaacatcacaggagtgagaaccatcatatgtccagtccttcctaccctcaaagggagaagattatacaggggcatgggtcactggcatcattttaggattctgcctgtcacagggcgtcacttgcaggcttcgctggaggagatggctcctgtcacccaagggcagttctcctgagaaagttgtgggcataagcaatgcatgtagcggctagggcactgaggtcccgtgacctggttccagcctgctctccttccctgtccatagtccctccctgcccctcccccgtgatcttgccccacagacctttctcaggtggcggtggtgatggtgttgtaggggcaactggcttttttagagtgtcaggagctctccaaggtgcttgacatccatttctctaatcttcacaacaagcatgcaaggttgattctgtcatcccattttacatctgagaaaacaagctcagagagagtaagtaaagtggccaaggttgcagtttgcaagaaatggagcttggaccccctctgaccttgaactggctgacatcaaagttgtcgctttgcctggtcctgtcacctctcttcctcagatgtctagtgtttattagacctccatagtatcttcaccaactgagaaggtgccccatcagcctgaggaactcccagggtcacccctctacaaggattcttgacacttgcacttctacccactctgggtcagaagctattcttccctcattggattgccaccattcttgtaagggcaccttctctgcaccacagttttttgctcacactcctcctatttttctcttctcagcttccctatgcctcatgatgccaggcataaggcacacagcaaccaagtgttggcagaaggcaaattatatggtttggctgtgtccccacccaaatctcatcttgaattttagctcttataattcccacatgctgtgggagggacctggtgggagataattgaatcatgggggtgattttccccatactgttcttatggtagtgaataagtctcatgaggtctgatgcttttataaggggaaactcctttcacttggctctcattctctcttgtctgctgccatgtaagatgtgccttttgccttccaccatggttgtgaggcctccccagccatatggaactgtgagtccattaaacctcttttactttataaattacccagttttgggtatgtctttatcagcagcatgagaacagactaatacaccaattgaggttcctccagagaattaacaaaatgtccatgcactctttcgttgttcccccatacccacagacctgccatccctggccctgcctggatgccggtacctggccactgctgctatattccatgcttttggacaagagcatgttcagtattgtccaggagacccagggagctcaagacagagctgagatccagttcctacagccacagttaacaccccagcccccgacacacacacagacttttcaatgcaaaatcaaaccattcccaaatatccagctacatattgttttacctttgaagagaaaaaagcatcagtggggttatgtgattttcatagatgaacaatttttgcaaatatgttaattgaagagtaattggtgctttcttgaccctcctgagcactgatgcttgccaaagggttatacatttcagactaatgatgatatccattactatatgtgcaattgcttataaactaatatatagtcatattaaaatctctaatctgattgagaaattttcagaaacaaggtacactgattttctcaccacttatttcctgctctcatgacagaatttctggagttctttgaattcacctggtttttggagctctgtcaagtcaatatttataactgaactagttcaaacagttcaagcattgtctcttcctttctggttgaagttctgtcttagaagactgttgtagtcagctgtgcttgtcataaagttttgtttaaaattattttagaattttcttctttggctttaatttaaatttttgtttgtttacttttttttttttttttccccggctcactgcaagctccacctcccaggttcacaccattctcctgcctcagcctcccaagcagctgggactacaggcgcccgccaccaggcctggctaatttttttgtattttttagtagagacagggtttcaccgtgttagccaggatggtctcgatcttctgacctcatgatccacctgcctcggcctcccaaagtgctgggattagaggtgtgagccaccgtgcccagccttgtttactttttaatttataggattgtaaatgaaactatacttggcctcagtttattctctgggaaataggttcttgctacaggtacagtttataataaggatttatttcataatagggagctttttatagattttaatatcatagttgccatttaaaaaattgtattaaaggccgggcgcagtggcttatatctgcaatcccagcattttgggaggccaaggcgggtagatcacctgagattaggagtttgagatcagcctggccaacatggtgaaaaccccgtctctactaaaaatacaaaaaattagctgggcgtggtggtgtgtgcctgaattcccagctactctggaggctggggcaggagaatcacttgaacctgggaggcagagattgcaatgagctgagattgcgccactgcactgcacagagtgaaactctgtcaaaaaaaaaatgcattaaaaatggtaatgatcaccatttattgcttgcctacagtatgtcagtcattatacaaggtatattttataattataaatattatttattatctgattacaaatatgttataccttgcactgtgtcctgtatgtctgttatgtttatttctgaattttccttcctttttcctctccatgctttgatctggatatttcctattgagagaatacactgaggcccagtgtgatttcattcacaatcctataaattaaaaagcaaacaacttctgggtcactggtcgtcttttctgctgtgttcaatctccagtaaaatatgtcagcaccttaaccactgtcctctgcctggtttcttagtctcacagccccgtgctgctgtagaattggcagatgccttgaggacaattgtggcgtacagtaaacatacctcaatatacttatttctgtttgggattttcgcccctcaagtcctcattgcgttattagccctgagctcttaagttttgtcttcacagagtcataagacttccagaaattcagcttagaaactcaagaacttagctttttagccactgcttcactttcagtttcatagcctctcatcccacactgcttacaaatctggaaacacctcaagggaaaagtgcccataaatgttggggttacctccacattctttccttctctttgggaccctatactctgaagtcctggctgtcttgatagttagttccctgataactttatatatttttaatttttttaaatgaacctggcatttcaaacataagttccatgataattttaaacaggggtgtgtgtgtgtatgtgtgtgtgtgtgtgtctgtgtgtgtgtgtgtgtgtgtgtccagcttttcgagttgtccgtgggaggacggtttcagtaagttactctatcattactggaaatgcaaaatcctgttttcttttaaaagagtcttcaagctgatgaaaattttaaagtagcttataacattttaactgtgatcttatttattatgagtatagagataaaggaaaaggcatcccacttctgaagatttctcgtttctaggagtgtctacaagattatcataggtgaaagtagggttggatgcagagaaatagtaagaaaggatggaggatggaggggataaaaagatcacatgtttggtgaatcctcttttaaaaacacttagaagattttccctaaactaattatctggcttaatgctaactgcttatttgctgaccttctgctttatttacaaatttaaagtggggccaacccttcctgttttcctttaatttaccccggcagctgctggttagctaaggaagaaaaaaaacccttttttttttttttttttttttaatggagacaagcagcaattaggtaggcttctaggtcaggtggccagttaggggtgccagggttcccaggtccagctttcttcgggtcatagagtgagggtgggaatcaagtcactcagatatttctcccgaattgaaatgcgtgtcttcctttggctgggcagatgaggtcccctcttctccatctctgctgctgggtcctggtgcaagcccttactctctttccactaaacccatgtggcagcctcctccttagcctgtttctccccagtcctgcacccatcagtccactgccacacggcagctacagggacctttctagaacacagcctcctgctgcctccatgttggcctccctgcccctgtcagagggatttttatttattttatttatttatttttgagacagagtcttgctctgtcacccaggctggagtgcagtagtgtgattgcagctcactgcacctccgcctcctgggttcaagcaattctcctgcctcagcctcctgagtagctgggattataggcgtgctccaccacgcccggctaatttttgtatttttagtagagatggggtttcaccacgttggccaggctggtctcaaacttctgacctcaggtcatccgccttcctcagcctcttaaggtgctgggattacagacgtgagccaccatgcccagccaagagggacttttctataacagcctctaggatcatgctacccccttcccagctctccctagcttttaagatcacataacctgcaaagtgccctgagatctggttctgcatgaatcttctctaccctattgctgcctatcaacttgacttcccacctttgggagtcagatgcagtccgctggacagcccatgccctctccatgtggctataccacccctgccttgcccctgctctctgcctgatgtcctactgtcttttgactgtgcccaggggcatttcctctgggaagcctgccagccctcagtctgaacctttgggtccccaaagcctcccctgtcctggtatgtgttgcactgcgttgtcatctcttgtctgtttcccctgagactcattattccctgaaggtctttcatctctgtttccctgtggcccagcacattgcctggcataaagtaagcacccaataaatttcagatggagcatatgttaagttccctataaaacctcagctgctgcaaattctgccaccagcctgggtgttctcctctgtggggactccttcagttttcagagacaggagactcccatagatttttagcaggaaaaggtagattcttgccttttagtctgtcagaatgacactttattagatgctttagaactgcagaagcttcaattttagaattttcagtttgtagcgttattttttttaagcagtaaaatttcagcgactatggtctgtgccagagccctaagcctctttctccatcctaaggagtttctctgcttaattgcagtgctgagctcagggaagctgcatatccaaaaatgaaaaggaaaccgctaaattgtgctgctacttttcctttgcagctcagataaaacaggcccagtgtgggaagaaggggctgtccttttgggggtgttggcctgtttctaattgctgcaccctcctctgcctccacccatgcctcagtgtggtttgggtcccttctgcccagagctactgggacatgtaataagaagctgcttttcagacttcttaattaaaataggttccggcagccattgccaggaagcagcattcgcacccctacatgtccaaatgcattactcatccaaaataagatatgccacgactcaggtttccctccttagccaccatggcttgaatggctgcatttagaaacagcccttacttcaagcccctatttcttaattatttgtcacttattcgcattcatccttgtgtgtgaaacatttttcccctcaccctatatgctgttatgtaaacaagtaattttttaggatgatgtcagaacctgatgtagttggggtggttttaaaatagtattttatggacagcaagaaaagtagttttgcttctggtttcacttgctagctttgggatggagggacatttatttgagcttctgcacctctgtgatcttgtctataaaacggggggcaatggctggtgctgtggctcacacttttaatcccagcactttgggaagatgaggcagaagaatcacttgaggccaggagttcaagaccaccttgggcaacatagtgagaccccatctctacaaaataaaaaataaataaaagaaataaaagaatgaaagttagctaggcatggtagtatccaactgtagtcccagctactcaggaggctgaggcaggaagattgcttgagcttaagagttcaaggctgcagtgagctatgattgtcccacttctgggaaacagagcaagactctgtctcaaaaaaaaagtggaaggtgggggtcaataatctgccagctcaggtattgtaaggattaagaaagacagtgtctgtgaagagcttggcccagtctctggaacacatttggtagccaggaaatagtaaatgacttctgtttccctacccccatcttcacctcctcccctagaataacaacatcataactgacttatttcatcattaaggatttaaatgcaaaaccttaagatagtcagccttagggaaacactgaagaatttatttttaaacacataaagattgcattcattcatccttctccacaccgcgggcagtcttcaaattctggttagcagagtcagcgggcagggaggatctggatcctggggttgtgtgctttgctcccagaggacatgagtatcaaaggtctgccccgatatctggagttcaagaggcgttttctggaaacaatttgtccaaaggctcccctatcactctcttggagaagtcctgtgttttatttatgctgaatgattgaatctattcccagccgaatgttttcctgaacaccagtaaaaatcatctgccagtcactcgggctcccaccccgggagtcatctgtcccctttgcctggtctcccatgcctcacagctcagcagccacaggcatggccatatctgcctctcttgcccttgccactccacttcatcatggccgtctcctctctggggctgctgcgggagatttccagtctgccctccagtgtctctgcatgcattctactcacctcctctccccccgcagccccgaggaactctgaagaaacacaagcttctgtggccccgtacacgtaggactaccaccgcttacttggaggcagtggcagtaaaaacggaaacaacaaacaaaacagaataaaatcctctttaactttgtttaacttggtgtcccatgcagtctatttaatttcagactcttatttaccccagtcctagggaactgaggttcataggaccaatctgggtgaatgctgctacagtttgtggatgggctgctccccatttgcttgttcaggtagctttgagcccaaacattggtcagcaagggcatccatatagtgacatgctgtatgtcatcaaaaagaaggtgttcctgacatagacaatttccagaatatatgctaagtgactaaagcaaagtgcagcatgagatgccaccatgtgctgcagatgcttggactggatggatacctaagtacccccaaactggcaggcacatctgcctctggggaagggggctgggtgtcggggaggggtgggagcaaattcctccccgtgtgcctcctggggcctttagaacctctacttctttgaacacagtgctactctgctccaaacgcccccaaacttcacacagagagtagtatgaagtcctcatctctgcacttgtggccctgaggttggcctcagcctgcccgcccagcttctcttctcattcttccctgctgccactctcctgtctccccagggactcggctgtttgagccactttcctttgacacgtctcagacttgccctgctccacttggaagtccttggagcagcccacacgcacccccgccgagctcactgtctcagaatgtgggaccacctaccagctttactcctgcgtctaactctaacttgtgagattgtgggggccagagtccccaggaggcagtgacgctgtgtgcagaaaagccaagagctccagggctgaacagatgtgactgaaaatctttaccagccatgtgccctggggaactgagcctttcatttcccctttccttttctgtatattggaggataacaagccttcactcacagggcgtgggtgtgtttctcatctccttgcagcacctagcacagtacctggcatctcatatgttcagggcatgtttgctctcctcccttcctttcccatcgtgactgtcaatcgactgttcccttggggcttgagattcttggattccaaaggaaagaacacagggccaggagtcagaatttcatccttgcctccgctgatgtctaattctgggataacgctgggccactcagtctttggattccctgccctaacacaaaatccatatttatctcaatgcaaaagagatgtggtcatcgaaacactgaatgcaaagggttagcagagtgagcacagatgttctcccatttgccaactggtttctaagaatatttggaggatgagtaaagtaatgtcttccatatgctcaagagaagatgatttagcaccatgcaaggtagagaaggagagcccccacccatcaacagaatgaccttggacaagacactagctgccctaggcctcaattacctcatttaaaatatgaaagtcataaaaccctacctcacgagggtgattgtgaggattatatgaggcaattcatgtagaaggtctttgtaaactgtgaaatgctctacgactgtcagccaggattagtagttaatgcacgtatttgtttattgtttcagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacagagcagaaataatggcccaaaagttgagagagccgtgggcctggctgctcaggagaccgcagccaggacacacctcctctctgggtctcccttttctgatctgcaaaatgataaaataaacagtcttaggggttacttgtgactactgtgggacttaaacactttcagacaattctcaggctgttagaagttacaatcccctcgagttcgtgaactggctggccacttggtccctgaacttgcctctgttcctagactgttttcagagcttagattggtggatagtaggtgcttaatgaatgttttattggtgggagaatgagtgaggtgaagaagcaagaatggtagcttgctgaattggcagttgagttacagaatgctcaacccaagagtccctggaaaccagagcactggggcaagtacaggtggtccacactcatcagattctgggatgtgcggctgtgtagagaagctttagtgcgatgggtgtatcactcgtatgaagtaggagtgagcctgtgcctgattttgtgcagcagcgctggccagctctgaggcgtgcagcactgagtgcggtgcaggaatatgcaaggaatctgcaatcccaagtctgtttcaaatcttttcttgaaacccaagatcaccacagattcagaaccctgtggaagatcaggaaaaactgtgggctaacccagcctcctaggcagggttggggcaaagctgtggaaccacctttcacagtgcttcagaccactgtaagtgtaggggaaaactagcagattgtgacccatgccttgtagattagagttgtagactgaaccacagagaagggtttgggatttgagatatccatccaggtgttcacgtaagtgctgagatttttaccaaggcatcgcattatctcccaaagcctctttcccatcatcctaagtggggttccctagaagcagagcctgagaaagggaattgggaacacatggtctaatgatgctgtgctcttagggaaaacctgtaaaggaaaggcatgggggctcaaaatggttgtggtctcagataaagtctggctgagggactctggaacaaaaattacaccaaagagttgtcctcaccttgaggcaagaggggcttcccttttgtgccccatatcattcagccattgactggctgtgggggggaagggaagtgtaaccctccttgaaaggagatcccctcagctgaggatggttctctagagaagaatgcagatgtgagccataagcagcctacacacacatcagccaggagatgggccacagttcacagtgcccactacacatcaaaacacaccctctggggaatgctgccaagaggttttgatttaaaacacgaaccttctttcacaacacaagtgccccaggagagtggcctgtaagtcccactggccattgatacttggaacaggccctgggggagtgagggaggacacgtggtgtctaagcaggtgggcagagtagatgggctggccttactctgaggtgtggagaaggctagagaagagtagaagataaggtgaagaggcagggcaggaagctgatggcttctgccttgactgggaagtacagacctgggtcccctcctgacagggaagtggggagaagaggttggcctggggacacagtaaagcatggtattatggtaacttctacataattggtctctagttctagaattattctgctttctaaggtcaaatcttactggactgataaacttacccatacttgggttacggaagttacccagactcggggtcctgggaagaatttcagggtcctctgtgcttatttgtttctgaattgacccagtgaggtagtcatctaccctgtccagcatcttgctagcctggacatactttccacagtgaacctatctctcattcctgcaagtctgtcagtggcacagatgtggactttctttagtgaaaagcatcttggaacctttactgacatttttagatttaagcagcccaatcaaagccagagatggagggacagattagtattgaaatgatgttcttggtcacttctggttccagatggccaaccaagcacaaatgttgatgtctgtgccttctggtaccccattgcaatgattataaatgagtagatcggaacagggaggacaacactgtgaaagaaaggcatcagctaataataagagtccagtaattttctggtatgagtgaagtaaatggaagagtgttagtgggtgaacttgaactgtacatggaagagctggcttcctgcctacccagggaacagagaagctgcagccacagccaggccaacagttacagagggggccagagtaagaagtgggactgcaagtggtggtggtattgagggaggtcagtgaaatgtgaaggttggtatgaagaagggttagagttgacttttcaccattgtccccacccctacaggcttcaggcatgcagaatagcaagcagccaggcatcgccttctctaaagtgttaagtaaactgtttaagatagtgtgggcgacctcgttctcagagaaaagaaagccttacttctggcatttgaagtcaccaacgtaagagctagctttctctcccacaatccacccaaacactttcacagattttctactcagtccttttaccttagtttgaaatatgaatggacaaccaaggaaacccaagattgaggaatatttggtgcatgaaaggaaaggctaaaataaaccaggagaataactaacttaaaaggaaacaaatgatttagggaatataagagattattttaaaaaattttaaaaatgcaacaccttaatgtctatgcagtagacccaaggagatttaggaatatattccattcttttcattttctaatggatgggattctgttcctttttaaagggaggaatgaaaggcaagggaagtgttcttaaaaattaaaaatatatttgcagcaccaaaaactcagtggaagtattagaagacaatggtaaataatttcccaatggaagtgctaaaagacaagtagaaaagaaagctaaagaataaatttacggggtcctatatctccaagtaataagaatactagaaagtaagaataccagtaataagaaaagagaaagaagggggagaaaattatgtaataatagaatagcatgtttcagagttaaagagggagactattttttaaaattggtgtaaacaacaatttacaatcaaaataaaccaaaattatcatagacacatcattttgaaatgtcagtgcttcaaagacaaagggaaaattctaaatgtttcgagggcaaagaatgcaggaatgttgatcatggaggataagtcagcttacaacagaatgagagtcagactgagtagtccattagactttttataagcaagattagaaactaaactatgatgaaataaaggcttcaatgttctgagggaaaatgattttgaaattagaattttgttttcagccacacaatcaaagtatgtggtaaaaataaagtcacttttcagataagcaagaacccagaaagtttacctccctagtaactcttccaaggaaattatcttgtacttcaacaaaacaaaaatgacaaccagaaggagcaagatgtgggatacaagaaactctggaactaactctcaaaagtctaatgacaagaaatcccaggatgataactgcagcaagtctaaaaagcagccaagtctattgagaagaggagatcaattaacttccagaagaatgaagctaagcaatagaatgatgagcaagtggcaaatattcagtatatagtgcagattgaatatgtttcttttatgggtaagaaaaaaataaaagcattcaagacctctcagaaaaatagaaataagataattacctgtacagattctccttgactcacgatggggttatgtcccaataaacccatcatgaattaaaaatattgtcagttgaaaatgtatttaatacacctaacctgctgaatatcattgcctagcctaccttaaatgtgttcagaacacttacattagcctacagttgggcaaaagtcatctaacacaaagcttattttacaataaagtgttgaatatctcatgtaatgtattgaacactatactgaaaatgaaaaacaaaatggttgtatgggtactcaccattaacacacacagctgaaagcacactggacctaaagaatatttgaactaaaattaactgctggattatggggctactagtgtaacagggtcatccatttctctctcttctgatgagtctcaagaatagctggtagaagccactgcggtattaacactcgttgatggcttagcaggcatggtgttctgtagaaagctatcagttgtttaccctcctaatcctataactgactgggacctgcagctcactcccactgcccagcatcacaggaagtattgtaccacatattgctaccctgggaaaagcttttgaaataaaaaatttgaaatatggtttctactgacatgcatactaccttcacaccattgtgaagtcaaaaaatcgtaggttgaaccattatnnnnnnnnnnnnnnnnnnnnttaaaatataaaacaaattaaaatgtgataaaataaccagttataactatcagatgttttttgtaagcctcatggtaaccacaaggcaaaaacctatagtaatacaaaaataaaaataaaaaagcaaagtaaccaaaccataccactagagaaaatcacttgaccacaaaggaagatagcaagaaaggaagaaaggaacaaaggatctacaaaacaactagaaaacaacaaaattgcagtagtaagtccttacttatcaataattatcttaaatgtaaatggattaaactctccaatcaaaagacatggagtggttaaatggatttaaaaaaaaaaaaacaaaaaacaagacctaactatatgctgcttataagagactcacttcacctgtaaggacacacataaaatgaaagcaaagggatgaaaaaaattctatgcaaatggaaaccaacacagagcaggagtagactttaagtcaaaaatagactttaagtcaaaaactgtaaaaacagacgaagatcattatacaatgataaagggatcagttcagcaagaggacataacaattgtaaatatatatgcacccaacaccagagaaactaaatatataaagcaaatattaatagatcttatgagagagttagattgcagtacattaatattagggaatttcagtaccccactttctgcaatggacagatcatccagacagaaaatcaataaggaaacatcagacttaaactacactctagaataaatacgtctaacagacatatacacaacagtccatccaacagcgacagaatacacattcttctcaactgcacatggaacactctccaggatggatcacatagtaggccacaaaataaatcttaataaatttagccttgaaatatcaagtatcttttctgaccacaatggtataaaacttgaaataattaacaggaggaacttcagaaaattcacaaatacgtggaaattaaataacatggtcctgaatgaccattgggttaatgaaataattcaaagggaaatttaagaatttcttaagacaaatgaaaatggaaacacagcatacaaaaacttaaaatgtggtaggattttgagtaagtagaagagtataaagaagaatgttgatcctagaaatattctatctgaagtagaagttgaatattcctggactttaactttgcaactgtagaggaggatgtataatcatgacacttgtcttggctcaactgtgagcaataatcatgaaccataataaaattagcactatttattggttttcaatatttataattaagccaaaatcagagctatggtgatagcataaaatgcaaatgtcattaaacttgattatataaaggtaaaagtagaataagataagttttcttaatatcttaatcttttaaattgatgagtcaagagattgcaaaacttgatgaaacaggaaatcactgttggcttaaaattgcagaggtcatcagtagagcaacacttcctaaagtgtgattcctgaaccagcagcatcaacctctcttgggattttgtgagaaatgaaaattgtttttattttattttattttattttatttttttcctaaatttcttatttccttctctttttttaaagttttattattattatactttaagttttagggtacatgtgcacaacgtgcaggtttgttacatatgtatacatgtgccatgttggtgtgctgcacccattaactagtcatttagcattaggtatatctcctaatgctatcccacccccctcccccaaccccacaaccgtccccggtgtgtgatgttccccttcctgtgtccatgtgttctcattgttcaattcccacctatgagtgagaacatgcagtgtttggtttttttgtccttgcgatagtttgctgagaatgatggtttccagtttcatccatgtccctacaaaggacacgaagtcatcattttttatggctgcatagtattccatggtgtatatgtgccacattttcttaatccagtctatcgttgttggacatttaggttggttccaagtctttgctattgtgaatagtgctgctataaacatacatgtgcatgtgtctttatagcagcatgatttataatcctttgggtatatacccagtaatgggatggctgggtcaaatggcatttctggttctagatccctgaggaatcgccatattgacttccacaatggttgaactagttgacagtcccaccaacagtgtaaaagtgttcctatttctccacatcctctccagcacctgttgtttcctgactttttaatgatcaccattctaactggtgtgagatggtatctcattgtggttttgatttgcatttctctgatggccactgatgatgagcatttcttcatgtgttttttggctgcataaatgtcttcttttgagaaatgtctgttcatatccctcacccactttttgatggggttgtttgtttttttcttgtaaatttgtttgagttcattgtagattctggatattagccctttgtcagatgagtaggttgcagaaattttctcccattctgtaggttgcctgttcactctgatggtagtttcttttgctgtgcagaagctctttagtttaattagatcccatttatcaattttggcttatgttgccattgcttttggtgatttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttggtaccagtaccatgctgttttggttactgtagccttgtagtataatttaaagtcaggtagcgtgacgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacctacgagcatggaatgttcttccgtttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagagtttgctgaagttgcttatcagcttgaggagatatggggctgagacgaaggggttttctacatatacaatcatgtcatctgcaaagagggacaatttgagaaaattcttgggcccaccccagacccactgaatcagaagctgatggggtgggccccagcaaactatgtttttgtttttgtttttgtttttgtttttgtgttttgagacaaagaatcctctgtcacacaggctggagtgcagtgacaggaactcggcccactgtaacctccacctcccaggttcaagtgattctcctgcctcagcctcctgagtagctaggattacaggtgcacgccactatgcctggccaatttttgtatgtttagtagagacaagttttcactatgttggccaggctggtcttgaactcctgacctcaggtgatctgtccgccttgacctcccaaagtgttgggattacaggtgtgagccaccgtgcccggccagcaatccgtgttttaacaagatggctgggtgattctcatgcagctaaagtatgagaactgatacagtagaggagttaaactaataatttgcccatcaaaattatggaggtgaaggagtggggatcgttatgtgagataaattcctgtctatcatggaaggaatttagtaaaataatgtctagatctgataaatcaacgagtagtagtatcagcatgttttctagagatatggaaataatcatcaaaagaaacataaacggacgtgggtaataatgagtaataatggttgcccctggagaggaggactcagtatggcgaggtatgtggcagggggttattatttttctaaccatgtgattctttggttgaaattaaaataaaagaaaaaattgttcttagattgggaagattgtccaggagcctgagagaagttctgggagagcagttctttcttattgtccttttcctgattatggggaaaaaaaaaaaaaaaaaaaagataatcttccagatgttggctcagtttgaggaggaggaaagattctgagagtgaggcccactgcaggaagcagagctgatctttaacctgtgtatatatacacaacagtttgacacagagcatctcacctctttcataggaaggaataaattcatcagaactctctaggtcatgttgccagataacattagggttccactactttaaatgccttgatctcttcactgagcccatgttggtacccaggactatacagaagggtggatcaaatcatgatgaccttttagagttggggtctgcccccactgatggcctaattaaagtggaatcgctgcacagactgtgtgtgtaacatggagatagtgaccagtacatgttaagtacaggcttactgattaatctgaggctttttgctatgagttaggaatgtgcaggacaggcaggagaccaagccttccctctatagggtacatagtcctgggagaagacgggttccaggatagggctttggcactaggctctggtgagtgaatagtgggattgctgctaatgctgagattggattgggattctgggcgctctggggacggtggagcttgaatgctacaagcctccgtacatacagcctgatgggcacacattgcaccttcaaaatttaaggaaagcaaagacctgcatctgtctcatcagaaagggaggcatatttgatagcaggaaaaagacaacctttttttcattaaccagaggagtattttaaaagactataaagctggaagcaattcaattgtgtgtctactttatgtaagacctcgatgaaaaaataaatcattgctgccttcattggagtcacagacagtccaggaataatttacaaagtgagatttagattagtgtgtaagaatttcactgcagaggccacttctggctgaggagaagatgttctatggagaaagggagaattggccagagccttaaaggtggagtaggatttgggtcctcagggaatggaggggctgatggatgctaaaggtctctcacgtggctgaatatctagtgagggaaaggggagaggccatctggactggagattcagtcatgcagtctgaagccacttgttcactggctgaggagttggatgtgattctacggtggacagaccatggcatattttgcagtttggggagatcgtagatgtgcctcagggagattggtgtgcctgggtatggggaggccagttaagaaagagcttgttgcaggggcctttgcaggtgagtccctggggagtctgtgtgataccccccagagagttgactcctaattaattgctagttggtctcagctgctgaaacagagggtatggaactaaatgaaacaatcatgggaagtcctggctggtctgtgtgctgggaagggagcaatgctgtccttggactggtcacctgaaggtcctttatccctcctcctcagctgagcataccaatggtgatgacagaggccctgtcttcaatccctgtacacagaatagcgctctgaaaattataactcttctcacgcttcatcagcaggcccccaaagagacctggctacagcagggcttccaggtctttcactgcggtaggcagaatggccccccaaagatgtccatgccctaatttctggagcctgtgatttggatacgttacatggcaaaagggactttgcagttgtaattaaggtgatggacttccaaatggggagaggagcctggattttccaggtgggtccaatctagtcacacgagcccttaatagcagcaaacttcctccagctggaggtgggaggaatgaggcggaataggaggtcagagagacttgaagcatgcctttgctgatgttgaagatggagtatgtgatgtgacgagaatgtggacaaccttaaggggctgggagaggcttccaggtgactgtctgcaaggaaacggggcctcagtcctacaaccacacagaaccaggtgcttccaaaaacccgaacaaagctggaagtggattctcccccagggcctctagataatcgtccagaccagctgacaccttgatttcggcctgtagaacctggagcagacccagacaacccaccgacctctgacttacagaactgtgagataatagatttgtgttattttgagcagctgaactccggtaacttattactgcagcaatagaaaataatagacacacaatacagcccacacctccagaaccccggggcttctttcctccctgggctctctggggaaggagcacaggctgtgcagtgagatcagggccctggcccagagcactcaccctttagagcctgtttcctcacctgtcactgggggtgccatcggctgctctgcctgcctctgggtggtggtgggattacatgagggaaatgtgagaagcccggaaatgatgaggcagcactggatcctgctgttcccttcctgggaagccggcttcctggtgttgtgaggagaggatgaggccgtcatgggagcaggtctgacctgggctctgaggaagcaggtgctctgctgcctttccacatcctttcctctgaggggggtcccgtctctgcaggcccgtgggtgggctccccggtgggacgcaatggcaccatcttaggcaggagtccccaactcctggatcagtaccagtccggccacacagcatgaggtgggcagcgggccagcgagtgttaccgcctgagcgcccctcctgtcagatgagcagaggcattagattctcacaggaacatgaaccctacacatgtgagggatctagattgtgccgaaaccatcccgccccctccaccgtccgttcatggaaaaattatctttcacaaaactggtccctggtgccataaaggttggagaacactggtctaagggttctggcaggctctcagatgaacctctctggatctttagggtgtctggccctcacgtgtcaggcccaaagatgcctgttagtctgtcgcagagggagaagatctggggaggacccatataaccagaactcgggagccagccgcaccaccatgagcccagatagcatgagtcccttctcttttctccatctctgctgccattccctaggccaggccaccatcatttgtcacctagaccaggtcacatccctgcataacctcctcccgctgaggagctcccttccccctcagaagaaaatccggacacatgctaaggcccacgagagcctgtacagtggggctcctgcctcgccagcgccacccgcatactgcattcccaccaccctcaaacttaccaggcctctgcctgcctcaggccctttgcatatgctgatacctcatctagaaagcactttgccatgcttttcccgtggccagctcttcattttttaggtctcagcctaaatgttgcctcctcaaagaaccattctcccactaccctgtatttcctgactcagctgcctttctttgttttgacacagggtctcattctgtcacttaggctggagtgcagtggtgtgatcatggctcactgcagcctcgactttccaggctcaagtgatcctcccacctcagcctcccaagtagctgggaccactggtgtgtgccaccacgcctggctatttaaaaaaaaaaatttttttttctggacacagggtttccccatgttgcccaggctggtcttgaactcctaggctcaaggaatcctcctgcctcagcctccctaagtgctgggattacaggcatgagccaccgtgcgtggccttagctgcctatttgattccttcgtgacatctaacagaacgtgttatttcgtctacttgttattgtatttacctctctagaatggaagcccagtgagggaagggatctattttatcttatttgctattgatccgcaacacctggcagagaacctggcctatagtggatgcttagtaaatagtaaatagttgaaagagcccttctggaagaacacaaggctagttcctttggcaaaaattgggcatcatatcagagcttcttcactagcagattcagcagagctataaaattaaaagaaatgtgttctgtaatccctctgggaattccccacgggcaagagagcatgatgtgtgatttgcagtgacatatctataccacggtatgtttgtagtgactacttttcaaaagacaagatggaggatatacagctggtgaaagaaaaggtgtcggctttgttgagaagtcttactttgttgtctttcaagtgaaaagtgagctattttagtctaatggtaatttttaactatgttgaagccatacactttgggtctccattgtgctggaaatcgtcactacagctcctcccaccccacacccctcaatgcatgcatataggaatatagctcatgctatggaaatccactgtttgcacagcctggacattaggtaatagtttcccggctgaggtgcccagctggcttaacatgccattatttacagctctaaggtttattttcattattatatttaaacgtctctgcagaaggaatggaaggctaagagggtgggagagtagaagaggagagggagaagagtcactccagacgtcagaaccagacaggctcctgagaccgtgcaaactgggggatttcagattgcacacttggagtcagggcagcagtttggctcagcaggaggggaaaggggtgttagaggaaaaggctcctgccctccaatgttgtttgacccagatcaaccctactcttatgggtatcagcttctgggtaaatactcttttcaaagagggcaccatggcagaacacatgtgaaaaccatctagtttgaagtatgtgtgagaaaaacaactaattcacccttctcactgaccagtggagaagtctggccttatctgtctgtctcaggcttcttctccaaggttaaccccaacgggaaaggagaggggactcatcaaaggttagaccatgtcctgaagtgacctgttgaatttgcaaaacttctttttcagtgttatgttttatttttgcaatttttgtggggggaaaatgcattctaggcttctgaaaccctttttagaagaaaatcatggtttcctcaaactcttcaagcttattgagttttcttctgtattatcctgtcctattgaaaaccttgtgcaaaagtatgtgtggggtgagaggtgtttaaacacacccggtggacagtgtctggctggggaggaaacgttagcctctcttttcttatcttatgagataatttaggaaatcaagtacaaggcccttgctgtgtgcacttatacctggagccttatttaggggatgttcttgcagatagatggggagaagtcttgctgggatcctctctggttttaaggcattttttttctcactcccagttgcctgcccatgtctggtttagcagcttttagaaacgtggctggcatccttttttcttttctctgacagcaccagcccctttatttgaacttcctagctgttttctgcctcttctgactaattaacagcaactaaaaaagaaaaatgaaacatagaacacaaaaaattccagggtgaaaaaggagaatttctagtcctggggtgcaaaagtccctagaagagagttttgagctgaaatgaaaagttgtgattatagagagacatgaaatgtgtcccataaaaggccacctagtcccaggcagatccaggaagagcactgggctgggagtcccatggggccagggcctcaccaagcagtcagccctgctcagttatcacaggggttgaactggattgcctaaatgatgcctttagatggatggaactggagtccattatcttaagtgaaacaactcagacacagaaagacaaataccacatgttctcgtttataagtgggagctaaataatgtgtccacatagaagcagattgtgggatgatggacaatggaggggtggggaagttggagctgggtggatgatgggaggttgcttgttgggtgcaatgtgcattggcccagtgatggatgcaccaaaggccctgactttgccatgacagaatatatcaatgtggcaaaactgcacttgtatcccatgaatatataccatgtttttaaaaatgttgcctttgggcagaggggataattctgcaaactgcagagccatggagtaaaaaaaacacccaagatagcagaacttgtcatttctagtttttccacaggaccataaagcaaaattggtgccgggtttgtatttaaagggaaaccaagagggtttttttatccttccatggtttcaaaatctggaaggacaatttgtacagaccctgagatagaaggattcctcagctttaatttcatgaacgatttgcctttcattgattcttgaggatatgaatgttttagaaagcaacagtgtatgccttgattttaagaggcaatgagccttttccttccttcgtttaggcatggggctgaatggagctgaaattcctgcactcttataacgtgccacatgaagggcagttttggattctgggaaaacagcccattgaaacagaattgggagggagaaacctcttacactcaggtcatggtatttatatgaatacaaaaaaaaatttaaatactgtgctaggtgctgggggttataaacatgaattacatgattagggcctctggaaacttgtgtggggctatagaaggaacaccagttcagaaatgtcactcctgtcatccagacaggatgcttcaccataggggcagagaccttctgctaagtcataccgcatatcaagaaatatattgctaggccaggcacggtggctcacgcgtgtaatcccagcagtttgggaggctgagacgggcagatcacttgagatcaggaattagagaccagcctggcaacatggggaaaccccatctctactaaaaacacaaaaattagcggggcatggtggtacgtgcctgtaatcctagctactcaggaggctgaggcacgagacttgaacccaggaggtagaggttgcagttagccaagatcgtgccactgcactccagcttgggcgacagaacaagactcatctcaaaaaaaaaatgcattgatcaaatcagcttaaaaatagccttcttgtttgctcttcttggtgtgggattattcagtccaattcttctactttttttaggcctcagcatgggatttggttgtcatatcaaccctataaacagtgttgaatccatgtcaataattgtattttttaaaagcaaatatcaccaagtccaagaaactgatcctcctctgaacatgatagctggactaggctaagaatcctatttcctgttagatcagaagtgaagattttctggtacagatttgggtgggagaaatgagctacccttcccaaggccttagcacctagatgacatcctctctgaagtcaccctcagccaggagcggacactgagctgctatttctgaatcacatgtccccaaagctgccctggccttggtgaccatggcactgtaagagaagcacagccagccccagcgtccttactctgactcagaggaaaatgcaacttgagctggattcattgaaatcttttttttcctggcctgaaggaaatgaagaaacatagccaaatattctaaaacaggattcaacaaacagcccataggccaaatccaccactgcctgtttttgtaaataaagttttattggaacacatctatgcccattcccttatgtattatctatggctgcttttgctctacaacagcagagttgagtagtgtgactgagaccgtatagcctacaagcccaaaacatatactgtctcacccttttcagaaaaagttgccagccttgttctaaaagaagtagagtaaggatttagtgagaagctggagaaaatattttcaaagacaactgtattctccagggaaacctgagatgaagaccaaggtgaggaaggagccagcagagaaatcgagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttggccaactagcaggtgaagtctggagggaggtggaagagactgcttccaagctgggttccgatttgtctgattgaagcagccaagcttgtgtttgccagaggacttaggaggatgtggataaaatcaggctgaggcctttttttaaaggcccaagctggagctattgggattgttccctcagaggaaaatcaggagtttgggccattggcttcatggagaacctgtactttgtaccaaggagaagtcatttctacttggtttttgaaactgcattgtcatctagtattccaaggctttagtctgtccaccctcctgctccagagagatgcctttcagttccttaggaaacaaattggccatttgcccaaagagactaatccaggactagaacacaggcactgagtttcaacctcaggctccccagtgcgtgactcaggtctcttgattccatggtgtattgtttttttacctattaaacaattgcattcctagcctatggaaggtcttacctaagccaagactttggcagggattggattgtgcagcccatttttgttaatagcattgcccaagttagggaaggccattaggttggctgagtattctggtattctattgctgcataacaaactctgaaatttagtagcttaaaataacatttattttgttcatgaatttgatttcattgttttttaatgtatgtaaggtatataaaatgatgttttgatgtacatttacatagtgaaatggctactatggtcaagcaaatgaacatatccattgcctaacatagtttttttttttttttgatagtaagagcacttggaatctactttattgtcaaatttccagtatataatacaatattgtcaacatagtcatcacgctatacattcaatctctaaattttttcatgctacctaaccaaaactttgtacctttgaccaacatctccccattccctactccctaccccctccccgacccctggtaactatcagagtttcactttctggttctgtgtatttaacttgtttagattccgcaataagtgagatcatacaatatttttctttctttttgtgacttgtttcacttagcataatgtcctccagtttcatccatgttatcaaaaatggcaggatctcctttttaaaggctgaataatattccattgtatgtttatatatgtgtatatatatatatgtgtgtgtgtgtagtatatatacatatatacacaccacaatttctttatccattcacctgttgacaaacacttaggttgattccatgtcttagctgttgtgaataatgctgcaatgaacatggaaatgcaaatatttctatgaggtactgatttcattctctttgagtatatacccagaagaggaattgcagggtcatatagtagttctatttttattttttttgaggaacctccatacttttttcataatggctgtaccaatttacattcctaccaacaatgtataagggttcccttttctccatgccctcactaacactttttatctcttgtcgtttttatagtagccatcctaactgttgtgaggtgatatttcattgtgacttcgatttgaatttccctgatgattagtgatgtggatatttcagcagaaaccttgcaggtcagaagagagtggggtgatatattcaaagtattgatggaaacagtgcctcatacctgtaatcacaacactttgggaggctgaagcaggaagatcacttgagcctaggagtttgagactagcctgggcaacataatgagaccttgtctttacaaaaaataaacagaaaattatccaggcatggtggcatgtggctgtagttccagctacttgggaggctgaggtaggaggatcgcttgagcccaggaggtagaggctgcagtgagccaagatgatgccactgcactgcagcctgggtgacagagtgagaccctgtctctaataaattaataaaataaaatttaaaaaccctactagccaacaatactatacccagtaaacctgtgcttctcaagttgaaatgaaaggacactaaatagcacaagagagcataataaagaaggaaactcgttggtaaaggtaagtatatggacaaaatcagaacactatattactataaaggtgatgagtaaatagcttttatgtctatgaagaaagttaaaagacaaaagtattttaaaaaccattataagtattaactaaattatgttaatgggtacataatataaatagatataaactgaggcatcaatagcatgtaacttggggggagcagagggaaaatcagagtttttatgcaagtaaagttacattgtgaacttataacagactgttacaaattatttcgtgtaagctcctggtaaccaccaagaaaatacctatggaagttatatatataaaaaaagaaaggaatcaaaacctatcgatacaaaaaaaaaaaagaaacaaaacaaaagaaaaccgcaagggagaaaaagagggacaaaagaacaagacacatagaaaatagtcaccaaaatggcaatagtaaatctgtctctatatttactttaaatgtaaaaagactaaccttcccaataaaaagatacagcatgactgaatagattattaaaaaaaacaacaacaaccaggatcaaactgtatgctgtctacaagaagctcacttttagattcaaggacacacagagagatggaaaaaggtagtccatgcaaataccaaccaaaagagagcaggagtggttaatacttatatcaacaaaatagactttaattcaaaaactgtctctagagacaaaggtcatttcttaatgacaaagggtcaattcaacaggaagacataacaattataaatgcacccagcatcagagcacctaagtatatacaacactgacagatctgcaaggagaaattgatagcactataataataggagatttcagtaccccactctcaataatggataggacatctagacagaaaatcagtaaagaagcagtagacttgaacaactggacctgtgtaacaaatggacctagctggcatatacagaactgttcagccaacagtggaagaacattcatttttctcaagtagccatggaacattctccaggatagatcacatattaggtcacaaaacaaatcttagcaaatttcagatcgaaatcataccaagtatcttttccaaccacaatggaatgaaactagaaatcagtaacagcaagaaaatgggaaaattgtttgtgaattcatttgtgaatttgcaatttggcagagcttgatcaacacagctctctgttccatataatgtctatcagctggggcaactcaatgggattggaggacatctctgaggttttcactgtcatggtgactcacgtagcctgcaagttgatgtggcagtcagtgtctcctgtgagcctctgcatggacagcttgtgtttcttgcagagtggctaaattctaagaacaaatgccccaagaaaattaggaggaagctctattgctttttatgacctagtctcagaagtcacatagtgtcacttccactgtagccaaaagtccacccagattccaggtaagggagcattagaccccacctctctatgggagtagtttcaaagtcacattgtaaggagtgccatcatcgagatattgttgcattgatttttggaaaataatttacctgcacagaggtaaattcacatcaattctttgtctccttatttcaccatccattaatgtttgtttgtttgtttgttttgagatggagttttgttcttattgcccaggctggagtgcaatggttggtctcggctcactgcaccctctctctcctgggttcaagcaattctcctgcctcagcctcccaagtagctgggattacaggcacccaccaccacacccggctaatttttgcatttttagtagagacagggtttcaccaagttggccaggctggtctcaaactcctgacttcaggtgatcacccgcctcagcctcccaaagtgctgggattacaggtgtgagccaccatgcctggccccaccatccacacccagccccaccatccattaattaagcttcatggtgttcactcagtcacactgttgtcgctctcatttgccaatgttaaatagtgatgcacagtgcctaagacaaaatcgctatcactgcaagctcctacccctggctaaatgctaatctggatttatgggacagtgacgagtgctattattttcattttataaatgaggaaactgagtcctggagggaagaaaagtcaattttcttaatgtaatacaattaaaataggattacactttgaatttccttatttcttaactagtattttatctttccatgattgtgcttaattttatcttatcagtacaagcactcatataacctgtagggatatttgtgtacatgtgcatgtgtgcatatacacacacgcactgtgtgtgtgtatatgtcaaactcagtgcttgcctttgttggatggaaattcagcagcactggaggactagacagctagaaaagccagtttcagggacaggaaatagtagagttcaaggaaaagttaggacaaggaaaatgagtctttacaaagcaaccaattcctcgtgagaagtctttgcatctcacatggctaagagacagtactttggttaggggcctggagctttggttttgatgaacagtgtgctggtattggctctaagctggggcatccaccatttggctccccatttgagtggtcactctgtctctcagagcaatgtgtggtctttcggtgttgataaagcagcaactacatgccaggccctaagggcaggcacagaggcaagcaagaccagtacagtgccccctgcaatcctcttgggacatcattttagcaggggagactaccattgaacatgtaatgataaaattgattagttatgattgagatgagcagtaggaggaaaaagtgtgtggaactgtgagagctcacgatgggcctgaacttgcccagggactcagagaagtggtctggatttgcttgttgaagggtgagaggacatgtactaggtgaaccagctggaggaatctggggatccacttgtggggaggccctgggtgggaagttgtaaggacaaccagagtgatagctggcatgagaaagccagggtgacagaggtgaggagggcacatgccagatctggcagcctgcatgtcaccagatggatttaggtcacatcctgttcttccgttctcacctctttcacctccatctccacctccacctctaccccttcacctctccatgcctcacaaagttggactgtcttgcctgtgagacaggaaaggcatgtgtgatgaggggactgtacactaggggccagtccaggttttgtgagacctgaggcttatatagtagagggtggggtcttgaaggaaaaaaaaaaaaggtgaaattatgaagacaaagtttgtgcaaggcttccctaggggccatgtcagctggggacctctaagctgaagtttcactagtgtggtggggaagctccctttggcaccttccctctgtcctcaaagctcataaagcccacctttcatcttgcctgagacgttcatgccatccttacacccacttcctcctgttttcttcttagttaagatggcaaagaaagagcaaatatattgaaatctcctggaaatttggctctctccttgaccccagtagtgtccaaaagaacacaggaatttcctctttttgcccaagacttccatgatattttccctgataatcaaggaagggagtgttggctgggacacttttttcttttggaaatgtggcaggggaatatgaattttcataggcgaaattactctgtctggtcgagtctagactgttcgttggccagcacgtttgctggcgcccacactgacactctgaggtgctgcctggacttattctctgggcagggaagaaataacctggaactacattttggggaaaaaactcacgaacatgagcagtgacaaggaagaagtttaataatgagtaaattacaactaaaagttgtcaacaggctcttctctccaaattccactgaaatgagcaaagccatctaacagtagtgaagagtctctgtcatctggaacttggggaagctactgtccatagatctgaaatgtcagagaggttgagacagattgaggggaagactaacaagccctccatggaccgtagaagaaagccctaacccctctccaaatgctgctgctgatctcctggcaagcctccacagataggcccaggcccaggcacagccagcaagctctctggaaatatttgggttttgacatgccaagacttggccccagtaagggctgggtggggctttggctgttgaggcccagtcttggttagagaaaaggcactgtgtccctgttaactgctggctgccccaccaacaaactggaaagaatctcccccagtctgttgtgattccctcagcctgatggcctaattgcctttgccttttcctgttaatactgacaattcaatacagtcccattgctcaggcagaacctatttcatatataaatttcctgcatccccaaggcagagcaaatagggggaaatgaccaaactataatctgagagttctttactcaactggattatcattcatctaagagcatctgaaagacagtctcacacaagcaaagactgaaaggacatccaccaccacgtacctctcttgaaaaaactgcttggagaagcacttcagtagactagggaatgaatcaaataagtaatgcactgacaaaatcaaaaccacagttgacttaggcttccttggagcttggaagaaccccttcccacgctggagagctggctttttggaggtgggagtagaagccctgaggggctcaggggaggaattcccactgatttgcaagaaaggaattggccactgtgtactcgtttgccactcaatcctgccctaaccttcctctcctgtctttctcacagactgtttttgaaaggaattgccgttcagaggactgtgccgcagacctgcagcttcagggtaaactgctgctctccaggtatgtcggtgtttccttcagagcattgttctcaggctcctttttcttgaccccaggtcccaaacctgaatgtgcagatttccccactgaagaggataaacagagttgatgggttacagtaatattctgtggttttaaaaaaatgtatgttacaaaataattataacaaaagctttgttgggaagattgtttaggtttttttgtgtgttgattgcaattccacatatctcacaatgtagcttgtatttctaatttctatgagtatttgaggggtggctattttatgcttgctgattgtattaagttgaatcatatgaaattgccaatatttgaacttttggacaatttcatatgtatgattcatcctattattaaataaaggtttatgccctcctgcctccacacacacacacacacacacacacacacacacacacacacactagtgtatgttttaacaagtaacatttctgtggcaggagagggctgaaggagaggggcaggctgccctgatccaagtgagcagatagtctccttattgtttcagggtttcctcccgcactacatgaatcccccaaggctaaaggtgaaccgtacagcggccttctgtttcctctttgccaaccttttattttagacttcatttaggatgaaggtgctggtcctgatcatttagcctcatttcacagaatggcttccttttgaaacagttccttctgaaagactgttttagccttggggccagaaacccctctattagttttattaccatttctgaaaaacagtcactagttttggtagttatttttcaaaatgcatagtgtatcccttacttaaaactatgagagttaagtttggatgaaatgacatgaatatactattatgaaccagtgcctacactaggacattttttttattgttatactttaagttccaggatacatgtgccgaacgtgcaggtttgttacataggtatacacatgccatggtggtttgctgcacccatcaacctgtcatctacattaggtatttctcctaatgctatccctcccctaaccccccacccctgacaggccccggtgtgtgatattcccctccctgtgtccctgtgttgtcattgttcaactcccacttatgactaagaacatgcagcatttggttttctgttcttgtgttaatttgctgagaataatggtttacaccttcatccatgtccctgcaaaggacatgaactcatccttttttatggctgcatagtgttctatggtgtatctgtgccacattttctttatccagtctatcattgatgggcatttgggttggttctaagtctttgctattgtaaagagtgctgcaataaacatatgtgtgcatgtgtctttatagtagaatgattcataatcctttgggtatgtatacccagtaatggatggctgggtcaaatggtatttctggttctaaatccttgaggaattgccacactgttttccacaatagttgaactaatttacactcccaccaacagtgtaaaagcattcctatttctccacatcctctccagcacctggttgttttcttgactttttaaatgattgccattctaactggcgtgacatggtatctcattgtggttttgatttgcatttctgtaatgaccaatgatgatgagcattttttcttatatttgttggccgcataaatgtcttcttttgagaagtgtctgttcatatctttcgcctactttttgatggggttgttttttttcttgtaaatttgttttagttctttgtagattctggatattagccctttgtcagatggatagattgcaaaaattttctcccattctgtaggttgcctgttcactctgatgatagtttcttttgctgtgcagaagctctttagtttagttagatcccatttatcaattctggcttttgttgccattgcttttggtgttttagtcatgaagtctttgcccatgcctatgtcctgaatggtattgcctaggttttcttctagagtttttatggttttaggtcttacgtttaactctttaatccatcttgagttaatttttgtataaagtgtaaggaaagggtccagtttcagttttctgcatatggctaaccagttttcccaacaccatttattaagtagggaatcctttccccattgcttgtttttgtcaggtttgtcaaagatcagatgattgtagatgtgtggtgttatttctaggcctctgttctgttccattggtctatatctctgttttggtaccagtaccatgctgttttggttactgtggccttgtagtatagtttgaagtcaggtagcatgatgcctccagctttgttcttttggcttaggattgccttggctatagggattcttttttggttccatatgaaatttaaagtagttttttctaattccatgaagaaagtcagttatagcttgatggggattgcattgactctataaattactttgagcagtatggccattttcacgatattgattctttgtttccatgagcacagactgttttttcatttgtttgtgtcctcccttatttccttgagcagtggtttgtagttctcttgaagaggtccttcacatctcttgtaagttggattcctaggtattttattctgtttgtagcaattgtgaatgggagttcactcatgatttggctctctgtttgtctattattggtgtacaggaatgcttgtgatttttgcacattgattttgtatcctgagactgctgaagttgcttatcagcttaaggagattttgggctgagactatggggttttctaaatatacaatcatgttgtctgcaaacagagacaatttgacttcctcttttcctatttgaataccctttttttccttctcttgcctgattgccctggccagaacttccaatactatgttgaataggagtgatgagcgagggcatccttgtcttgtgccagttttcagagggaatgcttccagcttttgcccattcagtatgatattggctgtgggtttgtcataaacagctcttatttttttgagatatgttccatcaatacctggtttattgagagtttttagcatgaaggggtgttgaattttgttgaagcccttttctgcatctattgagataatcatgtgtttttttttcattggttctgtttatgtgatggattatgtttattgatttgcatatgttgaaccagccttgcatcccagggatgaagccgacttgattgtggtggataaactttttgatgtgcggctggattcagtttgccagtattttattgaggattttagcattgatgttcatcagggatattgacatgaaattttcctttttcgttgtgtctctgccaggttttggtatcagatgatgctggcctcataaaatgagttagggaggagtccctcttgttctattgaatggaatagtttcagaaggaatgataccagatcctctttgtacctctggtagaattcagttgtgaatccgcctggtcctgggctttttttggttggtaggctattaattactacctcaattttagaactcgtttttggtctactcagggattcgacttcttcctggtttagttttgggagggtgtatgtgtccaggaatttatccatttcttctagattttctagtttatttgcatagaagtgtttatagtattctctgatggtagtttgtatttctgtaggattggtggtaatatcccctttatcattttttgttgtttctgtttgattctctgttttcttctttattagtgtggctagtggtctcttttgttgatcttttcaaaaaaaaaaaaaccagctcctggatttgtttattttttttttgaagggtttttcatgtctctatctccttcagttctgttctgatcttaattatctcttgtcttctgctagcttttgaatttgtttgctcttacttctctagttcttttaattatgaagttagggtgtcaattttagatctttcctgctttctcctgtgggcatttagtgctataaattttcctctaaacactgctttaggtgtgtcccagcaattctggtatgttgtgtctttgttctcattggtttcaaagaacttatttatttctgccttaatttcattatttacccagtagtcattcaggaggccattgttcagtttccatgtagttgtgcagttttgagtgagtttcttaatcttgagttctaatttgatttcactgtggtctgagagactgttatgatttctgttcttttgcatttgctgaggagtgttttacttccaattacatggtcaattttagaataagtgtgatgaggtactgagaagaatgtatattctgctgatttggggtggaaagttctgtagatgtctgttaggtctgcttggtccagaactgagttcaagttctgaatatccttgttaattttctgtctcatgatctaatatttgacagtggagtgttaaagtctcccactattattgtgtgggagtctaagtctctttgtaggtctctaagaacttgctttatgaatctgtgtgctcctgtattgggtgcatatatattgatgatagttagctcttcttgttgcatgatcccttcaccattatgtaatgccattctttatgtttttttgatctttgttgatttaaagtctgttttatcagagactaggattgcaacccctactctcttttgctttccatttgcttggtaaatattctaccatccctttattttgagcctatatgtgtctttgcacatgaaatgggtctcctgaatacagcacactgatgggtcttgactcttcatccaatttgccagtctgtgtcttttaattgggtcatttagcccatttacatttaaggttaatattgttatgtgtgaatttgaccctttcattatgatgctagccaattattttgcccattaattgatgcagcttcttcatagtgttgatggtctttacaatttggcgtgtttttgcagtggctggtactggtttttcctttccatgtttagtgcttccttcgggagctcttgtaaggcaggcctggtggtgacaaaatctcagagcatttgcttctctgtaaaaaagtttcttcttcgcttatgaagcttagtttggctggatatgaaattctggtttgaaaattcttaaagaatgttgaatattggcccccactctctgctggcttgtagggtttctgcggaaagattcactgttagtctgatgggcttccctttgtgggtaacccaacctttctctctggctgcccttaacattttttccttcatttcaaccttggtgaatctgatgattatgtgtcttgaggttggtcttcctgaggagtatctctgtagtgttctctgtatttcctgaatttgaatgttagcctgtctttctaggttggggaagttctcctggataatatcctgaagagtgttttccaacttggttccattctcctcatcactttcagatacaccaatcaaatgtaggtttggtcttttcacttagtcccattatttcttggaggctttgttcatttcttttcattcttttttctctaatcttgtcctcatgctttatttcattaagttgattttcagtctctgatatcctttcttctgcttgatcgatttggctgttgatacttgtgtatgcttcatgaagttctcgtgctgtgtttgtcagctccattgggtcatttatgttcttctctaaactggttattttagtttgcaatttctgtagcctgttttcaaggttcttagcatccttgaattgggttagaacatgctcctttagctcagaggagtttgttattacccactttctgaagcttacttctgtcaattcatcagactcattctccatccagttttgttcccttgctggtgaggagttgtgatcctttggaggagaagaggcattctgatttttggaattttcaacctttttgtgctagtttttcctcatcttcatggatttatctacctttggtctttatgttggtgactttcagatggggtttctgtatggacgtacactagtacattttaacttatgatggcacatgatctttcattcatcaaaggaaagtaatactaagattccttttcttcagtttgagtttactggaggaagatgatgtaacacacacacacacacacacacacgcacacacacacacacaaatagtcctccaaaccacttaaatattaattagcattacttttacttagggcaatagtggtagattaaaatagcacacgttttgccaagcttacaaaattacttaaaactcatggcatggatattagaattgtttcacattagtacgaaggacctcctgggattattagaggaactgactttaaagaagtttcataaatttgcagctcattaattttaattttaaataggccttccacaaagtgttttagggaaaaaataacaagaaacaaaaatatatggatttgttttgtcttgaggcagactggaaatgctggaaatttattttggatcgtagaaaaacttcatgtggtgggaaaatgttcacttgctccaaggtcaggtattaagttagcaaagtcctaatgcttttgctacccattagtggatgatcaaatccatctctattgaattgtgcttttcttatattaagatgtaaaattcaaggctcagtatagcacctggtggctaaagctgcctccactgccccagtctggcctttcaagtgtggtcagagctagttatcctctgtgggcccagtaatcaataatgcttgaacaactagtgtggtggccaggacccagtccccccatatgtatcagctaccaattgccacaaaaaaggctgaataaaaaagtcaccccaaaactcgatgatatgaacagcaatcactgattcccatggattttcaggtcagctggcccaggctggactcagctggaccttggctgatttgtccatgcatctgggttcagcagagggtaggttctaggcttgggtgacaccattcagctctactccctgtgtctttcattttttctttggaaccagtggacaagcctgggcatattctcacagcataacagaggtacaagaaggcatgcagaaatgtgcaatgactcttaaggcctgggctcagaactggtgcacttttcctccagccttattctattggccacagcaagtcacatggccaaacccaaagtcaagggacaggaagttagtgagaggaattacaaagccacacagcaaagggcctgagtataaggaggaggtgaagacttgggacccataatgcaattgactatactatataaacagcaaggtagccctgtctcttatcctgatgccttgttgttatcagggctatttcagtctttattgcaatgccgtctctctggaattcagacatgagatctggagactgggtgagaagattttctgaacctcagaaacaatgcctttggaccgaagctctcagcctcttaggttgggttatttctcagaggacccctggcctctcaaaatagccttttggccgaatcctccattaaagaaaccttcgttgtacttttgggcccatagctgttctcacaggaaccatcagagaaatgttcattgatacttagataacaaacctgtggttcagttatatgggatttatccagacctttggatgttcactcttcagagccagggacaatgtgagggaagatacaatcagttaagtgctagtggaaaccagggtctgaatttggttggcaaaggcatagtggctccaagcagaggtaaactgctttggttatcattgagctctcttgattcattcttctctgggatggaatgtgccctcctttcttgttcaagccaggcaagtgctaggcactgggctgcagaagtgagcagtatgtgagccctgctctcctgctgtgagcagagcaagaggctgggagatagtggtaccacacagtgagtgctaggtgggttactccagggctctggagcagcttccaagaggtggtgttgagaggaatgaggactcacgcattccgagcagagggaaaatgtgagcagaagtatggagaacaggactcccatgaagatctgcaggtgtctggaatgaaggaggcagtcaggagaacacagtgagagacagggaaggagaaagggagagaaaccagattgtggaacacttatgagtctggacttcatcttgaagccagtgggagtacagccaagttgtagtgtaagtgcttttaacctaacaagaatacagccagggggccaggcgcagtggctgtgcctgtaatcccagcactttgggcggctgaggcagatggattgcttgagctcaggagtttgagactagcctgggcaacatgtcaaaactccgtctctaaaaaaacatacaaaaattagccaggcgtggcagcaagcgcctctagtcccagctactcgggaggctgaggtgggaggatcacttgagcctgggaagcagaggttgcaatgagctgagatggcaccactgcactccagcctgggtgaccgggggcaaaaaaataataataataatgcagctgggcacactccaggagccagggtggggaagggagaggagaacattgagatggtataggtcattttaccctctattcctctcagtgaaagtacgttccagcttgagttttgagtttgctcctctctccaaccataacagttcctgcttccctgccttgggtaggtctgtggggcagctgcccttcatctcagtgcaggagcagccttttcagggttggacttatgagagatgttgtgctgatttccaccatggtgcccccctcccagggcttcacaagggcaacttggacacaatttttgctttccgtgatgtctttagaacttagctctcctgttagccgtgaccttactcactgtacgaaaagtcgaagcaaaggggtcacagagaaagatttctctgatgactgtgtagacagttggtccatggtgttgtggctggaggcctctgaatacccaccagactgaggagcctttgtcttaagacagagggaaggacatctgggagtgattgtgtcacccagagtggccagagatcaagccataggaaatgctgtctgtgaccaggattcatggatgtttttattttcctctctggagagcatgaattctggcaggcctgtgatctcttaaaacaatcaactcttcaattagaagttcatgatctttaatgggcttgagtccagttccaaaacaggccattgtcaaaacgtccaggaacagggatgaaacttgtttaaaagtttctattaagcaggactgaaaattccatttgtaaaaggatgcaactatgttttgtctttttgaatactcacagtacctaagaaagcatcacatatgataaagaaaaagactatggcaagtgagctttaaaaaaattctttttttgatgcattccatcagaaatcagtggaacatttcattgctgtctggctagccaactccgataaaataaggacttttaagggagatggaaagacacagcaggatatctgtaaagccagaatcatctggtggcaacatataattgtcctatggttgtaaccttgatagtgctgttaccatgggggttgggtggtggggcgaagtgcatttcccaaaactgttggctagctgagggatgagagctccatccatgaaaaccagtcttccagaggaggatccccaaacccagagagctatttagagtttgaaacaaattgttctccttctcaaaagtggcagaatggttagaatcatcaactgcacagcctaggtcagaagtgaagtttgtcctgttttatgaagggaaagacacccttgtttagtgagcactgaccaagcactagataccccactgaatactccatatacataaaagcactgaagtatcttaccagctgcataaccttgagcaagttgcttaacatctctgcctgttttctcctctgtgaaatggggaaaataacagcagcaccttataaggttattttgcatattaattaattaatacatatccaagtgcttctaaaagtgcttagcatataaggaaacactcagtagtgaaaactagcattattatttcatttaatcctcaacaacactgagaataaatattcttatactctttttactgaggcggtgcagaggctcaggaaggccaggttacttgctcaaggctcatgttgtatgggaaagttaaagcttggaatgtctgattctacatcgcgctctcctcctgtacattggcttctgttgtctctgggttcagctatcagctggctctagaccagaggtactaaggctagagaccttgggtaaaaagtcttcctctctttgaaagccccaatccagagaggaggtagatgggcaaaaaatccaccagcaaagatagctgccatccctcccctccattctccccatgtgctgtctgacctggaggccttgttcaatagcttttcctcctggagacacaagcaatctgtcctgctgggtcagtggcagtccttgcattgagtcagcacattcttttttttttttttttttttttagacggagtttcgctcttgttgcccaggctggcaatggcacaatctcagctcaccataacctccacctcccgggctcaagcgattctcctgcctcagcctcccgagtagctggtgttacaggcatgcaccaccatgcctggctaattttctatttttagtaaagacagggtttctccatgttggtcaggctggtctcgagcttcccatcttggcctcccaaaatgttgggattacaggcatgaaccaccgcgcctggccgagtcagcacattctttatctatgtaggttgcattttctctccttggagagcctcagattcaatggtgagcttatggctggcatgccagcagtttcctaaaatgtaatatcatcactattattgttattatatgagggaaggtgaataggaactcatcagaaacctggaaaatgttgtcagaacattagccgtgtaatttttttccccttcattgtctgcaccagctctgaagaaaaaatgcagaagtttgttgatttggagtagctggcttttttttttttttttttagatggagttttgctcttgtcacccaggctggagtagagtggtgtgatctcagctcgctgcaaccttctccgcctgggttcaagcgattctcctgcctcagcctcccgagtagctgggattacaggtacccaccatcatgcccagctaatttttgtatttttttagtagagatggggtttcaccatgttgtccaggctagtctcgaactcctgacctcaggtgatccacccaccttggcctcccaaagtgctgggattacaggtgtgagccactgtgcctggcctagctggctttaatggttgctgtttctggaatctctggctataggaatggatttctcaatggtatattcttgaaagaaaggcaaaatgctcaaccaaatggaactttttgaataagagttgacagattgctcatccttgccctcctcagaacaagtgtttgccgtttctctgatgtgggccttctttttttttccgaaaaagtctcactttgttgcccaggctggagtacagtggcgctatcttggctcactacaatttccacctcccaggttccagtgattctcctgcctcactcagcctcctgagtagctgggattataggcgcccaccaccatgcccagctaatttttatattttttagtagagatggggtttcaccatattggccaggcgggtctcgaaatcctgatctcaagcaatccacctgccttggcctcccaaagtgctgggattacaggcgtgagccaccgtgcccagcctgatgtgggctttctaggagggggcagcagatgcctctcctcacatcccagccacgcatcaaggatgaatggacatgtgggtgtcttccgtgggagttacctggcggagggtgggatttaggccccagggaaggtgaggagcagtgtaagggacagtcacactctgggaaagacatcgaagggtgacatgcccttccagagagcccagcttctgttcacctgatgagaggtgacacaatgctacggtgttcattcgtttgacaaatgtggatggagcacttgctatgggtatgccagacctggtggaaatagacacataatgctgcatcacaatgctcccagtctagaaggggagacacacatgaaaacaggtatcactaactatagtcatgatcacgatgggaatatgagggagttccccggaagcacaagggaggcagcactctacatggtctgaggttgagttctcctagaagcagaccatgagacaaggatttgagtgcaaataattgagtgagcagtgcaggaaatgaagaagtaaggaagtacacagggaagcctgcggtgaggatgtgccatagcacttgtatatcagttacttactgctgtaacaaatcaccccagaactccatgacttaaaccagccaccatttgtttagctcctgattctgtggccagctgttgaggctaggctcagctgtttgggtcttctggtctcatttgggccccctcttgcatctgcaggcaacctcgggttggttgggtgcctggctgttggtttgtggttcgctggcgttcctccgcatggtctctcctcctccagcaggctagcccaggattactcttacagtgtggccagggcccaaaatggagagcagcagtgcactagacctcatgaggcctagttccagagcaaatatattctcacttttgctacattctgttgatcaaagcaaatgtcacagggtcgcatggaaataaactctgcttcctgatgggaggagctgcaaagtcacatggcaaagggtgtgatccagagaggctgtcaatcagtgcatcatcccctgctcccacagtggatgattggcactttgtcctgcagggaaacgtacctcttggaatgactatatctgagaagtgaaggagctggagtgtttgtaccccaattcctgagattcactggttgagggctactctgggttaggtgggtggggacagttagctccctggcacttgcatccttgtctagctatgggaaaaggcccttagatacaaaaatgcagacactggcagctgaaagtcagcaaaagcattggggtcagggtggggagtgtgggaggggatggcagggacatggatgatatctcctgtacccgctttcttaaagactctcagttgatgaatttattctgaaattccaacaggagtatcatatcaccttttgacatggaggcttcttcccattagcttcctaggaatactttcatttcatgttttgccaaacacccaacattctccagtactatgataactattctctattgcattcgtctggacccttttttccccttcactagcaagcataacaatatattattgcacacatgcagaagggcatttggctttacagcaaacctatgaaccatgtatagggctccaagttttgttcccattcgctgaggacagcagcaaaggcagataagggatgtgtccacagcacgtccacaggcagagaggataagatccctgagccctgcatcatcctgggagtgacgtgggccaagcctagccatgcagcagaactctgtgtttcttaggagccctggctccagcgcagctcaggcgtaagcacaacccatgactctgggatgcccctcaattgtcttacaaagtaactcaggcattgatgtggggtagagacaagcccagcacacaagttcttccaggttgggggattttatgtgtgtacttggagccagagcatttctggtgcagaataggaagctgacagacagggattagagtcacttatctgaggtcaaaaaaattaaatagcagaggcaggagaaacacctggtgggaggctccaaagcctgatattctagcaatttgacccatgggccctcactttaaataaccattgcagcttggggaacctggcctgtctttaggtggaaacaagttttggaaattcctcctattgcagaaagcatttgatttgcagtttcctgaatgcgaggctccaagtgtagggaccgccacccaaggacgtttttctctgttgggcagactcaaagcactgaggggagcttttcagggcccaccatacatgagcaacagatagctctccctacagataccatatttcagggacagccccttccctcctgagcagacactggctgagattttccagcttcgactttctagatggtgagaggatggggatgctcagagggacagtgaaggcactgaggcagtaactgtggcaaccatagaagaggctggccacgtgctcatagcggccttcctcctgagacacccgggaaggctgagtctacctcacaggtgtgcctgataaaatttttttgggcagtgttttccttggcttccaaacatagccatccattggaggttttatgtggaagcatctttccagcaggcacaatgacatggctatttcccttgtgactggacgcaaggaaaggatctatgaagagaatgtagccccgaatccctcccttctctcaacttggagcagacagggagccatgtgtggtttccttgctaagatttttgcagtttattctgtgtggctgtgtgtgttggtcccttgccaataatcctagactcacccatcccggcacaggcttgttactgtgggccaagccaaattctgaagcagcgcagttgtttgttgtctgaactcagtcttccccaacacatacttttcttgttgtcctgcacacaccctctcatcagcacccctcccaagtttgttctgagccacctgatataacctcaggtgaacaagaaggctgccctgtggctcttcacggatgaaaagccaaaggcagctgtggcttcgctttgtccccagtagtcactggccacggtgagacctgggtttaacatgacctgcccataaatcagtttgctgcaattgcagtgagagggaaggtaccttgtagaaaacctctagattttatgagcttgtttccctgactgcattccagagccacgtgtgagacttgggtttaacgtgacctgtccgtaaatcattttgctgaaattgcagtgagagggaaggtaccaggtagagaacctctagattttatgagcttgcttccctgactccattccaggtgatcttgatccaaaaatgacgaggctgggtggttgccattggtgtcacacccacatcccttgctgtgcaggtgcactgctcccagctgctgtgctggctgctagctgctcacagtggcccgtcctttggtctggaaagtcacccttgccctgcctgggagggtgacttgttagccaatggctggctgatttggggtgtggattaactccctggtgcagtttatgctgcacagctccccttggtgtctggttgaggctagattccccctgtgcccacagccttggtccactcctgccctgtccctgccccagcctggttccctggctcgccaacagatccctggatctctgccacaagctctggcttccagggaagggagcctatcctgagatgcggtagaacctcatgttttatttatctgctcttagatctcctgtccgggcaggctgattgctttttaggattccaagtttcaaaaggaaatcaaatccaatgtatttatcagacattagtgggagagaaaaaaaaacagttgctcattggctttttatttgccctcttggaattgcagaggattttgttatttttatatttaaaaaccagacttgtggagtaatgtgtgggagaccccttcaggctggtccaggggactttgtgtctttagagattgctctggacacctcttccactgaggctttgtttttaaagaggactttccagacccaagggaatggaagggggctcccttgagagaaatggctttcatacaaaatgtccttactggtggggaactgaagacaggtacagtccttactgcataaggggacagatgatgttcagttacagtcataagcctttctcaccaggagcactggactctcctttaagaaagttttctgtgataatgagatttgaactggaagaaatgctgttctttcagttaacagttgtgttttttccaagaaaaaaaagaaatacaaatgttaaaacttttttttttttttctggtgctaaagaacaatttcacctcctaagccaagaaggaaaaaattctcatctaaaccgccaggcttaaaggtggctccttgtcagtcctgaggtggtagaattgaggtgaatgaagtcaaccacagtttctaatgtcttcttatatgccttcagaaacaccatgctcacctttcctcctgctgtcctaggctgagcctgccatccctccttccctctgtccatcacagcctccccttagggtcattaactcagtccctaccactcaccttcccataggacaggtgttcttaacctggagtctatgtcctcttgctgatctgtgaacccggataaggaaatgattgcattttgttttcactaacttcacactgaaatttaacatcatattcaattatgaatgtaggaaacagactacagtaatattaccaggacctgtgactctgtcccaaatagaaatcacaggtattgtcaaatcaagttagagttattgcagatatttcaaactaccatttacattcatccctccttcagagttatagcattagatttacctccagatctttttatttaatatgttttttttaaagcatattgctaaactacacatttgtgctctcccctttcccatagggctacctcacctcccaggagaaaagattcaaaatctaggagattcataatttcaatatattccattgcttgtgactatttatggccgtatttggttcctgagctagaaacagaaaagttatggccatgacagaattacttgtcaagggactatgatggccctgctaacctgggctttcttgagctgtctgccccgctagctttgatgaaatgcacatacactgcttgcattttctgtgcaatggccaagtgtaacaggcagcacacatgtggcagatcgtagcagcgggcccttgccgggtcaagtcatacatcgctgcacaccggggctgtcttaggacattggacctccgagcagcctgcagatcttgggaattcctctgccccctaaagtattctttgtctttaatccagttgttacagtgagtgaacctgatttgttccagatgtcctaagatttagtgattccggaaactactcctaaagtcaaggctgatgaggatttgaattcctctgttagctgggaaccagcagttcttttcacagttaaacagatgaggcaggaggagggagactgagctgccttgagggacagggaggggcccactgactggcttatttgccttgttagaaagaggatggcctttgaagcaaatatcgattctaccactacatggctggggccaaagtcagctgggcagggacatggacgtgctattttttttaaagtaatacatatttaccttaattatctgaatgttgttgctagggaaaccactattttggctcagatcatcttagtaaatgcttttttctctcactttttgagcataaaactggcccaggtgggtacctatgagggaggtggaggtatttctggcttcctataagtgagtttttcaaaccagaaattcagtcccaggaatgatttccctgacccactgtaaattttaattgaggtgcgttacaggggtgcactatgatctctctctggagttaataaccatatggatctgttttgcctgattagaagggatttctaaagcatgatgagatggggaagcacaattcaaactacatggcatagtaactcactcccagaggaagttaaaacatgtatacatacatatagaatgttctgtttaatattattggtttatgcagtatttgaatatataaatatgaatataaagccacgtacagttatggatttaaaacaaaagcagaacttaattaatgttgctgtttggatttttttcaagtgtatttgaatgcagacaagtatccagatagatgctagtggaagtctgggacaagctgtataagggtatcaacccagggttcagctggagctgggccagactactaggttgtgtatttagagaaactagggcaggactgctggagaagaagctgagtggtgccaaggtagggcagtgatatggtttggctgtgtccccacctaaatctcgtcttgaattgtagctcccgtaattcccacatgttgtggcaggaacccggtgggaggtaaataaatcatgggggcgggtctttcctgtgttgttcttgtaatagtgaataagtctcacgagatctgatggttttataaaggggagttcccctgcacacactctcttgcctgccaccatgtaagacgtgactttgcttctcattcaccttccgccatggttgtgaggcctccccagccatgtggaactgtgagtcaattaaacctctttcctttataaattacccagtctcaagtatatctttattagcagtatgagaacaggctaatacaggcgggataggcacacctgagaaggaggacagggtcagataaggtggtaagctttgaacagaagaaagcgtatcataggggatgttgagcttgttgggatgaggagcatccaatgggctagagcaggtggtttagggctgaggctgtaaaccacaggggattacctatgtttatctggggcaagttgcaggataaccacaggacaagactagtagttggacagaaataccaatttttattattctagaatagattaaaatataaaataaaattagattttctctaatatatttagaattgaacctttttgggtacaatattcttttttagtatttcttggtgatttttttttttacaacaaaaaatagagcaatacctttcttggttagtaaaataaatccctaaatatttgccacaatctctagaatcttctaaatcaggaaattttaatgattttcacagcagtgaaaattgatattcatattctaaataattccatgtttcactgaaatctgcaggaatcgaaaacaataggcagtcactaactaaaatgggacagcaagacagaaacagtttcctatccctgtaggaaagagaaatctcggagctttcattgcatgaaaaccgactccattttagtacctcgttgcactttaggctttccttgtccagagttctcacacatgacagtgagctccaactacaacctattccaagctgagagtaatggactgagaatctgaaaacatgacacatcaatccattccccacctttcccctgtgagactcaaaaaaacatttcccaggctcccttgcagataagcttcttgggaagttcagccagtggcatcactggtgtgagattggagaaagggaggaggagaaaagtcagggtgtttctcctcaactccactcactttaagcagcatctctggcagtagctacttctcctccaccgtcttagctccctcttggcagtcccagtcccagtcacaatcacaacacctcctccctcagtccctccaactctaagggtgtcagcagttgcttctgatctcagcttttccttatcttaccttgtttgctcttctggttcttttcacacctttgtacctggttccccattttaatcccttctatgaactacctggcatgggttctgctttcctctctggactctgactaatacatagtgggtttgaatcctggtactgccactagttactaaataagttattaagttgtctaccttatttagtcctcaatgtctttgcaaaatggggaggaggttggtctgtaatgaattctgagatcccttgaagctttgaaaatccgtgagtctctaaattttgatctcataatacatattcatgaaatgagtgtatttttctagctccattacagagatagtttttattatttgctttctaggacatggccttagccttcataatactgtttgtttacagatttcatgaaggcatttaccctggcattgtaccactaaaggctgatgttggcggcattattcttaggagacatagaaatgttgtggttttgagaatgggcttttatattatttggcgtagattattaaagaacagttacctgtgtcatgaaggagaggcccccagactggcactttgaatgcaaattcttctgtgacaaatccaggggactttggaataactctcagatatggcagtagacttaactgtaaaagctcccagcccacagaggtgagcagaggctgaggagtaaacaccataccaacattctgggacaaaatagcctgaatgctgttgtaccttggaaatgcaatagcagctgccttcctaggtggggaagctgagagcagcctcttacaggagtgcatgccctatagacagaggctcatgaacttgtgcttgctgacatgtatatcttcttcagttggtccctagtgagtctacccaaagtgaattgcactggggaaattcagaaatatacacccctcagattcaacaagggtggtatcttgtgtgtttcctttaagttataccagtttatggcaggggcaatgttcaaaatagttaagaacctgcacagcatgagcacacctacctttaagaacagttgccagtcatagagaactggtacagctcccctggtgcaacccactgatggtcagtctggggccaggggtgtctttggtcacccacacccacatttggctggactgtgaggcctgggacttgaaccacatcagtagaaattgaggctatggcacctgggatgtctccttgtgacagttacgcaagaaggaaagtgaacagaatgtggatcccaagggttgggtagggtttgtccagagccttgggtcctttccagaaggagcttgggcccctgtaattcagagatattcagattaactgatctggtctcctgccagtgacaggcctcactcactggaccattctcctattcagaaagctgacataggatcctgtagcaggaatgatcagtgctggctgcatcccttttatatttatgtgctatgctggtatgcagctactagtaactatatctctttgccttttctgcctaccaagtatcttgccagaggtactgggagtagatgtgcagccccccgcctttgcagtagccctcaaccaatgactgactagagtggacacgtaaatattccctcatcccacaaatgggataactctgttctgctcatgtgttgcacagtttcccagagctccccagcaagattaagttccaggtgctcagggagctgactggcttgatgttgctgcctttgctggttgcctgtccttctgtgtctcactctaccccttccctactggtgttttatggaaccacctctggaataaacaacttgctttcaaacctgtctccagctctgcatctgggggcgcctgcactgacattctttattccctagatctgtgtggcttgctacttttttctcccaccacatcacaggtaatgaatgaggctcatttgcacaacatacaactttggacatcagattttggtgaaactcaaaattacttggtgagaaagaaaagcacacatatgttacgctttttttttcagcatttcacaatattcactaaagcattttataagcaagtgagttgtaggagctaaatatgatcaatttttaaaaactactttttttttttttttttttgagatggaatcttgctcttttgccagactggagtgcagtggtgtgatctcggctcactgcaatttctgcctcccgggttccagccattctcctgcctcagcctcctaagtagctgggactacaggtgtgcaccaccacacccagctgatttttgtatttttagtagagacagggtttcaccatgttggccaggatggtctcaatctcttgatctcatgatccacccgccttggcctcccaaagtgctgggattacaggcatgagtcatcacgcccggcccaaaactatttactttcatttttacccaaatttatttcccctggacgtctacttcacaagcagtaacataagcaagtatgtatcattaaagatttatcacaaatcaaccatattatatcgtaagtaaagtaaaactggtgaaacaaatttaatgcagtatatcccaaaagtaattatttgagcatgtaatcaatattaaaacaactgtggagatttttacatctttgagtatctgctgtctttgaaaactcatgtgtatgttaaacttaattcagaccagccacattttaagcgctcaaatgccacatgttatctgtagcaaccatatggggcagctctggtctagcacatgaacttcagagttgtcccactcaataggcaagggagctggggtaattatacagcagttcccatcagtcattgagggttgctgcagagcatgtcagaggcttaattcttaggcactttcctggcctgcagaaaaaagccctctgacaaagagatggggatactgactagatagaactgcagtctgtgcaggttacacagtgataagaccccaggtggaaccacttatagctgactacattttttaatatcttcactttggtgttttattattgtcaaattacttgcaataatgtatcttaagttggtcactcaagaaaacttggttaaattcatgggcctagaagatcaacatcaaatctttgtcttcaagacctaagggaatctggatgtgccctacacatatctacttgcctctcgctaatctttctgctaagagtgtccttctcctgcccctttccatgttatttctgcccaccttcatcctctgatcatgtttatttttctctctggctggaatgtactccctgtttttctgcccatcaataggcagagcattttacaagcaagtgagttttaggatcattctttcagatgtggctcaattgctacctgtctctggaagcttcatgtaataacttcagtcaacagtgatatcttttccctgagtttctcttgccccttgatcttcacctgttcctttggcaggtcttatcaacttcatggtttatttcctgggtaattcatttaccagcatgcattcaggaggtgcctgacagtcctcacttattccctgtagcttaattaacaccgtctcttaattcttcatgttataatcaatttatttggtattttttgctcatatctctcatagaaagacaacagatgagcaattttggttttatggtttactcatgtttgtaattttaaactctgaaaattgaaaagctttgatagttgtcaacaaagtacccagaaagaaggttgcccatgagagtggctaaagacatctagagtcatctcaaatgcctccacaaatttcaaagaaaattgtcaagagaaaagttaagcacctcagtagcatttgtaaagagatgacaccttatgttctaaatattctcccagtattctaaaatattctaaatgctaaggaaataaacacaattttatttataatcttatagccaagtatgtttcatatacattgatactatttagttgcatttttatatgctttaggagcaatgggaaaggcaaaggagcactgactggaccaggggttagagctctgcccttgtctgctgagtggccttggggaagtcatttaactgtctgcctttatctgcaaaatggtgacccaaatgggcccccttccagctgtcaaattccatgtctgattttatgatgtctgccctttttaagaatgggaagcattgtttgtgatttcacattgcaggggctatttacatgtatgatttgcatcattgattttatgatacattgttgagagtatctgtgatttttttggaagctgaatccttactgagggcatgctgcccctagttatgatattgctcctaggaagaataaaatctgcttcacaatgtcctttttggtatgatttccatgattgagaaaactggggattgtatgtgtagtacatctggtttatccacttgtctgtccatggacactttgggttgtgtctacccttggctactgtgaatagtgctgctatgaacatgggggaacaaatgtctctttgagttcctgctttcagttcactgggtaataaacccaaaagtataatttttgggttatatgacaattctatgtttaattattttgagaaatgttcatattgttttccaagcagccactcgattttacgttcctaccaacagtgcacaagggtttcaatttctccacattcttgacaattcttgtcttctgtttttttgatagttgccatcctaatagtcatgaagtgggaaaaaatagtttttaaaaagtaacagatggataaacaactaagagaaagaaggaaggagtgaaggatggacggatggacagacttggctgccctatactattatcctagtcatcattgttaaatatagttgtggttggtagatacaataccgataataataatgatggtgtaatgagaatttttttaatgcaaatatagttggatgcatttgattaacacttgtgctagcctttactcaggctagatttatgatggcagcaaaagaaaaggtcatggtttttatgtctaagacttaaggaaaatctaagtgatccaacagaatattattaagcaccatccaaaaaattatctggatagaagaggaaatttttgctttagttgccttagtgattcagcatatgtggttgatatggaaatgtattgcatttacccaacaaggaactttgaatggtaatcctaatgtacagtgatgaatgaggacagaaaacaagttctacagagattttctggcttgacacagctgccaagatgtcatcagtaacatcttccattgagtatagtgaatgaattggtgctaaacttaagtacaaacccaataacgcagtcaaaaaaaagccagctgctataagatatacttgggtaggatttttaataacaaatgagcaatatattttcagcaggctatatatatgctgtaagataagctttatagaagcagtacactttgtatcttatgttgactactaataatgattttcatttaaaagcacagcaaagagatccatgtacaaagtaatataacccacttaaaagactgcacaagcaaattaaaataaatggggaaatttctcagggaataaaatttcttgaagattagaaacactgttcctcaataaataagcacccctggaatgtttagcacaaaaactctatgcttgatcgttttactatttcagcaggactgtcagagaggttggtctttgtggagtcctgttcctttcaggtgtttgtaaactttcttgccaaagcccttcccgactgagatggagttgatattagagccatggctgggacaaccttcatgccaaaggaggtgtgctgctagttgcaactcagaccctgcatggcccgggtgacctcagttgggtgggttcccctttctggggctcaacttcttcatctgtaaaatgtgaagggggagctgatgatctgttgtggggatgtcatggatgttcattcattcaagtgttcactgaacacctgctaggagagaccaacctctctgacagtcctgctgaaagatgaaaacaatcaggcacggggtttttatgctgaacattccacggtgcttagttatttattgaagaagaatctttctgatattcaaggaattttattccctgagaaattatgtgccaggcactactctgtcactaggagttcaacgataagcaaagccagagaagggtcctacccctgatgtttagattctagtaggggatagacagtcctcaaccaaaaagccccacaaacaaatgcataaccacaacttcgataagtgccatgaagggttgatggggcacatggggggtggggggctcataatgggaggatttatttcacctaggcagggagatcaggaaggatcccctggggacatgatagtcagggggctggagaatgtgggttatgttggagaggaatgagttttgaagggataggagttgctgggttctcataccagcacagcgtcttctctctcttcatctcaatttcctcatctctctaatatgggcctaatatcaagaccctttctcagtgttgtgaggtttcagaaggatgacatatttgacaacacccaatatcatgctggcacatcacattttcatttcatttctaaaaataactttggaagcagagatatgctgttttagtcaaagacttttttagctttggagaaagaatgaaaccccagctttgagactcctctaaaaaaaatctgagttcacattctgccctggaagttgcctggctgcttcccttaatcacagagccttgtttgaatcacttgactttgaaatcccaggaatgactttgctgtgtgattaagtgacagaggcccaaggtttggggattggcagaagtttagatgtccctggcctgatcccttaccctttacatataaggaaaggaagctgatcacatgaacaactaaactggaatgaggaggcagcccctcctccatggtcctgggctcatctatactgtctccctgccaaatattccatggaaaccttggacactgtctgatgtcaggactacttatgaatgcctgtccacttccttctcaagataaagctaggttagcactctctcataactcaagcctgaggtttattcttttaatcttccaaaagcaaacagaagaacagaaataacctatccactgtttaagattaaaatggccaacaataataaataattgccacaatagcttgagatcagggtcttaatttattggaggccgttcaagaatttgcagctcttaagttaatttttcacatcttgtttggatcctcagagcccgtgcttccaaagcaaggccatcatatttctcattgcacatgttattcttgttgatgtgccagacatgcaggagagtgaggtcctctcttcacagatgggtaatgaggattccacccccccagaaattagtatttcaaagtatttttgcctatggagattttgaagagttctcttcttttgcatggtgtattagctgtattaatggttgcaaacaagaaaaacgtatgctggttaatttaagcagaaaaggaatttattaaaaggatgtggggtggttcagagcatagacaagaaggctggggaaccaacacaggcaggaaacagaggaggcaagtcttagtccagggttccacctctgggccctttactcctctgtagctacttcagatgatccctggtgtctctgtgcaaccctcaaaatttgtagccctgggtgggagcatctgttctcacatcgctgccacttgatcacccttagatcacatgatttcacttaggcaagtgcccacaccctagtgatcaagaagaggggaaagagagggtctgccccctttctgctgatgtgccgccccacctatcttgagattcccccaaaacacgaggatgtcaggatgctgagtggccaaaaataacaaccgttcattatacaaacccttatatccttaattacgtcttccattaactggttatccgattaaaactggccactcacatggatttattttgttcaaaggtcgcatcacacaataatcatcagtctctcatgcatcttcatccttgtcatcttcagcctcagccttatcaccgttctcatcctagccccgttcactcacccctgtcctgggcccccatttccctccatctcctcacctctcaaacgttcacctctttctcctccaactcccagtctttcaccctacttctatttcactacaaaatagaagcaatcacagaggaattcccgcatgttcctaccacccatctactaatgcatcttcagctcacctccagccaggcgagaacagtcattcatcagaccccagcaattgttgcctgtcgtgttttcattaattgttgcctctctaatggatcattcccattagcttgcaaatatgctatgataattcccatcttaataaaaaagagcaaaaaaactccctggagcccacttcccccaccagctaccatccaatttctctgttctcctttagagaaaaactcctccaaatagttgtctgtcctcattgcttccatttgttctcctcctacatctctgaaactctctccagttaggctttcctcccatcgtgccacttcagcagttcttatcaaggtcaccagtgacctccagaaggctgattccaatggccagttctaattattcccattgttctggcctgtctgccatattggacaaaattgatccttcctttcttgagactgtcctctgtgaccatgtggatgactcctctctcgattttcctcttccttctctagccatgcttttccagtcttgttggctgacacctcctcatcttcaactcctaaatgtgagtcctcatttctatctatactcatttcctagtgatcgtttctagtctgtcccaaatgtatcctagcccagacccctccttcaactccagactcatgcatccacctgcctcaaaatctcctttaaaacccaataggcatttggattttctctgctgaaccttctcaacccagtctttcccatctcaataaatgacaacttttctcttctagttattgaatccaaaatccttgaagcagtccttgactcctcttttcctaacacccttcatccagtccatgagaaaaatctgttggcatgacctttgaaatgtgtccagaatatgaccccttctcaccccctcagctgccatcaccctggccttcacgttcatcttctcacacctggattgtcacaagagcctcctactcaggccccctgttcctctcctggccactccacagaccgttcacatcatagccaatgcgagcctcctttaaacactaacgtcaagtcacgctgctcctctgctcagagccctgaaggggcttccgagggtcaaaccaaggtccctgtgctggccctcaaggccctgtgggatctgctgccccaactccctcagtccctctgagctcaatccttcctgctctctttatcactcctctccagctgcactgacctccttgctgttacctgcacatgccaggcacacgcccacctcaggacttctcctttgctagtccccacataccgtgtttcttgctccccttctttcttcgggtttgtactgagaagtcacctcatcagtgagacttccctgatcaccttattgtaaattgcaccccacctcccttgtaagtctggcatgttctatcttccttaccctttgtaagttttctccacagttcttaccacaatctgacagacatatttgcttctttctatgtgtgttttctctctccctgaagctaccaggactctgttttctttgctgctacttccctagcacggagtagtggctggcacatggtaggcactcagaaataaccgcatgaattcatgtacaaatgaatcccacgcttaggttgttaagtgccttatagtttttgaagtttgatgtacaagatttcatgtgagcctctaaacagtctagtgagttaggcaaggtagaaccctgtgctttacatgaggaagctgaggccctagagctaactgattgcccaaggacacatggctagttaatggggctcctggaacttgtagttctgatctcggtttctgccccccaccttcaactaccccctgtgcctcatgttatattagtgtaggcctcagggcattcattgctgtctatttttcgttacagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggtaaggagggcatccctgtaaaaagagcagttgttccatctggtgcgcttgctgactttcattattgcctggaataggcaatgattctacaagcactaatcctttctgtggactatcatttagaatgattagaacttttttcttcctgggcttagaaaacatgttggtatagccaaagaagcagccgtaaatgcccacagagtgccagagaagtgtctgtatttatgtagtctcccatcccttctctcttgtggaatcctctccctatggttttacatctggccccttcttggagatgatacagttgctgtctccagcacacacatgttctagagaattccagttttaggtcagtagttgtgaaagtaagggcagatcactgcttgtcgtgttagttattatgtatgatgtacttgatgtttctagtagagggtcactgctttggcctgtgctttggattatttatttatttattttttgagacaagtctcgctctgtcacccaggctggagtgcagtgccacaatctcggctcactgcaacctccacctcctgagttcaagtgatcctcccacctcatcctcccgagtagctgggactacaggtgtgcacctggctaatttttgtattttttggtagagacagggttttgccatgttggccaggctggtctggaaatcctgacctcaagtgatccgcctgcctcagcctcccaaagtgctgggattacaggtgtgacccaccgcccctggccttcctaacatatttgagtgaattgaggtagttaaattatttccacaaattgagtgagtttttttagagtaaattaatttgaatgaagtgaagtttatatagcatgactcaaaggtacagtgctggtattctcccctacccataatcatcccgagtgtaccacctctcagaggaagtgaacaggcttccctgcagacaacaagggggaacaagtggacaaaagtcgactctgctctacccagtgttgctctaactgctgatagctgttcagctgggactgcttgcagctttttaatatttacagcattgaacggggttgccttgttctttatgttaaaatggaaccaaaatcactttctgtggaaaaccttcactctgcccaccgatgagcactgggcatacattgagcaggtcaacggcgtttgttcaggcacatattctgtggcctcaatagtgttgacaggtttgtgccaagcctgcccagcttaggggacagctgaaatgctcagagccaccaacagtagaggcactccaaaactttccaagaagtcatctcagattccctgctgcttcatagcttttaggagctccagggttgagggaggccacaaaagcaatcaaggactgcaggaggggtgtgctttccatccactttctatattctaaaaattaccgctggattaagcccagtcaagagagaaccaagtatctgtatggttcaagtatcgctggccacacacacagtatcttttacagaatcgcatgtgctgtgatgccatctccctgtgcagggtgggttggtaggtgggggaaaggggcttccttggggatttgatctgtggaactcatctctgtggtaactgaaaagatgtaattggcaactggctcattacattacacagatttctctcactcaggacccatgcgagaaatttccttccagcctcatttaagctatttccagacttagaaatagctgtccctttgcctgagaattttggcttgtttttaccttgtgactgactaggcttcattctctttattggctgctagaaagctcagagctgaccccactctgtcagtatataggacttagtcttactattttataaactcactagcctcctgtatcttgctttgctccccctttaccatgcttttctttttagcttggagattgcataatattctaccatatggatatactgtggatttaccttaaaaattcctcttattctgtatttaggttattcccagtttctatattaagtaaaattgtgagaaatgtcttttatggagattagtaccagtaaatgatcatatccttagctctataacttttcagagggtgtgaagtcacatttttgaccacctactatacaccagggactttttgcatctcgtccgcatcccctcttcactgcatgaggcacaatgtgtgtgaattattggaggagcactctcaggagaagaggggcgagggagcagggaggggcaggggatgggctgggagggatgtgctgtcgggtcaaagctagccttggtctgatttatgggctgggaagaggtggggaagccctggagcataaatcactctgcagaattgtccccccttgaagctgctggggacagcatcattttctacccctgtatcgtcattggccactggagggacgcaggcgtggtgagtagcctcccaagcatgctggacaaggaggctctaggaagtcaaagacaatgtgcctgggaaggccacaggtacaagccattggccactgtagctggccatgggaaaaatgggagcacatcattttgatctctttgccattgaattccagcaacctttgaaacctttgtcacaaggaaccctaggtttcagttcgacagaaacttgacaaagcatcaggctcttcgggacgtggtgagtgttagctccagagtggtgatggagcagggaggtatcttgtagctgctgtggaggcagggccagccagaaacgcagatgggcaagacgaccctcagggtggcaggaaaaggaagggaaaagaaacagaaactacccttccaggactccagccacgctgcaaggttgataaacagcggatgtaaatggcatcacccagcaccgggtaggattctgacaggacccagtggctagtgaggggcaccaggagagcccccccaacctgcttaacaacccacaggcctaacaggaccaacatgggcctgtgaaatattctaatgggtaaactaagaaaagcatgactaagatacagagggaaagcataagttttaaaaagattattaatagaaaacaaaagtaaattttacagagcatctactttttgatgaaagtcaaaaaaaatgaacaaagtggaagatcagacagtagaacaatagactgtatgaaaatggaatggactgggaggcaagcaaaaataaatgttatggatgggataaagaaatgttacaatgaaaccaggaaatcagtggcagaattaaaatatgttatagtcaggaaagagcagaatcagcagaacagaaaattgatttaatgatgcggaggtgtttttgagaggctctgagaattcagagaaaaagaacaaagcaataaaaaaggatgacatgaggactatattgtggaaggtagaaactggaaaacagcaaagagaaaatggttccagaataattggaacagaagccattccttagacagcaaaggaggatctccatttcctgaaatgggtgcagcagacaccaggcaaaaatatttaaaacattttaatgtctacaaatagcttcatgaaatttttaattttaaggatatgaaaatgatactattaacacttagcagaaaacaaagaaaccagtttctacagacttttctgtaacattaatgtccaaaattagaacagtatattccattgtgaattttaaattcaacacacagccaacttgccctccattgtgacgtcaaaataaagatatactcagatatatgagaattcataggctattacctcttccagtttggatttccccaaaagcataccctgatacaatgatacaggtacaggtagtttatttgggggtgggcgatctcagtgttgagtttagacaggaaagagaggaaagacaggaaggcgtgcatttataagcaggttactgccgtaggcaccttgggcttgtcttcctcagaccctccaagagactgtgtgtaacaaacctcacatccacttcactccaggatgaggaagctgctggaggaccgatcccccagctcctgtcattcatcatggagaaccattccctgggcatgaactctctggcacttccagccttctctaagtaggtccacactgcctggggccaggaagcaactcaggcagaaagatgtgggaagcctttgacctggaggggcatggcttcaggtgaccagaactgtggctggttctggggaatgtgagcgaggtgctggccacatctgctatagtaaccatgagagcttcctgaaaagtagttatttactgataaactactcaagaatacaaaagtagttgaataaaaagtgtgccacagccaaataagcatagaatgaagcaaaacaatttttataaatatttacaatagtaagcaaatgtaaaaaaaagtattgccatggtaaatgcataatttaaaagattaataaaaataatcccataatctcagttataccaataacaatttgagaagaaagttgacattgtgactcctctgcttcactttcttcaggaaggagttcagactcctcagctcctcatgagaggccgtcctgagcctggtcctgcctgcctgcctttctccccagacccctggctcaccatgcccccacatactcacttgaatcagtcgccacttaataccaaagctgcctttacccaggaatcacccccaccccccatttttgtttaatgaactactatgtccttaaatctcagcttagggagcccgtgtgcaggctcctcacctggctgcacaggatctgtccacagaatagatggatggatggatggatgggtgggtgggtggctgaatggttagataggtaggtaggtagatgactggctgggtgactgggtggatgagtgggtggatagttatgtggataggtgagtggggatggctggctgggtggatgagtgggtatgtgggtggatgggcaggtgagtggatgactggctgggtggatgggtgtgtgagtggatggctggctgggtggatgagtggatgggtgagtggatggctggctgggtggatgggtgggcgggtaggtggatggatgattattcattttgtgcaaagttacagagactcaaggcccaggcctccaaggttacctatcttctctgtcatcacacagtccattagttatgtattagcttctaagactgaatacaaaatatcccctgcaatggatttttctgtcttctaatgcaaaactactttcatagatttattctggattattttttcctttgagggaaggctgcttataaaaacatggggtacacatggatgaccatctgctggcttttttctctcctaaataaagctaacttgaaaacacattataaaagagggcttaatttgttggtggctactctgctggctggcgtgtgctgtccagccagagcacagggtattatggccagcaactgggtttcctcaggggcaggcccagtgcaccgtgttgcctgccgggcaaggaaccagcaaagcctcactacagagtgacaattcctggggtgccctgtgggagcagtgagagggagctcctggggccggggggtgctgcatggttaaaaaggagcataaggaagaatagataaccactgcatcacaccagggtcaccattcacactgggttccatgtaaacgacacctccacagaatataatgtgagtggtgtccctggagatgtacagctctatggccctggagtcaaggtaaagcctcattttaattttttgccctggagccgtttggcacaaaggactttggctcttcttgcctttgtcaaacagccatgaatttgtttggacagcagttgttgaatgcctgctaaatgctagggactgttccagccacaaggagacacaaagatctagtccctgctcccagggagctcatggcctattggggccaaaggcatgtcagtaagcaattaaagcacaaggtgccagctgctctacagaggtgctgaaacgttgtttgaagcacagatatgacaaggtgaagcaagtcattaccacagtggctagtgccatgttggacagaatccttggataagtgcttaaggtacatggatgagcctccaaaggatctgatgtcagctgattcctacattgcagagctagggtgggtggaatgagtcagtttatttggctggtgaaggaggaacctaggttggagcagggatgagagggtagaagagagcaaaggaggaggggcaggagagaacccggtaggatggaaagaggctgcccatgttgaacaaagggccagtaacatttctggtggcagggagatgtcaggacattttagaaatctgatgcctgctgttacaggcctgtcaggactttaccactcataggttctaagaaatctcccctccccacctcattctgttttgtttttagcccattctggatttctgcactcatgcatgcctcatgtgaccagggataggcagggagaaaaactcaaggggctggggttatgtgtacatcttcatggtattgactgttatggcatgcatggaaacagacctggacatgaaaggataagcttcaagccaggtgcatgagggctcccagctgacttttgggtgcaaacaggatgcaacagcttgccacagagtgatagaggaggccatgctaggagagaagggagaacaagcagggcaggcaccctggcccgactcttacacacagtgtgagatgctctcttggtttgggtctcccagatggcgaggaattcagggaaatttctttatttgggagatgcaagaaataatggtagggggttgaagtgatatagtagggaggtgaaacaatggtagggaggtgaagttatataggcaggaggcagtgaatgaaaagtgagctgttaaaccaactactacagtgggcaatggggcttattcctgcagggcaacactaggaagagtaagggagctgggggttttatactcctttccccaagtgtcaagaattgaggtctcctggggctatttatattctccagtactcctgccctcccatatgcatggcaggagagacctacatggttttggaaaaatgctcttgggtgcagagatgccgtaatatagcccctggcagctggaagtgggctggagcaccctgagagtgcaagtaatgtggtcagggctcaccagcctctgccagagaggcccacaggattagaagtatctctaacctgagcacctcactttctagactcctagaagttgtgggttggtctgatagagcctcgctgaggttcttatacaagatctagtagcatacacctcacagtgtgcaggagttgggtgaggcaggtgtggtatgtgggtgaagaggaccagggtggggcaggaggaagcagtgaagacagtgggaagatggagggttccagcttcacccacagggcagcaggctcacagcagcattcagtggttgccaggtgggagtgaggcccagcacactctattttctaataaaaccgagagatcttatgactttggcagctaattaaaatgttttctgaacatcgtatgagccaaacaaaacatgtccagtgaccacctccagcctgcaggccaccagcctgtgacctccagcctggctgttttccgtatgttctagtccggatctgcatttctggtagaactagtctgtctgcagccttactgtgtttcatgttctccccttggcaacagataaattagtcaaagagatgagagtttggggcttcaagtgtccgagtgtctggggaaggagaggagtggagagggtcaaccggaatgtagtgtccatggaatttttagaactcatgatgttttgaaaactatttgctggctggaatatttgtacttcacagtgattgcaagaagcagctaaactggagtttgaattttagaagctgctagaagtaaaataacaggcaaccagtgtgaaatagagggaaagtgtagctttggtgaccagcagatgcagagttgagattccaactctgtttcttgtggccagtgtggccttggctcaagggtcttctctctgtgcctcagtttctttctctataaagtgggattgtgccaaggattaaatgagtcctacaccatcatgtacagtcccacttgtatatgatgggtactaccatggtagtcccgactctgccacacatgagcttatactttatagctcattcatttactcagaagagatatactgatcacctacttcagaccaagattaaatgctgagggggaagaggaaaataaggcaagaatataaaacatagaatgtatgtcagggggtgataactcttccttttaagccaaaaattatcagtcattgtcttaatgaaggattgagagagagagagagtgtgtgtgtgtgtgtgtgtgtgtgtgtgtgtctacatactgtaaaaaaaaatagagacagtgttaaactgacatctcttaatttaatgagttgcttgtacttaagaaaataaaattatatgaaaattaatgtgaagcagtaaatataggtcagtcaataaatgtctgtgttggcttttgtgactcctgattttattaaaataatgcttgttgattttttttttcccatttacttaccattttgcttaagtattggagtttttggtttagggatattgactttttaaaaccaagatatataattgttcaaatatgtgatgcacgtaatacataatagcgaagtttagataatgaggagaataatgccctccaaaaacaatggcagggggctaggtcctgactctttcagactgggcagggaggcatctggcccaaagggctggaggagtgcggtatgggattcagactttttatcaggtaggcagtaagtgaggtcttgactgagagaacagagaacgaagaacagaggctagagacatcttagaggaagaacaaagaaacagtgctgacaggccaggaaggtcagagactcagtgttgggactgctggaagaaagacaagtgaggaagaggggtgattgtgaactcagcagggagaacccagatcctctactcctgatcatgctctagcgcacagagcactgtaagctcgtgaggaatgtgcttcgtacctggcatcggttggccataagtcactgaatttggctaataagatgttgcattgtctctgatctccttgagagactgagatagatggataggccctaggtccttatttcctccatgggagggtattgtgggaggggtgatgatgttcgaagggaagctcatttttgctgtttctaaggagtataatttgagttccaaattaaactggtcttccaagttggggtttggaggcagtaaagcaccaggtcaactttcaaggctttcagtggctaattttttatgacagaaggcatcgagggcttgtaagtttgtttttcttatcaagtgattcttcagattatatctacctttaccacagaaagggtggtccctttctttcaggagtggttctctcttcactttcaaggcaaaccgctcaagatggcaccaggtgataaaacagatccacttgctaatctggatagagcaggaaggacttaaacatttatgtgtttgtatacctttatttgagggagtgctttggcctgtttttagacagaaggttccatacagaaactgcatctgggcaggagaacaaagcaaattgtgttacagccgggaaaccaagcattgagcaacagaatggttcttaggcagaagtgagcctcatccctcagtgctgggacagattacagccttccttcactgccgctttcattcagcgcagggactgattttcattgtgttctgctttctctggtgtctcttgtcaagttaatagtagcctcaagtaaaattcaacccttagatgtttatagtcatcttggcctggccattaagatgatgaatgaacttgctgcttgccctggtaagagagccctgagggtggatgccgatacttagaaaataataagtcttttccgcccccttcctgtctttaatccagtgccccaagccccctggtgactttaccttgaacttcctgtataacgccaggtagaaaagcctcacctggctggaagcccactcgaggctctaacacaacagcaagctctttatcttgctttgttggtcttccccatccgcttatcagatggaaactcggcattcctcagagacccttcagtgtttctcagttgcttctgcaggcccttcccttcctccttgagaggacaagagaaggtggcggggagcaggcacccccagcctgtgtttgtatttcctcacctggattacctgtggcccttgcatcagggagagcccagccttgagtgaaactgcctgggagacaggctgggcgcttcctgcggcagtcggcagtgaggaagtggtggagaaacgcagatgtccatttcaaatcacaaggcggcttcagtattccgccgcggggctcagctttcacgtatatgaaaagcttcatttgtgtattcactgcgtttggaaggaaggctatgttttgctttagaaatgtcaacagagctgtagttacgacaaggatcaattaagaaggacgtttcccagagccgcaagacttgagtgaatctgtggggggaatttagaaaacatgtgttaaacctctagatttctttttttctaactaactgcaaaacagcaatttaataatttcctcttttaaggggaaaggggggagtcttggattttaaatcttcctaaagcagcacagcatctcttgaaaagaaagccatgaaagactactaagctaaggcgaataaaataaaattttcaaaaatcgagaacttcagtgtcctagtctgggtttccctgagcagatcctgagatgagggctcacatgcaagtggttcataaaggatgtgtttccgggggaagacaggtagggagtggagagacgcaggacagggcaggactgaaactcaggcagggtccctcagagcgtggcctcagcctgatgctgcaagggggatcagaggtgtgagttacgccaaggtactgttccatctccagcttaggaagctgagttttgttctcccgtaaacaccagtcattggttaagggccacttagggaggaataagtggtagaaagtggtcctaggcactttccacccaggggtgaagtgtagacagtggggcttcaatagcttaagggcagaagaagacccacggttctggctcttggagccaaacgaagactgaagccacagtgtgcatgtaaagggagtccaaggagcattgggtggggcattgaaattgtttgctacagtcggtttaccttcaactggtttccttcttgttctgaaggatatattacaagcatattgacaaaagtctttgaactcttgaggtgtttgtatgatattctgtgtcagttgcacatgggatgtttctaccagcatctgaattggggaattgacatatacagatgcccgtggaatttaacagagaatgtgaatgtacggctacagtccgtcaccatccagcttgccagggctgtcatttcatccttttgaggccaggcttacagacagtctgggcttccactgcccccatgctctgcctgtgatgtgtggtggcctctggcattgttgtaactcaggcacctgagcataactagtgagcctgtcctgctctcccaagcaagtctgtgtttaaaatcagttaggaatatgttgggctgcatgtaacagaaaagccaccttttttagcagctgatccttgtgagacttttatttttctttggtaataataaaataagaaatgggcatttcagggctagtatgcacctgtgtggtacccacaggaaccccattccttctgtctttcctctcagcctgtcttcataggggttttcatctccatactccaaggctgggctttccctgatggtgctttttggtttccgcttccaacactacagctgcattccaagcaagaaggagaaggacaaagggcaaaaggtctgcctccttttaaagagctttcctaaagctccacttgacattttccacatatatctcattggccagcaccatgccacaaggtggggtggcaaatgaattttctcagctgggcacattgctactctagacagagtcagagttgtgtttattgggaggaagggaagagtggccattgggaagcaccagcagagtcagcagggcagagacctgagagaggtagtttgtgagtgtgtatccctgagatacgtagcagaactggggaaggactgcccagtgagtctactcccttcagtatttgtcagatcctgctcaattataagatgatctttatctgtccgccttatctatcttcactgacgtgtatttcttattttcacaaaatgaagccatttcaacgatgttgtcaatgtgtttggatttctgtccttcaacagaggtgccacagctccatactaggtcaatccatgcaataaagaccaagttccagaacccctgtccttcagaccatttggtatatataatttccaggcccttcttcactgttctgtttatcactccctgtgctgtctctagtttggcatcttcctttttaaaatagaacccaggcttgaactgcaattcaaccagcccagcatagttattattgtcccgagtctaaacatgatatttctgttaatgtggtagccacagcacaattctatttattcttgaggcattccctcttttattttcttggtctttttgtgttatttggaagtgtaatcatgtcatttatacccttgctactcgaatatggtccatgaaccagcatggtgacgtcacctgggagtgtgttagaaatgcagaatctcaggccgcagccctccggggtcaggatatgcattttaacaagatcgttgggtatctgtatgaaaatgaaaaattgaaaccagggcgagatatccagggcctcagaggaaaatctcaaaatggtcagggaggtcccttcttagagatgagaaagtcactcagaggctgccatggcctaagactgagacaaagagaatatgtctgtatacaactaaagaaaaagagaaaaggttcgctgggccagagagtggctagagactcgattgtactcagacttgctgtattaccaacaggtaatgtacaggacagtcatgacctacacctggctaaatccagtagtcatttttcagtcttctttctggacccgtcagcatctattagtacaaataacgactacttctgttattattattattattattattattattattattattattatactttaagttctagggtacatgtgcacaacgtgcaggtttgttacataggtatacatgtgccatgttggtttgctgcacccattaactcatcatttacattagatatttctcctaatgctgtccctccccttgcccccaaccccacgacaggcccccatgtgtgatgttccccttcttgtgtccaagtgttctcattgttcaattcccacctatgagtgagaacatggggtgtttggttttctatccttgtgatagtttgctcagaatgatggtttccagcttcatccatgtccctgcaaaggacatgaactcatccctttttatggctacatagtattccatggtgtatatgtgccacattttcttaatctagtctattattgatggacatttgggttggttccaagtttttgctattggaaatagtgctgcaataaacatacgtgtgcatgttctttatagcagcatgatttataatcctttgggtatacacccaataatgggatggctgggtcaaatggtgtttctagttctagatgaatcaccacactgtcttccacaatggttgaactagttgacagtccccaccaacagtgtaaaagcattcctatttctccacatcctctcagcatctgtggtttcctgactttttaatgattgccattctaactggtgtgagatgatatcttattgtggttttgatttgcatttctctgatggccagtgatgatgagcattttttcatgtgtcttttggctgcataaatgtcttcttttgagaagtgtctgttcatatcctttgcccacttttggatggcattgtttgttttttttcttgtacatttgtttaagttctttgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgcctaggttttcttctagggtttttatggttttaggtctaacatctaagtttttaatctatcttgaattaatttttgtataaggtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtccccatccttgtatattcagtattgtcagtcatttttattttagccattctggtgtgtaattgtgtttctttgtgatttagagctgcatctcccatatgactaataaacacgttttcacgtgcccctcagccattgggacacttattttagcctgttcaagtcttctgcactcccttcttctggggatacttttcttctcctgtgctgtggtacactcctcaccccaattcttctcactcgccactccttttctgcttcctttgttggggtctccttatcttgccaacctttcaacattggagagcctcagggtgcggtcctgagaatgcttttcttctgtgtatacgcattccctggatgaactggtcaagtctcataacttcatatcatggacatgctgacaactcccaaattttcccctccagcccagagctcactcctgaactccagcgttgggtaccaaattgcctgtttggcctctccacttgctgtctaacacatttctcacacttaagatgtccaaaatgagttcctgatcctcctgacacctgttccatttgtaggaaacagtaactccatccttcttggctctcccttttctctcatacaccacatctatttctcaaacaccctgttggctgatcctacagagtatctcataatccagccagttctcaccatcaccattggttccatcttggtccaagtcaccatcgtcttttgcctcattattgattggcaatagccttcttcataattggtttccgtgcttccacctttacctcttacactcctcctcttacactcctttgctcagaagtctccagtggcttctcatctcattgtaaagcttagttttttataatacctctaaggccctagaagatctgaccccgttgctgcctctctgaacatgtgtcctgtcactttcttccttgtagcctcagtggcctccttctgttccttgaaacacactaagcttatccctgcctcagggcgttgacactggctcttcccttaaataggcacatagcccactccccatttccttcttgtctgtgcttaaatgtcacctgattagaaatatcctactactccaaacaccctatctgtcctctttatcttgcttttctctatagaacctatgaccatctggcatactatttttttgttttgttttcttgaaacagagtctccctctgtcacccagactggagtgcagtggcatgatcttggctcactgcaacctccgcctccctggttcaagcaattctcctcctcaacctcccaagtagctgggattataggtgcatgctaccatgctcagctaattttttgtctttttagtagagatggggtttcaccatgttggctaggctggtctcgaattcctggcctcaagtgatcctccctccttggcctcccaaagtgctgggatgacaggtgtgagccactgcacctagccggacatactatttgtttgttgctggttgtcttagtcctcctaccggaattaggttaggtttctacatataatatgcaatgacttttttgagacaaggtctcactctgttgcccaggatagagtgcagtgacatgatcttggctcactgcaacctccacctcccaggctcaagcgatcctcccagcctccggagtagttgggaatacaggcatgcaccaccacacctgggtaatttttgtattttctgtagagatgggggttttgccatgttgcccaggctggtcttgaactcctgagctcaagtgatccacccacctcagcctcccaaagtgctggagattacagagtgagccaccacacccggcctggaatgactttttattcattgattcatacctagtaactgcagcagtgcctggatgtgtggtaggatctcaatctttgttgaataaactaatggatggtgggcaaataaatggatagaagatgggtatatctatctttctctgtactttatgagcactctttcaattattgttttatattacaccagtaatttttaagtagtgttaaaaactagtaaacaatgtaggggtttggagaaaaatgctaattccttatctcccggaaaagggaaaccatcaggaatcagaaatggagaaatgcttcccccacctggtgattgcatcttgctgtatgggatcaggcctgaaaagtgagttaagtctgttggtgctggaactcatcactgaggaacagcctatgtctgtgccttcaggggtgacagacagtggaccaaggccatgcctgcatattcctccctggacccctcattcaaagccagaatctctttcctgccagagcagtcctttgtccacatgggtttctgcagtagcccaagtttgcaggcccttgatagggctggagtgtgagctgtaatcctatgggcttgaaataatctctgctatgggctctttaaaataaccccaagtaacactcatgtcttatttaggtatccccagaagcaaaccctgagataagaattcaagtgtaaagtacctgtagtttgtttgggaggtgaagatagggggatatattaggaagtgagacagagaaaagaaaacaggagaaaaggacagagtgtcaagccagccacaactatgggcagctgggcttactcccactggggaaccctgggtccacagagcaagctccttggggttcttctgcctgcgtggtgaggagtctggggcctttatccacctgctcccagcagctgttgattgagggctgctcctgaaggcattaagatcttgacacttctggcctgttgtttgcaggggcagagcagttttatgacaagaaaaagtcctcaggtgaaaaaatgcaggtgtcagcaggtggagacacagggcaggggatctggaggaacatcagtggggtctgcgacaacctgtgaccacctcacagacaaggtgacttctggcttctcagtgactcagccacacttctctttttcactcactcttctttctggtcctcactaagacaaaatacagaatacagagcagcagttcacgggctatagcatttgaggagattaaatacaggcctccaaccacacaggccatctggaagctttggcctccagatgaggacataacgaggtcatctctgctttcagggagctctcagagtctcaggaacagatgtacatggtccatcagagtgtggctcagggcccagggtgggttggggaaaaggtgagttatttagcattggaggagcctgtttgtagccatggctgccaacatgcatgagccacttagaagggcttagggtggtgagggtacaggtctacctgtgaagctgagtgatagtcacggtaattacagtcacctactatagcctcacaatgagccattataaaaatgaggaaactggggctccagaaagatttctcagccccaggacggtgcagccaggaaatatcatagctgggatttgagcccagcttgtctggacactgagcctgtgttttgcacactatgcacacacttctcccagatgaagatttgccttcatccaaggggaatgtctgtgtgagacagtggcagcctctgatgggttcctgccgattggcaaggtggttagagctgtgtattgagaggtcttctccaaggtatcagtttttctctgggagggttaaagaaggaccttgcaaagcccatggcctttgaatagagagctctgttctgtttgcagtgactcccctcaaaaggcagaatgcaattctctaaagggaaaaaaaaatgaggtggctgctctctggggttaagcagagaaaaccgtcaggcaggagaggtggggctgtatttgagagggtgggagtggcccaggagacctcacggtacagtcagctgcaggagaggagctgctaaccctcatcttaagaatatcactctcttgacaatcacagttgggaaatgtgtaatctcagggtgcctccttgcccgggcatcttcattataaaagcttagtctttctaaatgcagccaagctctcctctgacaagagatgtgagaattccgttgacactcactgaccacctagaaaccagagacccagaaacccaaaggtgggtcacatggtcgccctgtccctggggaatgcacaggaaaagagctctgcctcccggaaggttccaggtgttggggtaaatagagatcctgctgctgcctctactcccttactggtctccctggggacatatttgaacatattttactcataaattctcatctcagggtctgtttctaaccagacctaaaacagacaggtcccccccttttttaatcagtaactttggtttattacagcagaaacttcccaaattactgatctgaccaattagatatgttttaatttttttatgaccggaatcttttccttcaaatgaacctgtttggattctcttatctgtgcaatacaacctaatgtaagtctactttgtaagtatttgttctgagattatttgttctgaaggaggcccaatccagttcagttaaatctgaagtttttgatcaattgggttgctgagattacaactttctttttcattaactattagtacttaaaatattgacatgctaagtttttagtcttctcttttttgacctataaaaaaggtcaattatatcttaaaagtttcaccttctatttggctattgtgtatcattctttaaatatctggctgggttcaacttgctaagattttatttagtatatttgtatctatagtcataaacaagatttctctgtaattttctttcttgtcaggttttggtgtcagatttctgctagtgtttgcaaaaataagcagaaagcttgcacttttctctgttctctgaagacatacaaccaacatagttgcaacagcaggcagtgagagctgacccttactgagagcttgtttatgtgccagaggctgctcaacactttttattaacgtgtttaaccctcacagcaacccagtgaggtatgtgcagttaccatctcagttttcctgatgaggaaaccatggcttagcaagcttaaggaggtgactcaacttccttagtgagtggtggggctgggattcaggcacaggcaggctggtacttaatctctctcctacaaataccagcttccttggtgagtattggggctggggttcaggcacaggcaggctgactccagtgtgctctaatgcatcttctttgcataaagaggcttatttacatgtcttttggggtatgctggctgctcacgtggctttgtagacattaccctctggagtgccaggtgctttgtgaattagatctttcttattacatcacggccagttttttgtggaggggggcaatgggcaaggaagcattgatgaattttctgagacagctgcgatttgtctaaacaaggcttttccttcagtacccaaggattctggcacacagacccagctccccaccagcctcccctggaatgagctttcctgaggtgcccgcgtgtctccactccaggtcctggaaagctggcagcagcctcactcttgggttttcctctctggaattaatttgtccccaagtgaactcaaataaaaggaagagcacctatgagagctttgcctttgactggggctgggaaggtggaaatagcatggtctatcctgttttctcatttgcccgttgagcactgaacgactggaagtagagtatgatgtgaagtcttaccctttgtgagtcagggggcttgggctgtctgcacacactgtctccaactccaccaccaccatccaactcaggcccaatatcactgggaaaaacccagatcccctacagaaatacaacaccggtgacttgctggatgctggtggctttgtgctattggcatggtgggtctgaaactcttgtagacaccaaagaaattggtaggttatggaatgattgattatatcctgtgtcagctggaatcctgcgacatgttctagtttcctagtgtgcagagtacaatgtgggcaatgctgggttgtagaacatctgtgattttcatgggataaaagcccttatttttgttttgttttattttaagtcaaaagcaatttctaccagtaagagactgaatgaataacaggaagccccttgtttgcatggttcagaactaggcattgcaaagataaccatttactctgatttcagaggtctaaaggtgttagttcccctcttagaagtaccaaacttacaaatgggaaagtggatgcttagaatggcatgaatgttggctggcttgatcatgagtgggatcacgatggcattcactctttcattcagcaaagttatgtgttaacaggtattaagtataccgttatcatttttccttactttagaagataagccaaaaaatttgaccttaatgaaaatagaggatttttaatggagatcagaattttcacttataaaagtaccatttacacatttcgtcactgctgacagtcattagctagtggatagatccaagctttaaatctgaatcttgtcataggaggatggaagctcaagttgttaaaggcctaaaaggttgcatgttacatatagaacaaggccctgggaaaggaaatggtctgttgaaagtcacaaggccaaatggcataccaggtttttggtccttgtttaagaaaaccaaatgtaggttcagaatagtttcttctttcttccacgtctctgaaagtccagcttcgtgtgggagagctctgaggccctctcccagccctcgtttttcagctcggggttaccacgtgtattccgtgaaatgctctacctgctttctgtatcggctttctagccagttgcagtgtacaatattagttttggctttgggaaatgaggtttctttgacttggctggaagtatacagcaaccattttatttttcttgtgcctcatgaattaatagggcagtgagaggaaagagcatgcatactgagcatctgagcttttttaaagcaacgattcacccagctttctagtataaaaaacttcctctggcccaccccgagcaaaccctcattcactgctcagtcctcccatttgttcatctggaaagaaggaatgttctagtggggccaggccccatgtggtatcttccttttctgaagtcatccattcattctcttcctggtggggacttaaggttggaggcagcaaaaagtggaaagactggtagatagtctgtcagctctgtggggtgggtgtgccatttggggggaaatgaaaccagaggaagtttggctttgcagagtgaggacccaggcaagttcattttttacactctggttccatctccttccccctgcacacatgagtcagctcccaggaggaccccgtgtccttgactcttccttgctgtctcttcaagctatcaatatgccctctctctatcttctccctctggaattctccctttccgtctcagttggactatctggactttttgattctgcttcttcccaaagtgctcttttcagtccattgtttttcctgagatgtaatgactcaagggtaaatggtacctgtcagttgcaacgcctgaaaccatagatgcataggtgcaggtggtttatttgagtagcgccccagaaagtaagaaagaaggaagaaaaggagggtatgtctttgaggtcactgccattggtgctaagacttttttgagaagcatatagaaagtcacctagaaatgcttacctataggacaggagactggagcactcacgccccagctccaatcccaggttgttaagggccacctccaaggaatggattgtcctgccctggccaggggtgtcattgagtttgggtgccctcagaatgctactgaagatggtacaaagctgaaatcatcagagttgggccagaaagaagtgacacagaacatctaaggcatatcataaaccatttctgaccctgatctcggaacaggatcccagaacagttcaacctgtaattgctttctgacatttgagcaaaagcatcagtagctcttctcatgaccacaatcagtttactaggatttttccataggctcaaagaaaagacagtctatgttctaagtacagatgaagaagtaaaagtttgtgttctggaggggtggggcttcaatctagaccttgcctctttctgatcactgttcttgacactggatctaaattaagaaaaacattaaatctaaaaatgtctaaaaagttaggacatttaacctatactatacaagaagttatcagctaagcaaataaaatccagactttgaaaaaggtaaataaggaactgatttactttaatcacaagttccttctgcttacaaaatgattcatactgaaatttttaaaaaatttcttaacagagtttagtgcaattcacataaaaaatgtacttcagtaatttgcaaatatttacttaaggatttagtaatttagtaatgtttagtaattttttcaacaagttcttttctgtttaagtgggttctcagaagtggttgcaccttcagcaggcaaggaaaatatttatttgaagacgtttatgaaacacctcccttgtttttattatgtttgtgttcttcttatatttctttttatttgcagtaccctcaagtactttgaaggtttggggacagtaaataaaattgatggccattttttgtcatgcatcttctgaattggtatgtttttctgtgttcagaatgtcattcctcagcccccaggggacataagtacaaagtgaaatgaggcgatgtcaggatcacctgtgcacattctgcttctctccaggccctggcttctcttctttccggtagatgaacttgagcacatgatctcaccacttggagcctagtaaaatccatgctactgttctgcaattgttcttttattctttctctctactaatgttttcacctatggatgtcagttctacttctccttggggctttaactaaaaaggaagaattgtctgtggcttcttagaaagtggtgtgtggacaggcaagggctgccctgcccttggctggcagcacaggctctgcaaagggggtgggtgagtgaccacatcatcatggctaccccttcccgagtgcttcctgtgggctaggcagggcccaggtagctcaaaggtgttcccatttgttcttcacagcagctctgaattcattagcataacaaaccacccccaaatctagtgggcttaatacagcaatcatttctatttgctcataactctaggggttagctaggcagtttttcagttctgggccaggctcggctgttcttggccaaccttactcatgtgtctgtggttagctgcaggtcagctggaacccaaatgttgtctggaacaaggggagtgatttagctagtggctctcatccccagcaggctggcccaggctcctgtagggttccaaaagagtgagtagaagttccaaggctttttgaaatctaggcctggaacagacagcatcatttctgctgcattctgttggtgagagcaagtcatgatttcagctcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacagctccccacacaacaaggaattatccaacaatgcacaggacagctccccacacaacaaggaattatccaacaatgcacaggacagctccccacacagcaaggaattatccaacaatgcacaggacagctccccacacagcaaggaattatccaacaatgcacaggacagctccccacacagcaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacatgcacaggacagctctccacacaacaaagaattatccaacaatgcacaggacagctccccatacaacaaagaattatccagccccaatgccaacagcattgaggctgagaaaccctggattatccctttttacacatgagatgagggtcttacaggtcttctaagtggtggagcctaggtttaatcccatttccgtactcttcagcactcactgtgctagtatccctctcaggcgtatgaatacgtcaagccacttcagcatgatggcgtttaagttttagcttgtctacaaagcagcacaatacagtggttaagagtagggttttgtcaccagactttctggcttaaatctgctcccatcccagcaccacttaatatgtgttgtaccttgggcaagttcaatgatgtctctgccttggccttagttttcttcttcttttttttaatgctgcctcaattacagaacagatgcctaagttttcttatctgtgagactgagctaagaataatgttgaccttataaatttgttgcaaagattaaattagacattcatgtaaagcacttaggaccatacctgagacatagtagcctttagttatttttgtctaattcttctttccctgatacagtgcccaccataaatccccagtcatggtgctgacctggcatgtgaagctggctgggaggaaagagatttttctctcccagcaaagtagtaaacaggctctctcaagcattcatccatctggggagcttggcacacaggacagatcctttctcttaagtgtcccaaggccaaccctgaaccatggaagccttcatttaccatcagtttttctttcaaaacttctgcaagggcataaaaatgggggactaaatagggaccaaataagtgagtccatgctttggaaatgatgacctgagagtgtgaggaaggggagagccaggagctgagtggcagcattgcgggagggctcttcctcccttggttggcagatgggcgggtgtgactgaggctcaccatgggtggactgagcagacgcctgccctcacacacaaccccatgctttcagaagaaggcgtcagacctccttgtatgggaacatcatcaccttcacgctttgtctttaatttgagaagcttatgtggaaggaaacagcacattcttgtgagaagataggttttggaaagtccggagtagacagcatgaatccagggtttctaaagtataccctctccatgcttgctactcaggaagcagaggcaggagaatcgcttgaacccaagaggcggaagttgcagtgagccaagatagcgccactgcactccagcctgggtgacaagcgcgaaactctgtgaaactttcattctgacagtaggaagaggaaaagactctggctgactccttgtgatagagcaaaccaagttgagtgttgtatttacttttctggatttattttcacaaatattcagctcagaatgtgccagggaggggaggaacacaggagctgtattggccacagccatgtgcgtcatcccaggggacacttatgtgagccctgtggagcaggaattgttattcccatcttacaggggtgacagcttagctcagaaagcttgcagtttgctccacgttacaaagctagtaagtagcagagctgagattggaacccccgtccgtctaatggcaatgcttcctcttttgctattctgcctcacaattaaatggagtaggacctgatccccgacatcgagaaactgacggtgttgtcaagaaataaatatcccccccccacacacataaatagagaacaataaaagataacgtcggaggatgaacccacgagcgtggtttgtgtgggaggatgtcttgatcctgggctcgcagggctgtccgctgaacatgacagttatcctggcttcacagtaacctttcagaggtgctctgagtcctgaacatcggagatagattctttatctggggagtgactacataatttaaccatttgttattttttattttatcagactgggatcctttaggagctgaaagggacagtatgaataattagccctaggacaacaggcagaaaccgggactgccccaggcagttaagatgcatggtgaccccacttaatggccaaaatacaaggaaggcttggtgtctccgcagcttcctgaagagggaatgaggggcaaggctctggcctcgcagccagctgagggagcgcttctctttccactgtctgattctgggtctctgcttcctcatctggatagcagccctaacacccactgtattagttatctgttgctgtgtcacaaatcacatgtcaaaacctagtagcttaaaacaacattgattagccctcatagtgggttggggattccagagtggttctggctcgaggtctcttatgagactgcagtcaggatgttggctggggatgcagttgtctgaaggctccactggaggatctgcttcccttgtggcccctcgcttggctggctgttggccacaggccacagagcactcaggaccaaggactggagtggtggaaccctcgtccttcattaacacaagcagggcaggaggatgagggtttgtacctgctgttggcaggggggcctcagttcttcagttcttctccatatgggtccctccaacaggtagctcaagtgttccaccatgtagtgactgactttccccaatgaaaccatccaggagagcaagaactgggcagaagctcgcctttccatgacctctcagaagtcacatagcatcacttctgccacattctgtttttcaaaatcgagccactaagtctggcctacattcaaggggaggagaatcatagctcactgtaaccttgaactcttgggctcaagtaatccttccacctcagcctctggagtagctgggactatagtcacgtgccaccacgtcctgctcattttttaatttttcgtagagatggtgtcttgctgtgttgcccaggctggcctcaaactcctggcctcaagtgaccctcccacctgagcctctcacagtgctaggattataggtgtgagccagtgcaccttgcctaggcttcacctttcaaagggaggagtgtcaaataatttgtgaacatattttaaaaccactgtacttagggtcaatgttctacacttataagttaagtaccatgtgtaaagtgcctgcagcagtacctggcacccattaaaaacagaatcttggccctccagagtccagcagctgcacttctgaatgctggtgggcacggacggggtttgatgtccagtaagcctgagcagccctgcaaatacagatgagcccaagtcacctgtacagttggggcctgaggaagttaggtcagttctgaggctcccccagatgtgggacactcctcacggacaagttcagtgttgtatttacttttctggatttattttcacaaatattcagcttagaatgtgccagggaggggaggaacatacctcctatgcggcaggagctgtattgggcacagccacgagtgtcatcccagggaactcatgtgagccctgtggagcaggctctgagcctcccccagatgtgggacactcctcaagggtttccaggtgaccacagagggtcccacctcagtgtggacatttccatgtgtcctcctgaaaccctctggtgagcatccccacccaccctttggtgtctggagccatggtggctggttgtccttcccacttaggggaaccaggcctcagaactacagctcagaggcctactctgtgggctgtccttttttctagggccttgattaaatttgcttctctgaacactgtgaggtatctgtacttgttttaactcttctagtgacagcaatagaaaacctaaattggtgtaggtaaaagagaatgtagggttttgcaaactgaaagtacctggggttggcttcgaccacagcttctggttggacctctggaagttgtcatagtgtctctttctctctctccatctgtcagcttctcttcctccttttggcttcgttctcaaacaggctctctgtcccttcagggtggcaaaatggttgccaggctacagtaaataaataatctcatttcctaaaagttcttgcaaaaatgtcatagagtctgattggtccaattgagttaagcctgggtcgcatgcccacctcctaacgggttgggagtgaggtggagtggggaggggatggctccccagagggaagggtagatggatgtgggtggcaagaaacatgtctgccatggtattgttatcctcatttaccaatgaagtgttggcactcagagcaggcaagtagcttggccagagtctcacagataatagcaggtgcagaccgtcatcctcctgccccactagtgttgatgaaggacgagggtctcacctttccagtccttggtcctgagtgctctgtggccatcttccacttaaagctctaggacagaccagcagctctggaagtgactggattaaaaccccaccaactgaagacagtggcgtgggatgatggctcgctgatgggagacagaatttctgtctctcctgtcagaagccctttgaagaactcagctgtctggacaacaaaagtgggagcttttgttgtctagaagttcatgtgacctttcctttcaccttttagtgctgcctaagtgtaagatttaagcacagcattcttttcccatgtgtcatttttcagcagttaaaaatccatcagctgaggccacacaaagttggcactccctcctccaccaaccctcagctaaaaggttcagtggaagggactgatgctgtctccagatgcagactggggccatggattgagccacagagggaggagggaggagggtctcaaattaaaaagacaagaaacaaacaatctccccaaataagcagaaagtctgagcgtggaactgagctggttggagctggggagggggtgcgggaggtactttcagcactccctcgtgagatcatggaacagggcaggaaatctgaacctgctgccaaagaaaactcgctttgccttttgtaaaaagcctgtcgagctttcttcacaagggagctgctggtggggactcacaaatgggcatgctgcctgccagcaagggtctcctggccagccctaaaggcccgggctgctctgcttacagccacacggctgtttctgagctgaggatgaccctccaggtggctgagattccctccaatctttttatttctggttgggaaaccctacacagaccagtgtctgtctcacggtttaaaaggctgcatgcaaaacatttcctcccctggtagaaatgctgcattgagccacagccctccctctgcagcctgtgcagtgtcaaggggacagtggctgcatgatgatgtgcctagcagggtgtcccccatcaggacagtcacaggggtggaacaaatgcaggagccatggagccaaactgaactgggttggaatcccagtttcagccacttaatagttacatggatattgccaagtagcctgagttctcagaggcttgatatcctcatctgtaaggtgggaagtataagacctacctcacggtgtcagtgttaaataagacagggcaaaatgatgaaggtactctgtaaatgtatgtccattccttcctcctcctctgggttccttttcagcacttcctcaccacagcaccattcttaagttttctagccccatttattttagaaggggaactggaggcagcttggagggaggtaacatctggatgtcgcagtgacagctggtggctggtgaggagtccacaggtcaggggcaacgggccctgcagacttctcagcatcccctgctcagaaggggctctcagagtccatgggctcagcaggctgattcttcccctctcctatgagaccatcctccatgtgggtcccatccaggaagctgcttccctcccaagggaaggaagccaccagtgtttctagaatctacatcagtgccactcaaagcgtggtctcctgaccactagcatccacaccagctggggcctggtcagaaaaacaaccgtgggctcctccccagacctattgagtcaaactctgggggtagtcccagcagtctgtgttttagcaagcctccatgactcgaatgtgtgccacagttggagagccactgtgctacgggcaggttatcccagagcaaaggaaggaaaacctcctctgcacaatgcactctgaaggccccactgaatacgggcatctgtgaggcagcatgggacctgatcactctaccatatatagctgttgtgtgaccttggaaagttccctcaccctctctgggtctctgtgtcctcatctgcaaaatggaacaatcataatactggattgaggatgagaagcatcaatctgttcatcctagcaaaatgtttagcaaaatgccacgtgttcagagctcaggacaggttagctccatcctgttaatgttgaggcagcccacccaggttaagggtctcattctgagagtggctttggacagcttgagaatctacaactgtaggtgacagagcaaagaaaactcttgaaaagtttctcttagagcctaatagcaataaccattaccatggtggcagccaccagagtaactcattatatcattccagcaacgctgtgggttaggagttactatctgtatttttacagggaggtacttaaggcaccacttgataagtggtagagccaagtcagtttgaaaaaaacataatcattgtgcaatgacaatttgagacattttcagggtcccagttccatcccctaggaatctgtaaagaggagagtggcttcaacctgctgttcagggcctctgccctcattccctggaggctggtttggacagtgtgagaggcatccttcccaaagcagacaaagagaaaacacatgggaatggtaattaaatgagtccatgtttaaggggcacttaagtggattaaaatcaatatgtagtcacataagtctgctaagccatccttaatgtttggcgggtggatttctttgtttaaaaaatcctggtttgcttgaaactggctgccccattgaagcatgagataggacgagagattcccaggacctggaagaccacttgctcagagtctgaaatgtttacactgcctctgactggcatctctataccagaaaggagaagagggggactagatgtttttgtgtgatagtctctttcctgctatcttaggctgagttccctaaaacaaaatcctgagatgagacatcatgtaaaaataatttgttaggaagtgttctcaggggaatgggaagtagagcttcaaagggaaggaggccaaacaaggatgtgatatcaagcaaagtccccaggagacagaaagaaggtgggtgactttggcaccgtctaaagtataggtcacatctcactgtcccaatcagggacaaaagagcatggctgaggattcccccaaggggatgtgaattctcaagcacttccatctctccatgttcatgcaaagaaggtgccaggagccccgtggccatcctcccacaaaagacacacaggtggtggcatctggggggtcaatgtgcatggttgtgcatggtagagacccctggatggagctccatgatgtgggatttacatcccgcccatactctgctgtgagagagatggtatgcagccagtccagccatctgaagcagaacgaaaaaatggtatggaaagcaaggcacctgaaaaaattttcaaagggagaaaaagaatgagcaaaactatcctgtagaggagagagacattgaaaatgacatatacagacacagaaaaggttgctcagtcaacaacttctgcaggctcaaagcatgggaagtaatcagtaaatggccaatttatctctccctcacagccaagccaactcctaacataattggaagtttaatatattccaacaagttcagaacaagcatactagatcttaaggcaatctcatggccctgcagctcatcctttttttcaaagaaattaattttcaaaaaatgactctattgagattgaatttagatcttatccattgccataaccaaaagcaacccttactatttgtgtgtgcaagtcgttttaaacagctggcccattaactgaaaaatgtcaaaaacaaatataggagaaaagtaagataatcttggaaggcaaagcctgtctccctatattgttcttaaaaatacaaaagggacacataacttcatcatttaattatattaggaggtccgtcattcagtgctcttgtaaaactgtcttgcccttgttctaattgcgtattgatcaccgaggttcttggcatcgggcttttctttgatgtgtgcatgatcagaacacactaagagacagcctgtgtgctccttcctgtcctcgtgggcatttcctaaagcttcagccctaagctggtatatgtttctctgttacatcaactgccaaggcaattactttacatctgatatttaatggaaaagcttctgaggacagggctatactcacatacctccacacctggcacagtagatgagctcactatctgttgaataagttcgtgacagaacagaagttctactgcagccacaaaggcctattcacagtctttaagcctgatgaagttctgaataagtaaacccttagctacatcaggcagtttatgaatggtgttttttgttactgtcatttgtaatagcttttgacctatgtgtttgtattagtccgttttcacactgctataacgaactacccgagactgggcaatttatgaagaaagaggtttaactgattgacagttccacaggcttcacaggaagcacgactaggaggcctcaggaaacttacaatcacggcagaaggtgaacggaagcaagaaccttcttcacatggtggcaggagagaagggggctggtgggggagtgccacacacttttaaaccttcagatctcatgagaactcactcactatcacaagaacaataaggggaaaatccacctccatgatccagtcaccttccaccagatccctccttaaattcaacatgagatttgggtagggacacaaatccagaccatatcagtgtgcaaatgatgagctaattttcccactaaagtaagcactggtatggtacatagtatgactatggtagtccagtattggattccataatttaaataactagtagactttttagttagttgaaaggtaaaacaatggtaataacaatgagctgtaaaatacgacctgtggggtgggaatggggacagccaatgcttctctggtaaagggaggccagtttcagcccctggtgcaacagcacccccatgcattcatcatgtgagatgataagtgtctttccttgaaccagttcttcttcttcctcctaggctgggaacttctccttggagacagcaggaactgtgttacaaaggcatatggcccaacaaaggacactgaggctactcagtaattattaaatgagagcatgaacaaaggaatgtaagatgtaacagaaaacatacgtgtctcacacatgagaattattgtgtagaagctgtttcccatttgagacaaaataagaaacacttgttgaacgagtagatgggcttcctctgggagcacagcaggtaggcacccatgttggagccagccatggtctgcagagttcatttctctgagtccctgccccagaggcacatgacataggaggctccagacaactgactcaaagacagagaggaccataataccagggttcctcagtcctcaccagcataagaatcccagagaaggcattttttttctcacatactctaggtctcaatctcttaacttcaaaaatggcagtggctacattagctcttgggaccagtgtttcaaaggctagtgtagaacacttgcctcagatgattcaagatccaggtttcctgactctgcttctgctgtaaagaatcccactctggaggctggggcctgcaatctgcatctttaacaagcccaccagagaatttcaatgcagtttcacttttgagggtttttaacttgattgtccatcagaaccacctggggagctttcagcaaatgcatgccgacgccacatgcattgattctgcggccacacagaggggcctgcatctgggtcttttttacaaagcttttcataggattgtcatcgtcacctttccagcactgttatgcaaattggagagactcatgccaaggtgaagggcttggtgagagcagccaggtcttctatgcagtgatcagcctgcacagctgggtgtggcatctctggctcccaggtggttccagtgcacacccccagttaagaaccaatgaagaatgttgcttgttaacaacctttgaaggctttttagcaaaaacaaagtgtcatattgggattcatctgtggcagtttgcagaacatatcaggggagagaggtgtgtgcaaggcatccaccaggaggccgttttgtgctggtctaggtaagaggagattggagctgacctgttgaagcaacaaagagaaagggaggaaggatcatcctagaagtggataccagttctttaagaagagtcctgagatgtacccaggagtagcaaagtggatgtgccaacccgagggaagagattagtaagctgctgccccctgagacagggctccatgagctgacaggttgatctgtggagatacactctgaaggtgctagactaggaagaggtcctctcaggccccatcccttcatcttcagccaaaggaagttcagcagtagctgcccctggcctctgttctcagtccacagctccaccagcccagttgcttgtgcagagggagaggatgtgggagagatgctgtcaacaccctccatgtcccctccacccaccctggaggccgcctatgacagttcgccataggcgaactgtttctctggttaggaactttctctggctacaggagtgtgctgcacccgagtcaggagggctggaagtgcaggatagttaacgtccccagtacagttttctaccaaggagagaccggtgagatggatagatgccccagctttctcacccgttgatgacacacttcactaccctctcctggagctccctgagatcactgcccatacaaactaattgcaccccaatgcttgtcccaaagtctgctcagataagggccgtgtgaatagacaggtcttcagttccagaaaagtgtatactcacacaggaaatatctctcaaataacatgggcagtgtatatgttatttttctggagggcagagggcatcatgaggaaggtggtcttcgtggggtgaatatcatgtttcctccagggagggctcagtgacatggagcagtgcttctcaaatgtccatgttcacagaggttagcttctaactcatcaggtctagggtggggcctgagaatctgcatttctaacagtgagcatgtccagggaccacactttgagtagcaagaccttcacagcttcaagttgcaaaccagttttgaatgagcagagtagaagggggtttgtaggtgagaaggaactcttcaccatgagtacatttctatgaagatttctggccaggattttagtaagtacctgagccccttcaaacatttgactcccgcataaccttttcatccaaacaccattcatgagttgtttttatgccatgaggttaaattctttcctatcatttcaggggaggtccccacttgttgagttttccgtcagcctataaggcaaaggaaaagagtgatagaaaataaaaataacttgattcattagatggaattcaacttgaattcttagtttgttgactaagaatttgcagcctccgaggaaattttttttaattgaagaaaaactaatttttaaaaatctgaaaataattcgtttgtgactatttaacagaaggaaaaacttcctgagtgagcatcaaatactttaattacttcttaggcttcagaagggatggcttgctagtctttgtactttgggctttctgttacgactggttgacttagatttatttgtttatttagcttcttaatttcatatcctgtggtcctgaagaggacaatcaccaggatttaggggagtgtttttgtctttattcactttggaaaaatgtaaagattagtcctaagcagggttgattcaccgcactacagagggacacgttaggaacgagacagcttattcaagtgcttttgaatttgtattggttttttaaaatgtaagattatttttacttattttaaatctttcaaagcacttttttcctcagggccaagtggactctttgggaggagacctcgccgtctccatttgatcacataattgcttctgatgccagccagtctgcaactgccagtgattggcacagggttatttcatgtgcacttcaatcaaatttcttttcttgcctttttttttttttttttttttttttaagaaaaaatctcactgtggcacccaggctggagtgcagtggtgcaatcatatctcactgcaaccttcaattcctgggcctgtgatcttcccacctcaactcccaagtagctgggaccacaggtgtgtgccaccacctctggctaatttttatttttgttgagacagggtcttactatgttgtctaggctggccttgaactcctggcctcaagtgaacctcctgccttggcctcccaaaatgccgggattacaggtgtgagccatccatacctggcctccaaatttcactacctaacttgggagaggaattttgcattagcagttacatggttcatctgcctcaaacatttgttttgactctagcttttgcttgtttcacttttttaagcttggaaagaacaaacttagaatagtgtaggccttggcttccacatggatgttttgacaaaatttcaaggaagcaactggctttgtagtgctttctttgtcctgcttctccaaattccccaagtgcatgggtaatcacctctggttccctcggagtgttcgtggccagctccttcccagccttgccagcccattgtctgcatttggcatctgcgctggagtcactgtgtgctccagttccttaaggatacttttagtttatctgatctgtgctccacacctcttcagactccatttccatgaatgttttgggagaggtgaggaagaaaccttttctgctcattgttgcgcgttccccaccccaggccccgtctgatctattcttacatcacaactaaaaatattcttaaaaatgtgaatcagatggtatgactcccctgctcagaaccctccagtgccttccctctgtacttggaaccaagtccaaactcctgatgagcagcagggctccgcatggcctggcctttcatctgttgcttcccaaacgtgtggcctctggttggtttctggaactcaccatgcctttccccacacatgctggttcttctgccagggacactcttcactctcccttcatgtgcttagccccttcttagcttgcaggtctcagctaaatggtacctcctcaaaagggccttccctccacctataccaggtataatgctgtttgcctccttcagaatgcctctcacaggctgtgattactttaaacagattcgttgagatatagttcagatgccatgcaattaacccttttaatgtatacaattcagtgggtttgagtatattttcagagttgtgcatctattgccagagtcaattttagaacatttcattacctcaaaaagaaccaccatacttcttagctgtcgtaccccttcccctatttccaccagccaaaggcaaccagaaatctactttctttctctctagatttgcctattctggacattgtgtataagtggaatcatttatatgaaatggagccagtcctttgtgactggcttctgtcacttagcgtaatgttttcagagttcatttgtttgtggcatatgtcatacttcattctttttcatggctgaataatattccattgtatggatataccacattgtgtttattcattcatcagttgctggacattagattgtttccagtttttggctattacaaattatgctgctatcaatatttgtgtacacatttttgtgtgggctcatgtttttatttctcttgggtacatacctaagagtgggattgctgggttacatggtaacttatatttcactgttaagaaactgccaggctgcttttcaaagccactatactattttacattcccatcagtagtatgtaatggttccagtttgtccacatctagtccagcatttgttattgtttgtctttttgattgtagccattctaatgagtaggaagtagcatctctttgtggttttgatttagatttccctgaaggttaatgatgttgagcatcttttcatgtgattattggccatctgtatgtattttttggaaaaactattcagatcctttacccatttgatagttaggttacttatctttttattattgagctgcaagactttttaaaaatgtatcctaaagttcctattagacatatgatttaaaatattctcatcctgtggattttttcactttcttaatggtgtcctttgaaacacatgagttttaaattttgatgatatccagattatccagttttttttgctacttttgtaattattattattatttttattattattatttgaggcagagtctcgatgtgtcacccaggatgaaatgcagtagtgcgatctcggctcactgcaatctccgcctgctgggttcaattgatccttccacctcagcctcccaagtagctggggctacagatgtgtgctactacaactgggctaatttttgtgtttttagtagagacagggttttgttatgttggccaggctggtcacaaactcctggccccaagtgatccacctgccttggcctcccaaggtgctgggattacaggcatgagacactgtgccctgccagttatttttcatttccttttgaattttttgtttttgccatctccccgtgtaggctgcatgtgctgcgacggcagcgctgtgtttgccattgtagccccatcccctagaacagggcgtgatatagggcagcggtcagtgaatagctcttcagtgagttagtaaacaaagtggttctcaaaatgtaaaattcttccttgactcactaagcaaccttctgattgcaactgctttccctttttggcctccaagacaggaattctctggccctgctgacaggagccccatgttgcacagggcaactatgtcactcattggaaattaacatgtctgccctctgacttcagtatttctcccaggagcagaggatggaagttcttcacagctggatctgctgtatcattcagaagctggcttcagagcctgtgtagctggaagcctcgggctcacatcaaggaagggaatgccactcagcctctgggcacacagctgcaacttcccctggtgctgtctctcttggtgctaccctatactagccttgtcctgaaacatctaccccattcatttcaccctctctgctactatgtcactgcctctcccatcacagtattccacccaaatgaggcaaattcttatcctttcaagacctaccctagagtcaccttttttgatatatttgcttttttatttactccaccaggcaaagagggtggcaccctgctatgagctcttggaacaatttatttataagttccttatagcctggatcgtattcaaccaatagtttttccccctctattaaaatgcgttaatttggagtctttgcttactaaatgctgtctcctttttttttgagacagagtttcgctcttgttgcccagcctagagtgcaatggtgcaaactcggcttactgcaacctctgcctcctgggtccaagcgattctcctgcctcagcctcccaagtagctgggattacaggcatctgcccaccacgcccagctaattttttgtatttttattagagacggagtttcaccatgttggccaggctggtctcaaacgcctgacctcaggtgatccacccacctcagcctcccaaattgctgggattacagtcgtgagccactgagcccggtcaaaatcccttcttacctgtcatttgtattctccccattctgtgtctgacatcttgtaggtgtttgttagatgattggtgagtgaattaatgaatgtacagatggatgatgtataagtcctttcagagggaaactttgagtatgttaagaccccaggaaggcttatacttgatctttgtatccagaatgttgccaacattctggatacaaagaaaagcaccctctctgtgacttctcagatcccatctgcctctgatctttcatgacccctgctggattgactacatgagcctctttcagaagtttgactagcaaatcaacaaaacagttcaccctctgcatctctgctcagggatcaacaggagtgcttgcttatgtggcttcattccagtgggaggttcatattttcttagttatgtatcatgtagtcttccttgattcaagagtaccatgacttgtgtttgttctgactccaggactatccatgagtaaccctcagccaagagtgtatcatcagggcctgagcaagtggcaggagacaaggtatagtgtgaatctagtacatggaagagaatgtcttgacagctggggtctgtaattcatatgctgttcaaatgacaggccttttccccacacctgtgtgtattcaaagcaccatgtcatgttctgtagggagataggcaggggagttgggtcaggagaaggaagttaagattgaaggagaacatgcagaggagctttgggaaggaatgtgcccggctcacatcctggctccatcatttaccaactgggaaaccctgggcaagtgatataacttcacattccagtttcctcctcataaaaatggaaataaagagaaggtgtacatagagtttttagataatggatttaaaacactacctggcacacagtaaaccattactaagtagaggctatgtactccatcctacacgcatcagcagtggcagtccagcaatactcctataaggcacatgttatgacttcattttactggtaaggaactggaggcttagagaaaggatggttaatttgcctgacaacacattgctggtatatatctgagccaataatcaaaattgggacactaatgccaaaggttttacaatttctatgctgcaggctcaggtgtttttcttcatgggtaggaactttatggctcaagcccgaaggattcccctctgggaatacgactgttctggtaaggttcaagctgactcatcattgagtgctgctaataaagtgtttgctgagaatgttttctgttaactcattgagccaggttattaagaacctgtgctcacctctgacacctcagttgattggggaatttgggatgaagtgcttccaaaatttatttgaattctaaattaactaagtgagttaacgtggaagccgcttttaccagcccacaagggtcacgcttgttgtgtctggaagaaggaaagggtcttagaggaacacaaattgccagactgacagtcagatatggagacaccagggtcatcttcagtttaacaaacacatgtcagaactagaaagttggaagtgagacttcaaactctacctagcattgagcataagcaggtcactgaccacaaagatattctgttcccaaagagcaccatattcgtggtcaagtaaggccagagtctagactgacatcaaatgcttgtatgattgggaggaaggagcccgaaggccaaagaggctcactaatttcattattcgattcttccaaccactgcacgttacaaacagggctgtagcctgggtctactggccaagcttccggggctgggacaggcaaggtatgtctggatgagagaaggtctttgccaagacaagcatctcttgtgccaggcagaccagcaaatgagctgcttcttgcagccccttctttggcatctcccataagccaaggcctattcatttaataaatgcagactcaggagctactaagtgccaggctcggtgccagacactgagaatacggaaatgagtacgcataaatcaagtgtgcttttcatcactgtgtttttaaaaatgttaactgatgatttcctgatcctgagagtaatgtgcagatgctccttgaactatgttggggttatgtcctgataaacccatagttagttgaaaatatcataagttgaaaatgcatttaatacactcagcctacgaaacatcatagcttagcctagcctacttaaacatgcttagaacagttccattaacctacagttgggcagaatcatctggcaacacagccctccatagagtatcgattgtttaccctggtgatgatgtggctgacgaggtgctacagctcgctgcgctggccagcatcttgagagtattgtacagctttctaccactttccactgaatacctattgtttttacaccatcagaaagttgaaaaatcttaagtagaaccatcataagtcagggactatctgtatggtagtagaaatttttaattgaatcttctgtaatcttcagcaagaaaccctgagaatattgaacgtctttgccagacaaggaaaagtgggactggggaaaaggccagttatgtgaatcctcttaaaatagggtctaaaattttataataaaaatgtattttaaaagttttgattgagactttgcctgaaatgtgaaactgaaaattacgaaattaggtttattttatcctgcatttattcagtggcactcaaaacattgtaattataattgtcaaagatatcttagaccaaaggcaaaagattatttgctttattagagtctttaaaataacagtgccctaacttctgaaacaaaagaaggaattgagtgctggataggcagcttttgaatgtgaattttcctactatttcataagataacatcctttgcttcatattttgtctggttttcggtacaatcacaaaaggatcattttaacaatggtcacttttttctaagggcttctcttgatcttttttatttaaatctttgtcttctgaagcatcttaaagtagtatccaggagaattttgactccttcaacagttaactgatctaactctgccagatccagatttatcagtggttttgcagtggttttatccatttttcaacatcactttcattgatttcatgaaagtctgcatcttttagagcaagatttctgcttcactctgtatttgatttgcattgtattgtagtcagataatcagatgtctgcactagcagtcagggacattagatagacagtttgctcactggtccgcgttcccagtcagctaagagtctcataaccatcagccttgataaatgctaatgttaagttctctaagttaaagccagtgtaggcaatgattggaacttggaagcaatcagagcacagaagaagcctggtccctggaatctctcccatatgcatcctggtggataccaagtgcctggcagaagtcataggcaactcccaaccagagcgctctccactgacatgttgcttagagctggggacagcttagattagccatatctccccaaaatttgtatttttaattgaattgattttttaaattgaatccattttaaacatgggattttatttttatttaaagaattaccttgtgggtatgtctgtgactcttgggtgcctgcctggctgccaagaagacatgtggctccatgatgactctgctttttaaggttatgccctgggcatgatctgaaaccaggagaacaaagtgggtactggtgttgccttgaatgaagtgctcccctaatgggggaagccttgcaacctttataaactgcagtcaggactgttttctcttccttagtatggatttaaacaagaatcataaacacgtgagctttctcctcatcctccttttgttgcctctccccacctgggagcaaatgcctaggactttccaagtggttctcggtgccagcagcctcataagggaagagtattatctgagttcaggttcatcagaagcagcacccgagatggactctcatgaaggggatttattggggcaagaggagcgaagggagcagaatgaggaggggaagaaaccaaacaggcatgtgggctcagctggagtctgcttcacccagtcctatgggagctctggaacattaattgtacaacagagttggtcttgtcttgaggcaaaggggacatccttgggtacccacatcaatcagaggctacggaatgcttttggggaaggtgtcataacctcccaggcaaagcgactccattcaagctgttgtacttatctagtaaggggttctgagtggagcaccaccagcatccacacaaggagtggtactgcttgccaaagcccatgctctgatacacctctgggcctccttggaaatcacagtagtagaagagaggggtatagaattaaaaacatttggtcagggcagttgacatggccagtataaacagctatgttggtgctgacaggcagcagaagggtaatccatgacatcccttcctgtaacaccatcccggagcacatgagtcatgaaccataagctcagctctcttgttcctagagatgatgtctttggtttactcttttggcctgtcctcaccaagatccaaccagaattttgaaatttttatttgactgagtaaggtggaagagagaccagaaatagttaaataaatgctgatataaatgttacgttctagcatttgggaattaacaaaaataaggtagctgagcagcttttgaatgatcaaaagtactgttgtcttaggtcaaagctaattaaactgaggtttcctcgagttccagagtacatttttgaagacatttatttcacacatgcaaaaactgaagaagtctttggggcaataaatctttttgatttcttttttttttttttttttttttgagacagagtcttgctctgtcaccaggctggagtgcagtggtgcgatctcggctcactgcaacctccacctcccaggttcaagtgattctcctgccgcagccttctgagtagctgggactacaggcatgcaccaccacacccagctaatttttatatttgtagtagaaacagggtttcaccatgttggccaggatggtctcaatttcttgacctcgtgaaccgcctgcctcggcctcccagagtgctgggattacaggcatgagccacagcgcccagccaataaatctttacttcaagaacagacctttgacttaaaattaaagcttctctcctggtttgaaaggaattcccagtgaggtattgggcattacaagagaaactggaaacagagttaggtaagcatgtaatatatgtatatgtgtatgtgtgagatacacacacacacatacacttatatatatttgcttatcctgggacactcttgagactaattataccagaatgacagaaatgaaccaggaccgtccccaggaaaccaagagaactaaagtcatccaagactttggcttgctgcctctgatgtccacaggccaattagccaggatttagggtagtgtctacttgggacagttgtgggtgttgcttctggcaggaggaatatgaggaagaagatggtagggaaaggccatctatggtgaatcattaatgccatgcagttcttgagacagcatttgagaaattattctctggttttccttattgaaattgccaatgcctgttctctaggttctaagagcagccctcacacttgccatcacacagctatgtaaacacctatgtctctgctgggaggtccccacctcttctgaactctgagctctacgaggacagcgattaacatctctcagatatgttctctcagtgctgaaatgtggtgtgtgatacgacaactcagctacccagtgcatgctcagggcgcgttctgaatcctgtgccatttgcatgttacatacatgagcttgccatccatgagtgtttggggacaagacagaggaagaaaaccttgggggaagggctaaggaaaggtgctccttgacagtgaggacaacttaaacagaggtgtgaacataagagcaggcagggtgtgtgtagaatagtagcatatacgtgccacggggcaggggtggaagaaccacaacagaacaggatgggccaaaatggaagctgggatcttaagatttgagactttattctgtttgcagtggggacagacatattttaagaagcttcctctggcagccagccaaatggactgaaggggaaggaaagctcatagcagcagctaccaaacatcattatccggcagaatcactaattttatcactcaataattttatgtattaaaaatgctcatcccagaccctgcagtctctgtgtctactcagaaaagactcatgctgtgcaattagagtgtggcccaggaatctgcattttatttatttatttattttttagacggagtctcgcactctcgcccaggctggagtgcagtggcaccatctctgctcactgcaagctccgcctcccgggttcacgccattctcctgcctcaaccttaaagaggctcccaaggtgatactaacgctggcgatcctgggtctctgtgtgaataacactggctaagagcacagagagatgttagaaaactaatcatcattgagatcagttatatccgagactggatgctgaaaagatatattagagtttagttttatatttatatatctcttatcttttgtttaattgtatttgggcttttaggggttttgtttcattgctattttctaagtaagagtgtattgatgtttaacaaacaaacaaaaatatacaagttattaagttcccagctcaatgaactttcacaaaatgatcaaacctgtgtaacctgcactcagaactgccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatgtttttcatccacctgtctagatgccttgaaatgttagtctgagctgagatgtgagtcctggaaattggaggacctctgtaccttctcttccaaaatctgtaaacatactgtttccgcttggcagtcttgatttgctttcagtgactctgagaagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctacacttggaaacctctcctcacccttgtaccctccccacaccctggggagacttgctggtggacagcccagccctcactgcttcaggctttaggaagaaaccctctcttttcttggtgtgattttcttagagtttgtctttcctgaaccaccaagatctgaaaaggcaggattagggtgtgggcttaggagaaaggggccaagaagatgacagggttgccttttcatccaaaccttaggaggtctccagctcagccatggcccagcccacctcaccaggactgccctagggtttgaacccaaagcattagttaggaatgaagagtggttttgtcctcttacctgtcttcccagggaacccatgaaaaagtgggcagctggaagggggctggagacggcctggtcagggcatctcgtcccactggtgcctaccgtctgagcactgctctgaaggactcgattgccccgtggagcctgctcccacacacctgccttttgtgcagccggcccatctgttggtgctttttctttcaggaggagatgggcatctcctgtgagctgctggaatcggacttcctcaaatgcagcgtgggatttcctttcatgaggtcaaagtcaaaggtaagggacacagacgggacccttcctcagcagcaggcccccagcccttccaccagccactgattccgccgcctccctgaggtgaggagtcctcccaccccctgcctcccatagcagctggggcggccactgaagccctgacatgctcctgtccctggctgtgtacaccggggtatactccggaggggctgcatcatatggtctttctcttcgattcacatgatgtaccccaaatgtgaaagtgaaggacacaccacagcctctgcactttagcacgtgccatttagttgaccttcctaaaataattttttttctgagacattctgtgcctctttgagtcccctagacaacacagaagaagatgtggtctgtcacctatagtcctgtcattcccttgggtgctcacagttttctgaagagaactctcaaaattctcaaaacataaatacctgtatcccacttcatttttaagaagagtaaagaaattaagtcactttggtattggtatggagacagattttctaagttcaaatagtatactacagcatcttcagacattcatggaacattgtagtatgtgccatcattataaggagatacaaacataggtaaaaagatgtggtgattggaggcaaaactagaatctaaaagaccaagtctgcctttggaaatggaagctattttccctgccatgaacagagtgagactccgtctcacaaaaaaaaaaaaaaaaaaaaaaaaaaaagtgaaagcttcatccttttctcctgcctgggtcatacactcagatcattttaatctccaaggctctttggtcccagtatctagtagctatttgtaaaccaatggtgagaatattctggtgagggagaagacttggtcatttcttagcaaatcacttgaacccataagccccattgaatgcacctcgatcttggactttccagccttcagaactgtgagaaataaatgtttaaaccacccaagctagggtaatttgtgatagaatcccaaactgactagggcaaaaaggtaataactttctcactgttagggtcaatgttgttcagtgctgtgttcacatatcacccaagataatctcatgaaccacctaaaataatcttagtgtaccactcccagtgtgaacatactgtgatttgggtaacactgccccaaacaaatggtgttcaccatatacatatcaggcacgtgtgggaatgtgggaggaacccctgggtaggggttataggaccaggctctaccacaaactgtgtgatcttggcgaaaccacagtggccaagtggccaagtggcccatgactcctcggatttttttctgcctctcttcctcattctgtccacattcaccccaggaggagggaaacctcaataagtgtctgcccttggaaaatggattacatgtggatggcagagtacaggccaagtcccattagactccaggtagggtgagggtggagataaaggaggacgaccacaatccatggacactattgcctatagtaatgtatgtggcacatctgcacacaaatttaattaaaatcttttgagtaacagataataggcttaactggaaaacttgcaacagtttccatttcattttaaactccagcctatatcacatatcagacctaagatgtgtctttctctctctagtggagtgttacattttgtcaaatttttgtttgtttgagagggagtctctctctgtcgcccaggctggagtgcagtggcgcaatcttggctcactgcaacctccgcctcccaggttcaagggattctcctgcctcagcctccctggtagctgggattacaggtgcccaccaccatgcccagctaattttttgtgtgtttttagtagagacaggtttcactgtgttggccaggctggtcttgaactcctgacctcaagtgatctgcccacctaggtctcccaaagtgctgggattacaggcgtgagccaccgtgcccagccaacatttattagatagagcccacagaagtatgaacattggaatgttggttgttttcccagctggtaatgctaccactttcctcccacatacagatgctgggacctgaagcaagactgactaaacctggggattggggggcatgggagcagagggtgattccctggagaaagcccaacaagtcacccagcagagacggggctccccgtatccgcagcccagcgtgcactcccatgtccttccaaccctgagggtcctcaggctccaggccacatgctaagcctcatggctatactttggcttaccttggatggccatgtatttctctctctcacagcctgcccagtttctgacattctgttcttccaggcctccatccctgattttggcttctcacccaattcttttgcctgtcatctcactgtgctctttaatgtttttaatttaattcagatctcctcccagtgctgactctacaccagtcaagaccctgcctctctcttccttcttgtcctcttcccgccctgtctccatgcctgccccccaccccacagtaagctgaccagtcccacagcaacagaaatttctgtctagaaagagatgtccatgttcactgtagatgatggtccattgtaatggaccaatgtccgttgctttcaggaaacattcagtagaattcagtgttgcaaatattagaccattgcctagaattcaccataatggaacccaaaggtttagacattgtataagttataggctctcaaaatttgatgaaatttaagaaccgttttgtccaacctcctttttttattgaaatgcaaagacagtatcttagccaagatcacagtcagtttgtggtggaacctggtcctgtgacccctacccaagggttcctcccacattctcacacatgcctgacatgtatatggtgaacaccatttacttagggcagtgccccctactcacaggatgttcaccactaagtggtacactagataattttagatggttcatgaaattatcgtgggtgatacgtggacgcagcactgaacaacattgaccctaacagtgacccttttcaccttagtcagttcagtcatctataacaaattaccctgggctgggtggtttaaacaacagacatgtatttctcacagttcttaaggctgagaagttcaaggtcatggtcccggcagattcagttcctggcgagagttctcttcctggttcataaacagaaccttctctatgtgtgcccatctggctttcccttggtgtgtgtgcatggagagagagagatctctttgtcttctcttcttctgagtgcactaattccatcatgaaggcctcaccctcatctaaacctaagtaccttccaaagaccccatctccacataccatcacataggggggttaggccttccacatattaatttgaggagtggcggggggacacaaacattcagcgcataagacttttcaatagtcttccaatcctagccacactcaggagaacgtctccaatcctgctagcacatctttaacacttctctatcaccagcaaatctcccttttcaacaaagatggagtagaccttaggctcagaggcttccaaaggcaacagagttcagcattgctctgttttcattgtgttcatttttacaactaccttctctttttggcaagtgatcctggattcccatctatgacagtgatataaattgttcttttaaaacaatctttaaactaaaagagtaaggcaacaaaaatatgaacaaatatcccaggtgatgtaatttgcagatgtggcagaaattgaaaagatggtatgtgagtgaaacttagaaagtcccggttaaagagtgtaaacgcatcacttcctaaggagagcctcggtggcggaacaggagcagcaggtctctggccagagtatgtgtcaggcttggttttactgttaaagctgtgactttggcctgacagtcagaaagctatacataaaactaaagcttatcatgcaaatgagcttccagaggtcataaactgcagaagatggaagagaacagtttaagtttggaatgcctgctgatgccaaataccacttcctttttcactagtatgaattcagcgtgatctttgatacaagccacctgtctggggaagaggaagttctcagcttcattgttactgctcagaggtaaggggggggtttaaacacttttttcaaagatgagagatttatgggaccaggaaaggatgtgtcctggttaagctttgatgaatcccaggatgctgaggaggaagaaatggttactcagtgataaagccttgagccgcaaagtggaattggatttcttggggatggtggttgcctagtgctgcttgcatagccgccactgcagattgaactgagaggaactgggcatcagccactcagaggtgatgattctacagctgaggagagacaggcccaggggggtgaggctctagtccaaggtcagttcccacttggctgtgtatttcccagatcagacagatgtcctctgcaaattgtctggctgggcccactgctgcttttggacatggtgctgtatcccttgatggagtgggcaggtcacctgcagcctgagggcctggctgagcctgttggcagaggccccaagagatgctactcaagagagggcttaatttggaagccaagtggatggataggaaaggggatcgtggggtggcagcttctcccctcagtagcatgtgcccgcccctctccaggatagccatgagtgcctgtgggggcttctggggagttacaagatgccttctccagggcagatccagcatgccttgaagcagcatctaggtagcacttggctggcagctccagtggagggaggggcgttcaggtgggtgaacagggagacacaagctttgattggggtggtggttggacacccaaggcaaccttttcattttcacttggaaatgatcttaaacttaacagaagtcttacaagaatagtgcaaggaactcctatataccctttacccagattcacccagtgttaacattttgcctcatctattttatcatcctctttctatataattttttttgttaaccatgtgaaagttgcagaaatcatgcctcttgattcataaatacttcagtgtgcattcccaagaatgaggctgttctcttaataaactgtagtatagttatcacattcaggaaattgaacattgacactatgctattagctaatccgcagtttatgttctgattatgccagttatcccaataatgtctttttagccgcttctttttactggtccacaagacttggttattttctattgacactattttcaagatcacataatttacatcacataaaacatgactgtgatctaatagaagcctatgcaaagcatagatagggtagacttcattcccattgcacaaaatccagaagggcttcagtggggaggtagcatttaaacagaggagtctgttttcaggctgaagcaacatgggcacggcagtgaggctgtccatggggcaagaagccctgttacacctgtgtaggtggtgggcacgagagtgtactggggattcgtgcaccttctcagaagaaggatggggagcacacaagcacagtgggaatggggctgaaagaggagcctgggcgctaaaccatgggggacaaaggtcacctagaaaatctgaactatatcctgatggcactgaggagccactgaaagtttttgaaaaggggagtggcacagtgcaacagcttggccccagagcatgaggttgatgaatttgataaggggcggcagatgcccattcaaacctgaaaattctcattctcttgccatttcttggatccacagaacactcgccattgttgggcagacccatcaatgtgctctcttggtccttccacacctgaggcagcctgtatgcctgggaaggaatgtgacatggaagagatttcccttgtcaaaatagaagacacttcctgcctccacctaattcagggctaatcataacagtcagagagggcagggaaccagtattgcaattgtgaaaggttcatttgttagaataacatgtccacacagcagcagtgctctggttttggatgcatattagaatcgcctggggagctttcaaaaatatcgatgcctgatctatccccagagaccctgaccctgcctctgcctggggtgagacctgggcaatggagttttcagaagggctcaccaaatgattctaatgagcagccaaggctaagaaccactatttataatcccttactctgtgctgggcacattttcactcagtaaatatttattgtgcaccttatatttaccagttgcagtgctaaatgctgggcacatgagaaaatgacagtaacctactaaattcaagaacaccccctatgtacattaacagtgctgcatagcttcaggaagccctaggatctgtagcttcaataatataaaaatttctagtttcttaaatcacaaatgttaagatgaccatattatcttctaagcacacaccagaatatttcagatgctcatttcttttcaggcattggtgaagatatggtctgactgccccggagggcacccacacacagcgcttgactccctgctatgacggaaagatccttaaagctccttatcttgaaaactacagttaaaatctcaattgttcctttcttccatcaccaccctttgaaggtctctttgcctacttgtagatttagggggacataacattgagactgagcagtttcttgaacctctcctctcagcagccaccagcctggcttttgcagaccactggaaagtatcccagctcattagcttttggaatgacgggaagccttttgatgtttgacgtctttatctcaactcttcaacttagctcattctggagcagtcacacgatgacagatgagacggttgggcctaagccggccaaacaaacggcagggcaagacctggcaggatgctggggtgggggcgggagtgggccaggatggtgttaacccatccacaggggagtcgcctttggcctgcccacagcagtgatcccaaggcttttgtcaccccttgggaaaggaaggacaaggaagtcaggctgtgtgggcacctgatcctgctgcttttgcaaactgtggatgcccctgagggactgatgtcaccccatgtaggaagacagatgaggagccagggcagagactgtggccctatggggtcagcgtcacacagcaccattgtttcagaacaataggagggagaaggagaggggatgtgagagctatttaagtgctgttgccattcagcacttgctggttgagagaggaaggcagtggggcagggcttggagggggcagagagagggcacagagcagacagggactcagcagatgttcagggaacggcgtggtggggaacagtcaggatgagctgagccagcctcagcaggtctaggggactcttttcttccgcccatgcagggtgaacttgggaaccaactgtgaatgtaggttcaagaacatgtacccaagagccacgcattttcccaaggaataatgatcacaattcctattagaaatttaataaagtaataaagggaaactaggtcttctctctcttcctcctgttccttctcctcccttcttcttttgctcctcttccttctcgctcccaaatctggcatcaggagcaggagtcacagctgagagagccctagtttgaagtctgactgagctggttggaatctcagctctggtttgcaggggggccttgggcagttacctgatttatctgacttgctccttacctgtcaaaggtgggtgctccatctccctctggggttgctctgaggtctcagtgaggccatgctgagaaatgcccggcatagtgcctggcacatagtagccacttaacagcatcaattccctcatgttcacctttccagaatgatctcacaagaatccccgttctgtgctttctcacccggaggccttatgtggatgtattttagaatcacctggggagctttcaaaaatatcgatgcctgatctacccccatagacttgctatagccagggtctatagcgagagcttccatgatgtttatagtggtaggtttggtcagggcctctttcctgggcttggctgtccatggatgatgggtggtcctttcaggtgagacatagctgctgaagtctagcaactccttcctggctgcaataccctaacttcattggtccattgttcgtggaacaggcacttacacaagtagcacacacagtaggtgccctgcccataacccctcagccctcacccttcccaatctatccgcaaactgggcagattccggctcccagcaccagccaccctgctgaggctttctctggccagagcccactcacttgcctgacaggcaggtgccagggggttcattccaccccacccccacccccagcagcagcaacagcagctctcaggagtcagtggataaaggcctggctcccatgccctcagctaggaagactgactctgcctcacagagtccccgcgagactgggccctggctgccgacagcacgaccctcctgtatggcatgcctttattgtctcctttcctttgctctctcccttctccactctccagtcctactggcatttcctggggccacctctcgaataaactacttacactcaaatctttgtgtggaacacaaccaagacaatagagtgcccttgatagatatgtacagggaccaaaaacagactgaaggcaatgaggtgccatctgcccttggagaatgtagagattcaactctaaagtggaacagagaaagcccactgctggacagctagtgttggccagcgttcattcattctcctctctctgcacagtggcaacacggagcgctctgaatccctgcatgacaacaccctcgtgctgatggtgccactgatgcacgaggtggacacgtccatcaccgggtgagtagcctggtcctgggttgccacaacacaggagtgccctccagtggaacactgtgcttctcatatttgcatgtgtagccagccaggagccaagggctgtgccacctccacttcctcccagccttgaaaagcaggatgaagctttagctgcagtaactcatacactcctccctccttgttttctcctctgtcccacctacccacccacctggtagataatctgagaagtttgatgacaagtttaagccccataatttctttgaacattccatatacctttatgtgcatatattctcatccgcccctagtccctccagaatgctgtatggtaacaagcagcatggctcctgggattaaaatctcagctggaagttgctgggccagagattatcaccagatgtgtctccagtcctggctcacaggaggaccactttctgattagctccacaggcagtgctggctttgcttgtttctgttaactccctctgcagagccagaggtggcttttcctgatgtctataatggtctggaatgggcagggaaccatcccatcggccacactgtctgtctgggtcaagtccacggtcattcagtgccgctggcattgttggaaagcaggaccctgggctgcagtctgtggagacctgaaacaacctgtgtcagttttcaaccaaagccccagcttggaaaaatgagaactccatttctttccagcttcagaaaacagagtgcatacctctttgatagtggaaaaaagatttacacaattagtttagatcaggtgaggacccactgaacccttgacccaaatgcaagctgaactttctggaggttcacagtttctaatttttcggttttcaagtgcttctgggtctcagccttgattagcagtagaaatgttgatcccttgcagggagagccatccctgcactagcccgcactgctgggagccagtggaatgagtctccaagcattcctgctcctgagcttttggcatttttggtcatgttttttaaacatgaggtactgatggaatatatttgcaaattagcatatttttgcctctgttcacagctctatttttaactgtatcatttatttacttgtctcatcaaaggcacagcaagaatatacccagaaccaagccctatccttggggacaaagagaaaacattctccccaccacccccagacacttgatcatgtaatcagtccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatcttccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgataaatttaagttttttaagtgaatttgtcatagagtggggtttaggatgccaaatacataactcatttatatttattttttaaaagcttatgatcatcttcttcaacccataaaacatttttcgaatgacaaaacagaaaatgtatacttttataatccagtttttaaaaagtcaaagctatgataatcttgtcatttcagaaaggtaatcccagtgcatatttctccatgcagcttattgacgtaacctaagatgagaagacactactattcatgcctggtcagaaagcacagactggctatgtaacagccccagcagggaagcactgggtgcaagacactggattaaattgagacaaatgtttgcttctcagaatggcagtgaccatgggtgcttgactgtgggtggggatgacagatttcatgctttcctctttcagaatcatgtctccaacctcctttgtatatggcgagtccgtggacgcagccaacttcattcagctggatgacctggagtgtcactttcagcccatcaatatcacccttcaggtacccactcctggagacctcctctgtccgtgggggctaacggaagggcacatgggatgtctctcctacagagggctaagctcttgtcaggagaaacccttctgtggttggctggtgtggtgtgtgtgtgagatctgtaaccacacacagaatgaatccttttcgatgcctggtactctgctgtgcaggcccctctgctttttcaggatttggaaggacaggtccacgtcatgaatgccagttttccccaagaagccctctgtgtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagcccctgtgagcccccacgggaggcacgctgctccctcactgagccatggctggcttgcccaggcacacaggcatcatttccagcaagtccacttggtgtagactgtggacctcatgaaggacactgtttcttctcttagttgggggtcagcaaactttttctgaaaagagccatggggtaatttaggctttgtgggccatttggcctctgcagcatctattcaaccatacttctgtagttcaaaggcagccatagataacacagaaacaaaattttagttccttatagacaatgaaatttgaatttcgtataattttcacatcatgaaatgtaggcccaagcgagaaaggatatcctgaaggtcccagagctgggagaagccgggctggggccaagacctggcggcactggccggaccctgtgtggatgaagtgaaggagatgggcccaactcacccataggacacaacagtccatatctcctcactctctggttctacctcccagaactcttctctgcctcttgcgtccttccccatggagagatggtttcccactctggcattcactgctgtggctaaataataattattttctttccttgtggcctctcctaggtggacttaggggatgacaaataatgacagggtgagggtctagagaatgtggcagtaaaacatttgtgggctctgacaaacaatggtcttcctctccccagagtattctcccagcaacagactgcgaaaccatgatacataacacatgtccccagctcacagaggatgtgccttctgaccaactaagcccctgctgtcacaccctgctcttgatttacaggggagaaagggaaggatggggttagagcttgtttttgagacagtagagtgattgctgtgaacagcacctctgcatttctgaattgcttctcagagttattttatttttctcctttgcttttcgtaattgggtaggaaatagataaagacctgatgggtttatttcatcttagttgtttctactctttcctactcttatagttttgggggtgtcttgcaattaaagatgtagttcagaaaattatttagaagggttcaagtaacacagaccatgtaatgaagagggtatgagtgttgaaagaaggaaaagaagaacaggggttgcacagaatataccaaatgttcttatcaccctctggggaacaaaagaaagaaatctgagggtatgcagcttatccttccagttgtttctctgaaggtaatttttacagtgagtttaaagtttggtattcaggcaaatagttttcttcacatctgacctgaaataggactcaggctagagaatccagccctggggaatgagtgattggcatgtcccttagataaactcctccgtgatccattgcctcaggaagtgcacagcattcaatccagggttgagagagttgggtctgaaagattgatagtgtgtgccattgattagaaggagatccttctgtgctagcaaagcccactttttccttgagaattgtctgactacttatttattggtataatggttgttattgtggttgtcctgcaggaaggtcactaaccagcttggcagtgataatgaccagaaggtgaaaatactgtggaaggaggccaggaatacggagaaaatgtttctatatttccttattccagtaatattgttcctgaaggagaacataagactttccatatgaacagatttttctatgcttttaaaaatcggttattcaacaagctacataattgtttaaaggctccactgccattgtacacaggagaaaggcagaaatactagtcttgggcctgctttttacatttcatcatagtttttaaacagacacattaatttctcgacaataagaggcttttttggcatcaaaatttaaagcatttccccacctgaaaaacaatggccaaaaataatgcagatattacacatgaacatttgcagagaatccagtataaagacatttgttaaaaataaagatggtaatacaagctctcctgtcctcctggctctgatgagtgaaatagtgcaaatcagcatccttttcttcattgcttaccccattcatgcttgaaatgggatttcccagacatgccaggatgtttctttttaattctgtgcactcatgtttcacttcaaattagttatttcagctatggtcagatattccttccttttctatgtcttcaggttgtttggtgaatattgttcttttttgaatcaggagttggcaacccactcatctgctctatcagtttttatctatttattctttgaagtggaaccaactattgcagaaaaccaaagacacagttttctagggaagagctagctggagctagatcttcatacatcctgtcatgtgtgaagacctggtaagatttctggctttttgttggctctgcccttctgacctcaacttcagagttgcagattccctggattctctctctagtgcccaggccaccaagcagcatgtcattccttcctctctcctacttatcctttttaaacatttagttttaaattgacaaaacttatatattttatattttactcatctttttaaaaataacacctttattgagatatgattacataccttaaagttcacccatttaaagcatacaattcaattattttaatatgtttacacaattgtgaacctgtcatcatcatctagttgtagaatatttttaaatttttttcattttaatttttgtgagtacatggtaggtgtatatatttataggatacatgagatgttttgatacaggcatgcagtgcataataatcatgtaaaatgggggtatccatcccctcaagaaatcccttgtgtttcagacaatccaattatactcttttagttactttaaaatgtactattaaattattattgactatagtcaccctattgtgctatcaattgctaggtcttattctttcaatttttttaatccattaaccatccccaccaccccccgccacagccatccccccattatccttcccagcctctggttagcatccctctactctctgtctgcatgagttcaattgttttggttttgagttcaattgttttggttcaattttgtttgattttcacaaataagaacatgtgatgtttgtctttctatatctggcttatttctttccttttttttcttttttttttttgttttgttttgttttttgaggcagtgtctcactgtcactcaggctgctggagtgcagtggtgcagtctcagctcattgcagcctcaacctcctgggctcaagcaatcctcccacctcagcctcctgagtagctgggactagagttacacaccaccacgcctagctaattttttttgtggagagggggtcgggttttagatacggggtttcaccacgttgcccagctggtctcaaacatgcctgcctcccaaggcttattttacttagcataatgacctccagttccgtccttgttgttgcaaaattttggaacatttcaatcacccccaaaagaaatttcggccttttggccagaaccaccatcttccagtaattcgccaaaatgtcgaacacaaagggaaagaggaaaggcacctgatatatgttctctaggctttttagaaaacatggagttgtttttttggccacgtgtatgcaaatctataagaaaggtgacattatagacatcaagggaatgggtactgttcaaaaaggaaggccccgcaagtattaccatggctaaactgaaagagtctacggtgttacccagcatgctgttggcattgttataaacacacaagttaagggcaagattcttgccaagaaaattaatgtacgtattgagcacattaagcactctaagagccaagatagcttcctgaaacacgtgaaggaaaatgatcagaaaaagaaggaagctggcggcacagtagctcacgcctgtaatcctaacactttgggaggccgaggcaggcggatcacctgaggtcaggagtttgagaccaacctggccaacatggtgaaatcccgtctctactaaaatacaaaaattagccggggatggtggcagccacctgtaatcccagctactcaggaggctgaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaaccaatgggaaggagcctgagctgctggaacctgttccctatgaattcatggcataataggtgtctaaaaaatgaaagacctctggactgtttaaaaaaaaaaagaaaaaagaaaaatccttaacccattgacatagcttcttgtattaatttcttattgctgctgtaacaaattactacaacatttgtggcttaaaacaacacaaatttgttatcttacagttctgaagaacagaagtccaaaatgggcctcgctgggctaaaaccaaagtatcagggcctgtgttcttgccagaggcaccaggggaaaatccacttcttgcctttgccagcctctaagggctgcctgcattctttggctcatggcccccttccatcttcaaagccagcaatggctggtcaagtcttaggatgttctctttctgatctgacttctgcctcttccctatataaggactcttgtgagtacaatgtgctcacctggataattcaagataccctctttattttgaggtcgcttgattagcaaccttaattccccctggccacataacattcacaggttccacagatgaggacatggacatctttggggggcctgtcatgctgcctgtcctactccctattcttcctgctccccagccctaggcaaccgctaatctactttctgtctctagagatctactcactttttttattcctctgcatattctgtttcttcctcgagtttcatgttcagctttttcctctccctccttgctcttactggtctctgtgacctccatctttttcctcatttctcaggaaatgattgacttctgaagacagaaaatggagaaatgctagggaaaacaagagaggcaaagttttatagaaccaaatgctgagacagaagaggggtacagttgtgcaagtgatgagctgcagattgcctggaaaccaaatcagctggctcatgtagtaaaaacagccctttctgtatattcgatcgcttggttttgggatgacccacttggtccttgagggcctcagttacctcaaactggcaaaggaaagaggttggaccagatctgtgggtctcaagtggtggttcctggaccagcagcagcagcatctcctgggaccatgttataaatatgaatctgccagccccaccctagacctactgagtcagaaactcggcatgacccccactccatacccccccaccaaaatgtgttttaacaagcccctcagatggttctgatgttttgctgaaatttgagaaccactggactagattatgatgtctgagttctcaccaagtgtaatagtctatgagtaaattcctatacatgtaaaaagaaaagttttagcaggaagaagacaaaatgctgaaagagaatatggtaatttcaaagtttgagatttttagatgcatgttagaagtgtttctattttgttgaaatttcccgtcattcagtagttcactttacttcaagttgtgaccttccagatccgaaccttagagtttctgtatgtgatttcaaagaatcttagaatatatattgcatgacaggaaatggaggtctgctattttccactgagacttgctgtgtgtgttccacacccacaggtctacaacactggcccaagcacccttccagggtcatctgtcagcatctctttccctaatcgactctcatctggtggtgcagagatgtttcatgtccaggaaatggtggtgagttctccatttgttttcactattgctttcagctttgagccagcccattcaaattttgtattccaccctaccctgacatccaccttgagggtttggaaaattcaactcattctaccctttggagacatatctggagaggccaggggacctgtgatacctgaatttctacattgagaccatttggttaatgctgtaagaagacctctttggagatggggaagagttaattacgaaccagctcctgggatggacttcgctggctctgggaacccccagcagcatctgcagttgcatgcgtctgaatgcattttgctgagtgcattttgcacagggaaagtgcctgcagtccatgttgagaggattgtgaaagcattgctctctataggggcacgtgaaggacattcagccaaagggacagtttttccatagatagcttgaaaatcagggcagcaaggcccatatggagcaggtgaatatctgagccgagagttgaagaggacacagcccacagggtggaggttcagaaaacattgtgtgatggtgacagtaatttctggcattgctgccctctgggtcatgtggactgaaaaccagacgcatgtgaatgttgaatgtagaacaggtcactcctcccgagatgccagctcagatgttaacatccctcatgatgttccattccagttccatggcatccccttgtctttgggctctgctgacccagcagaagaaagccgccagtgttccgcacctatgatgtactatggttggaacttagcatgaggtgaacaaaccacacaggcttctggctaccctcttaaatattattaaccatgctgaccatgccacatttccccagcatctaggagtgttctcttcctagagcatgctttctgagttgttcacgtgaacatctacagtgttgcaggagcctttttttttcctatgggcaaaatcatctattgaccaaaacaagacatttaagtcactcagattctgaaggtaccccaaaaccagggataccccttttcctctttactgatcatcgagccaaggaaaagccactggaagggacttgggctcacacttacaaatagctggcttgcatggaaggcattagaagtggtttcctgaagacctggacaactgcctggctatcgttctggctgagtggaccctcagatacccaagtggtgtgagctggctgcactctgttctttgggctctgagaaacaaatcctttggattttcaaaactatatttagaattttcataaagtctgtaacagacttggccctaggatggccaagtctccatctggatagcccagcctgtgatcaaaggctgtgggcatcttcatcgtatggaaaagtaaattcactggcacatctcactaagcaagtaggaaagctctctgtgttcttataaacgatcaccactgagcccagaatgacaacaagagtagaagcataaaagcgagtgcatgaggtgctgtagtgaagaggcgagagtccccagatacttgtttcagaggcccacagctggcacaccctctgccttaaagccctcggcaagggcctcctgtggctccgcccctcccttgctcagcagggcctgagaatgctcactgggtcaggtgtgattcagagctcatgacggtttccactttggccttatgggactttgaatggagcagggctttcattctggggatttgggtggcttggtgcaagtgaaattcagtcctattaggagaaaccagcactcattctctgtactgcactaggaggtgaccctttggcctggtggcattccctccccacccccactctcagccaccaccattccccaacctccaaaggctactgaacagctgggcaccagctggacatgttaagccaactgaagcagaaacagattataggcatggagggaaggctcatctgtcattcctctccacacccttgggaccctcaaattgtttctccctctctaacagtgcccttggtgtctgtattgcctgtgatcatcatccatagagcataatgaggatgggcttactcgccctatgggccctgggctgtcaccctacctacggacccacgtgtggcacagttttctgacttggttcagaattcatttagaagtctctggggctgcttctggggtccctgggcaggaccaacctgcctctagctttcaccaaagagtcttttgtgtttgcccaaagcatttcttgaggtccagctgtctgtaagtggagagtgtctggcttatatatgggaggtttttacggggagcctaatgaagtgtaaccactccaaactcccagccttggctcgtgatcttctttccttgtagctaatgtctctgagcccctctgctgtgcttgtatttaccttaaaaacagagccacggtggtggcctgaggaaagactatcaattttcactgcttcccacccacgggggttgtgtggaccctactctgacttcccacagcacagaaaaaaaaggaaacaggtcactgtggacctagtgtctgtccatcaggaagccaggttgtaatgatcatgaaaataatagaggggaagaatgacagacctttctagtctatctgaaatagcaaaattaccagtaacaaatcattcttgatttgttcacaaacactggctcagcaagtacctattacgtgccaggctccaaggagaggaataagtcccacatctgccccagaactcactgtcttgcaggaaacagatacataaaatgccattgtaataccgtataacaaatgcaataatggaggcatgcccagaccccaggatgctacaaaggttcagtgcttcacaaaggaacctcttcaagtcagggcttagaggatgtctagttcaccaagagaacaggtgaagaagagaacattccagatagaggaacagtcaccacttgtgagtgtatgatgagtatctgctgtgctgggagctacacccggttctccattctgtttgcctagctcttatacaaataggcaagagtaagtgttccgtatgccttctgcagatgtacagcagatagatattttggcagaatgacagagagtactgaaccacagtcatttcctctgtcagtttgtaaattaatcactcttcttgggtacatcgtgtgtgtgctgtagacctgaaccttcctacctgctgacttaggcatggagaaggccaagctccctgtttgatactagagtctaactacatgtcatggacattgtcagcaaaccacccttggcctgctgcaatgagcagtagctactgacctccctagcttacttttttccttctattggacagtcattctaaaaaactcacctgatttccaggaataaaatgagtgagccagacagcttatgggaggcaggctgtgtccacttgctccttagagatttctttttgaagtgaagatagatcatcttctcaatttttcagaacagacctgaaaaattgaaccacttcactttattgccattcttctgcagaggcgagccgtgtagcatagcccctgagcacaggtctaagattgcaccaagataacacatctgtcacaagcttcatggcttatgaagggaagagggtagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcgtaccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatatatcaatgtctttgccatagggtaccattaggacattgacttcaatatggcatgaataccaacatctgttagaatattccaagttggtgccaggactcatattttagtaaactgtaaaatcttccctccccatgcttgtacagtagacagggctacccatgatgtacgatgggtatcccacaatgagtcagttgatgtgggaacttcaattaatttatagtgggactgctcacatccctatgaagaaaatatgcacctgatacatcactgaccataacaggagcttaaaattagacataaatggaggaatgaattgttttccccaaggatgacctggaggagcttcttaagttggggccatcaaatcagtcgatataatccaaagctaaagagtaaagaaattactcctgaataactgacccccccaaaaaaatgaataccatttattgctgtcccaaggctttaatagcctttttcatgtgctgtcaaatttaatccttatggcaccttcataaggtaagatcagcatcccaagttgaggaaccaagcttcaaggatttgcccaacctgacacagctgctaaaaagtagagctgggtttgtaaccaggtctgactccaaagttcacgtggttcccattgtgctgaattgcacactgctcctgaaagtgctgcccactccctaatcaccagaggcaggctcagtcaataggacagacagatgatgagtagacccccaagaatcacccaccagaggaggagcatcaacaccagggcagagaggcagcaaccgcaatcaaaagaactaataccagagggtgcagtaacaaggccaacagaaggcttctgaataagcaagactgatgtcttcagagcaatgcaaaaagacagtgtttccatgaaacagaataaactagagatttgtaaattcaagatattgatcattcaaatgaaacttcaatataagccatagagtagaataaatattaaagaataaagtaggggattcgaaacttggattttctgagaatgtattgcagaagaacaaaaaagccagttaaacttattcctttttttaaatagcaatctggaatgaaaatatcagatgatcataatataagagttagaagtcaagagagatggaaatgaaagcaagtcaagattcttgtcttggggggacaagtttatgtaccaattagctcaaggctttggtaaaataaatgtttaaatatgtaaaattttaagggcaacaaaaaacaatgtaggacatccaaaccactaaagaagaagaatttaaaacataattaaattcaaaacaatccaaaaggaaagaatttatgaagaaaaaaataaatgtataataagatggaagtaataaacctaaatatttcaataatcaaaataataattaatggattaaatgccctaaagacactctcagattagaattttaaaaatccaagtaccaaataacttgtaagaaatacaccttcaaagttacccagaatgtaaggcattcaaaaaaaaaaggcaaatattaacccaaagaaataaagtatagcaatattaacagcaaatgaagtataattaaagcccaaaacccacaaacattaaacagagcaaaagaaaatatatttcagagtgttaaagatttagtccactaagaatttgtaacataaatgaaattttatataaccaacaacacagctttaaccatagaaacacaaaaagaaattgacacattcacagtcattgcaagaaaatttattgctttcccctcaaaaatcatcacacaagtaggagtaaaataatgagtatttgaataatgcaactagagttgcgatcatttatatagagaccaagacagaatgagtcagaatgtctgattttcattactgctcccttgtttaccagctatggcaacctataggaagttaccttaactccccaatcttattttcctcatctgtaaaatgaactagtagtagtacctatctcacactgtaaggactgaagaaactaatttatatggagtaattaacagagatcctaacataaataagggaatgcacattcttttcaaatgtgaacatttacaaattattcaacatacaacaacacaaaaataagcatcaatggaatttttaaagtcaaagcagtagaagccacagtctctgaccacaatgcaataaacttggaagctaaaaacaaaaggttaggcaaacaaccaaccaaaaacaaatccacttgggaaattttaaacaccattcaaattaactttttagaaaaaaaagaaatcaaagttgaagggatgaacaaattagaagtgaaagacagtgagcggttgttcatatcaaaaccaatgggatttagacaaaaccaacacagaggaaaatgccactacttacatgtggaaaatagggaagactgaaaataagtgaactaaattgacaacataaaaactagacaagggacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaacaacactagaaatactttttaaagaagtaccatacttatatgaagatttaaaatttataacatcttttgagctgggcatggttggctcatgcctgtaatcccaggactttaggaggctaaggcaagaagatccttgagcctaggagttcaagaccagcccagacaaggaagtaagaccttgtctccacaaaaaataaaaaacaaattagccaggcatgtggcataaactacttgggaggctgaggtgggaggatcccttgagtccagaaggtcaaggctgcagtgagccatgttcacaccactgtactcaagccaggatgacagatcctgtctcaaaaaaacaaaaacaaaacaaaaaaatcttttcaattgtattcacacaaagataaaatctgaataaaatatgcatgaggttaaaaaaaaagtccaactagactatcttagaaaaaaatgtaaaagtagacaaagacctatatcttaaaaaaaatcaccgacccagatagctatataggcagattctagtaggctttcaaggaatggataattcttatgttaatataagctgttccagagagtagaaaaagataaagcaactcattccagaaaactaacatagccctggtacagaaaccagaaatggagagcgggcacactcacgcaaaaataggaagcagtgagccaaactcactttgaaaacagatacaaaagttctaaataaattgcaaattgagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagatactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaattgcaaattgattcctattagaagaataatatagtctgggtaaaacaggatgtaatccaggaatgctaagttggttctccatgaggaaactgattaatataactcattatatattattattaataataaaaggattaaatgaaaaataaccaaatgataatcttgataagggtttctaaaaagttaaaaattaaattcaacatttatttatgatattttattacatttccagtaaggaaagcatagaagacttcctcaacttgacaaagaccctttgccagaaacctataggaaacttcaagctaagtgaggaacaggcatgagtccctgctagtgtctcttcagtttagttgtgttggaggccttaacaataaaaagaaatgatagcctttattcttaaaaaaaaaagtatcctattgtaaaaattgttattgtctccctaaaaaaatccaagagaatcaactgattggccctgaggacttgtgaatacagaaggtaagagctgaagctgactgtaaactgcctgatcttcaaatgctttccccagagacacacacagacccaccaactgagggtgaaaaccttcctagatcaagatgtttacatacagcctctgaccagtcactggctgatcactaagctgtgctgatccaggacagcccctacaaaaccaggcttaaaaataaaaacaagtgataaatatatatatacatatatatatacccacacacacacacacacacacacatatacccacatacatatatatgcatacatgcaatatatattttgccagcagaaacatcagaggctacacactccaggaaaaacagactccagagactatgtctaggcaagtcactaaacaaacaaaacaaaaaaaaagtaacaactacccctcaatgggaggggtaagaatccagaattgctacaatatattatctaaaatgtccaatttaaatacacacagacactgtatatatcatatatatttctcatgtgctatacaggaagaaaaaaacagttaataaaaactgaggaacccagatgttggatttaacaaagacttcaaagcagctattacaaatgtttaaagaactaaaatcagtttaaataaagtatgacagcaatgattcatcaaataaagaatatcagtaataatattgatgaataaattaaaataagtggaaattaaataaatgaataataaaatagatggaaattataagaaccaaggggaaattctggaattgaaagtaaaacatgggctgagcatggtggctcatgcctgtaatcccagcactttgggaggctgagttgggcatatcacctgaggtcaggagttggagaccagccaggccaacatggtgaaaccctgtctgtactaaaaatacacaaaacttagccaggtgtcgtgggcaggtgcctgtaatcccagctactcgggaggctgaggcaggagaatcgcttgaacccgggaagcagagattgcagtaagccgagatgtgccactgcactccagcctgaatgacagagcaagactccatctcaaaaaaaaaacaacaaataaataaaagaaagttaaacacctgactgggcacggtggctcatgcctgtaatcccagcactttgggaggctgaggcgggtgtgaggttaggagttcaagaccagcctggccaacatggtgaaaccccatctctaccaaaaatacaaaaaattagctgggagtggtggcagatgcctgtaatcccagctactcaggaggccgaggcaggagagtcgtctgtaatctcagctactcaggaggctgaggcaggagaattgcttgaacccaggaggcggaggttgcggtgagccgagatcacaccactgcacttcagcctgggcaaaagagtgagactctgtctcaatttaattaaaaaaaaaaaaaagcaaaacacctgaaatgaacaattcattagaggggctcaatagcatatttgagctgacacagaatcagtgaacttgaagctggattacagtacagattttccaatctgaagaacagaaggaaaaaagaataaaacacaagcaaaatggttgaagccccagaggcctttggtgtgctttgtgggacaccacaaagtttatcaagatatacacaattggagttgcagagaaagacgatagagaaaagagggcagaaaaaaaaatttgatgaaatatcgttccaaaacagtggcagtgtataaactcttcaataaatgatatgaagacaattggctatccatttgggaagaaattagagaaagcctgtacctcacagaaaaaaacaaacaaacaaaaaacaggtgaattaaagttagatgttaaaaaaaatatttgcagaactgaatattttcataatctttagatgggaagctcttcttcctaagcaagccataaaatcctgaaaccataaagaaaaaattaacaaatttaaacctataaaaatgttaaacttttatgtgatcaaaatacatcataagggaaaagatatttgggagaacatatttgcaacatgggtaacaaatagataatatataaattacttctacaaaataatgcagaaaagaccaaaaattataaaaatggttgaagttatatgaacaggaaattcacaaaagaagaaattttaggggctgggtgtggtggctcatgcctgtcatcccagcactttgggaggctgaagcaggaggatcacttgaggccaggagttcaaaaagaaattttaatagcaaataaacatatagaaagatgcctagcctcactggtaatcagagcaatgcaaacttaaaatgaggtttttctcctcattaaactggcaaaaatctaaaaaattgttaagatccattgttggttaagatgaagagaaatgagcactttcaaatactgctggtatgaaaggcaatttgacaataactaccaaaatttaaaatatgaatatcaacaattccacttttaggaacctgtctcaaaattttcacataatatatccaggagaaacttctaattttctgatagtaggtgtatattatcagggttctcagcataaatgttgacttctattttggtgaagcagaatataactttaataatgctcccttaggattctgagagaaagttgttagattcagaccaaaaagtatgaaatcttactaacttattacagataggtatagtgcagagatactgtatcaagtactttacaagaacaaattaatctaatcttcataataatttcttaaggaaattgaggcaaggaagagttagagggaaggccaaggtaaattggtaagtggctaagttgacgttcactcttaacagtggggttcactgtgaaataggagttcagcaggacttgtttctcaagacgcaggtcacagagaccccgctgataaagcaggatgtggtaaagaagccagctgaagacagccagaatcaagatggtgacactaatgataattcaccagcaccatgacaatttacagatgccatggcaactcctagaagttactctgtatgctctaaaaacagaaggaaccctgggttctgagaattcgcagcccctctcctgtaaaactcatgaataatccactccttttttagcatttaatcaagaaataaccattaaaataggcaagcagcagcccttggggctgtgttacctatggggtaaccaccttttatttctttactttcttaataaacttgctttcactttactctctgggcttcctcttgaattctttcctttaggaagccaacacccaccggccctcccaggccaaaccccaatttgggggttcatcctgccacaactgtacagtgtggggtcaaggggaacccttggtctttttcactgaaaaatcaactcagaaaaggcagattaataggagaaaaggcacacagatttatttaacttgtatacaggggaggcttcagaatgaagacccaatcccctggtaaggtacagaagcttatataccatcttgaggttatagaaagaatgcaggctcagagcatgaccacaaccaggttttaatggcaagacatgtcatgggggagagaaagaaggaggcttggctagcaaaggtggcattgttatgtagatgaagccttccaggtcataactcctagagagaatagatggtgaatttcttttcagacttgtaaaggtgtcagactcaatctgtcctagatctgggaaaggcctggaaagagaagggctggctgcattcaaggagattctctacaggtgcaaaatttccccacaagagacagttttgcaaggccacttctgtctgctggcccagcagcagccatttcaaacgatgtcaaagaaatctattttgggataaaacattttgatttcctttagccacttgcagggtcttgcgccatccttttgtctgggtgcgtagctgtccagcagctctagcactacctggaagttgaggcatggtcatgcagaactaaggccccacccaggcctgctgagtcagagccttcacttcagcaagatccccagggattcctttgtctgttcatatttaagaagccctggtctaaagcatgagacttaaatctctgctctcccattttcttatctgtaaaatggtgatgacagtcctcaccacaagaggctgttgtggggatatttttatacacatgttcattctttcaacaaatactttgcgcccagcatatgctaagcacctagtgcagagaggaaaacagacaaaaagtaatttccagccatcatgtagcttacattctggtggggaaagagtaataagtaaagcatatagtttattacatgatggtaaatgctctggagaaaaatttaaaaagcaagaggatagggattgggaaaggctgtaattttaaacggagtggtcagggacagtttcacggagacctttattcagaagttgcagggaccaaagctatcttacgggagtttgcaatgagaatttctttgcccatgaagtccttgccaagtctatgtcttttctgagaattctctcccccttgatttcagccctgtttgatttctgacctttgaaatgccagcccccatgctgccgttgtgtggggttccgactggacatccagaagtctccgtgtgtgttctcattagctttcactctgggggagttttctgccacaatgtgaatcacttattttgctggcagcagcagttgacagtgacactgatttttaaagcctgcacatttcacatcagaaaagtcctggattttatgacttagctatgcttagaggataattgcaacaagaagtctcccctgcagccagcttattggagctgagacttgtataagagccagacctggcactttaaacagcccagcaaataacccaaaacaaaaatgaacaatgcacatttttatctatgctgctcttccccatcatgaacacatgcttctttttttcctcgccttcaccctcaattttttttgtggaaattcaatggttgactgtaccaagccagctctctgggtgagaggttccttctaacaaggattagaaacccctctcatgtaggaagaggtggatttgggggattatatgatccaaccctctacctttggacagaatacaatcgagatgtctccccagtacacagaactgcttttccagcaagttctctttgttaagccattctggtatccctcaaatcccttgttatgactatccacaattctccatgccccatgaccctttcttagctaaaatgaaaaataattgcctagttccctcatgtagagaagttgagctattaccttgacttcccccttctcttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttaccatctgagaactttagtcctaataatttctctacaccaacttctagtcctaataatttatccgtataatgctcagaaacactccgagattctcagtaaaaaaaaaaaaaaaaaaaaaaaaaatcaaggaaatcttaatggccaaagccataggtccaaaacccggcgttccctcccacccaactttccaggccattttctccaatagcccctcatccctgaccttgtcttccagcctccctggaccatgaatgctgctgaaggctctcactttgtacttccctgggccccctgcccttgctagtgacttctcctcccctctggctgtggaaagctactcattcttcaagacccagttcatatgtcctctctgtcaaggcttcccagatgccttcacagatggccctgcctcagggcctttgcacctgcctttgctgagaacactgttccctccaatctttgcatagctggctccttcttattatgcagatctgagcccagagttcactttctcaataagtcttccctgaacactttacctaaagttgcaaacccccattactctctatctcatttgtatgttgttttcttcatagcacttgtcactatgtgaaattactctcttatcatcagtcttcttccacgagattaaaaacaccatgagagtaaagggcaaggtccttattttctgtgtatttgcagcatttggtgccgagaccatagtgagtggtcagacaaatgaaagaaatggctgcttccactctgttagtggcatcctcagacacacagtcaccccttgtatctcctggggattggctccaggacatccccccatctctacttgagatcgcccagtaggaatattttgaacaaattcctttaacccatggcagaggttgccttaatttcaatgtgagaataagaaggtgaaattttgaaataagagattgaattacttatcagaaacgaaagcttcttagagcaaatttaaactctacaaactttggtcagggatttgaacacatatttccttccccctcagtttctctcacacagacactgctgatctcagtaatggccctaaactttcttttctttttcttttgcattttcttctttctgcacatgtatgaatgcaagctgaatagtcaagttcctgaaatgggtcaggattaggtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccgactgtccgtacagagtgtggttcagaggctgccctttaacctgtgtggccagagagaataaatcaagccagcagtgctgtctccctgctgactgaaggcgcccggccttatcaaggagcccaaatgtcttgtgctcacagctgctgtgacatctggaagcattaacactttgttgccagcatgtaggctagttgaatgccgatgcgtaggtgcctggtgttttctggtctgctacatgaataggcgtcaaaagttggtggtgaggagtttgcttacgttcattccttaaaagcaacatgacacagagccttgccatggcaggggtgatgggttgttaccaaagtcgataacaggaaatctcactgaggataaacagggctcatcggccattgccgagaaacacatggttctcatttaacctgccaaggactaattgtgtatgcttcggaagcgcaaaaacaggaaaacgcttttctgacatacaccccaagtttcttcagaccaaaaagaactgcctcaatgttgttagacgctgagaagtaatgatctccccagctgtcagggagccaacctcacttacttctctttaatctaaacttatgacctaaagcatatttcaggcctcccatgaagtccttgaaacttgagacttaatgaaggacactgaggtttcacttttcactgctctggtgtatgtactctcagaaaagcagtggaagaggttagatagatggtgatgtaggaatcatggcatccagaaaatgagtgtgatttaccctttgataaaagggaactaataaagcaatatatgcaggaaatgcagagacaacccagtgaataggtgtgctgctttagcctttaagggaagatgggtctgagcttcattctttaccttaagatgggtccaagagctagaaccagaatttaaacaagcagatacaattccaaggaccatgttttgtctcatatgggggctattcactcatttattacccaaatcaacagaccattctgcttccaaaatatttcattatctgtggaaggaaaacatttttggtatgcatgtcaagtgctcagataacatatttatgtatcgctttttcactaaagagaatctgaccgcatctggaaattcttttgtgtcactgcctctctcagactacttcccatctgtatcgctttaactccaataaaaggccatccccatgcctgggaaatgggctttgtctggggaacttgtctttctctgattacatgtaaattaattaaagcccatcccgttttacagggcagcctggtggtggtggcctgcactcttgactttccagcatgttggcctgtcacacgcaaaggaagagggaggaggggaggatgcaggggcattgttttagccaaaccctaaagctgatggaaatgaaatccactggcttttatcatgagaagtgaaattgttcatgaaataatggcagcctcatacagaggctgtgcattggattatactcaacctttcctctgaaacgttggtctggaggctttgcccctttattttcagtttcagatttgatctcagtaacaccctgaccttttcagactccataccacttttcacagggatgactgccttaagggatggggaaagggttagagaaagcaagtattttatttagaagacagttttcagttagaaagggagaagacatctagagttaaagttacgatcttttcctttctgtgcttaagtgatactaggtcattctttaacttcttgctccacctgctctatccccagctctgcaggtttggagtgggctgtcatgtgattttgtttacccgtttcggttcaaagacagaactctttatttgaacactgaagctagcagggactgtccaaagccagagcccctcatattagcctagcttatgttgttgtgatcatcagactgtttctgttttttggatttttgtccttaaataaacaccttggaaccactagctacacagaggggtaaatatcagaaaatccaaatttggtgcactaatgaacacggggtctcttttcacaaagcaaaagaccatcattcttcagaaggatctcccaaagaatgccattgaaaactcctcattaccttcaaatggggtgatgcacacacgagtagcatgaaattagccatgttcatattaaggagcaatctaagatcattattgctgtttctctggccttatattaaatagtgtcattgcaattgaaaaattagagtaaatgaacagagcctgtgagcatccaccctttgtaggttatcctgagtctgcattattacagggtcttgaaatgaatggtgatacgtgaaagtatttgtcctaggattcattaatattattatattttagtctttggtcaatatgaagaaatactcaatagtaaatcatagcaacatgatttaacatgagatataatttgaagggctctttaaggctgctaagcaaccatgaatcatggtttgcatttttctagatggataatatgaagctatcttatttatctttctagaactagacaccttaggtcaggctaatcaaccagctggtatcatttctcagttattgtatgactactatctttatttcaaaccctgaagtcctaaaattaatgtcaccacagccattgtagtatgtgttcagccgcctgtgccggaataggggcttactgtcttttgatgccttggttctcagagtaggcaatgggtaattgaattagcaaagtagacattcaaaacattctctgagttttcaaactcaaggagcgtgtgacttcagagaagcaggcgataagtcagggggtgggtcatgtttacccggttgccgtcagctgcgattggtgtaatatgatatggaaaagtggcccagggatgtaactgagaacataaagtcaatgaataacacagaaacgtgagttaacaggaaacacatgttattctaaaatgaacctaggtcccttttaacccaagccaattcaacaaacatagcttttagatcataccttttaggtttttttttttttacccaaaaaccacactggggatgactccagccgtggctcatggggaacactactgtcattcagtttgttcctctgctaatttaatcttccattttcctttgattggtgatgcacgcattcaaggggcatcaagccatggacactttggtgaccctccctatccttggaaccccagccagctgatggggttcgtactggtaaaatggcaaactggtagaggcatctatgcttctgcctgttaaaaatatactaataggccaggcgtggtggctcacacctgtaatcccagcattttgggaggccgaggtggacggatcatctgaggtcaggagtttgagaccagcctgaccaacatggtgaaaccccatctctactaaaaatacaaaattagccaggcatggtggcacacacccatcatcccagctactcgggaggctgaggcaggagaatcgcttgaacccggaaggcagaggttgtggtgagctgagattgcaccattgcactccagcctgagcaataagagcaaaactctgtctcaaaaaaaaaaaaaaaaagctaaaaatatcacataccaaagctgcaaattatttctttaattttgagcgacgttaatccacatgatctaaatcatacattctcacacattctcctacttcaaagctttccctggttcctattaccttctgggtaactacctccacccacgccatgtgtaagacttgtcacatgccctcctctgtgtccaggcccatctcccctgcctcagttctggccactgctacccagcattcatccagtgcttgacctgtgttgaactccttggctctctagactccagtctcaagtttgcccctctatgcttttgcacatgctgttctcttcctggaattcctttctccctcctccctttactcctgagaagttttctttatcctttgcgatctacctgcaatgccacttcctctgggtcagatatgagaggggctgacttcctggtggagggagaaatttgtagacaagatttataatctcattaggagctgtgctctgaggggctgcgaatggataaacagtgaggtggtggtcaggtggtgtttgggcttcagtatgtggaatagctactatgcagcctggtgcaaggaagatggagtgggacagagcatcctggtggggattttcgagatgtgcttctcagacatgacaggttacttaacctctctgggcctcagttttctcatctgtaaaaaggggtggaatttaaggagagcagaagttaaagcttatctgtcacatccctgataaatgtctctgtgctgctgttctagctggttgaacctcaaaaatgtcccagtttagacaataaattatatggtcacccttctgagagcagtaccctccacacatgggtgccgtaaggattcagcatatgccgttctctaacatactaatagcacctaatattgtattatttccattgatatctgaactcagtatagagatgggaccataagcgatttcccaggatgatgtgcttggagcatgacacttagaaaaaagatcagaggacttttctgcctcttcagtgttcaaacccaggcacagggactgtgtttggctgctctgtttggggccctgtgggaggaaacctgtgtcctctctcttgctctgagtcaacagacaactcttagaagtgcctgattgagcctacaacatggaaatgccatttcctccaagccgtttatctgaccacctcagcctggaaagtaacagctcttgacttcccttctccacctgggatcagatgacgacaacatttgaaacaaagggtctgctctctttctcagtatcacacctatggaatcagccctgattcacacttcaaacccactacttcatgaagcaaggtcttgccagatcccctagagtgaacaggggattctttatcctctcacaggcctggcaccgtggtagcttctgaccatgacagctcctttcactgaggctgacccagactctgccaccaagtgatggccactccttgggctcccacagccagggttcctgacagcttccccagtcaccaccatttcatggtttcagtttgcacaatgtcctctttggggtaaaggggaggacagatgccaacagaaaaccctcagtacctgccttggtagaatacagccttgtcactgtgtcctgcatcctcctgtccttgtttgggtgcctggtgaagtccttttgttcaaattctaatagccatggacctctgccagctcccagaggccctgagagataagcagccatgtcatgagaagcatttggactccggtagcctgggaaataaatgaggactgactgggcagagaagagcaagggggcgatggccacagagtccttagccagccaaggaaatgacattgttggtcattggccggggatgcttgggttgtctgcaacacatgaaaaaagcatcacgtccccttgactttgagcaaagagtgcggttaaaaccaagttgtgggaggatggatagtcagtaattgtttatctgtgtgatgagataaggtagtcccctgctgtaatgaaaatgcacagacagttcatgaagtgaggaattagcaactaaggacaacctgagtgactacatgggccaacatcctcatgtgtagatgaggaaactgaggccctggagacccaaactggcacggctgttagcaggcagagctagggctgaagccaggactattgagtattcatcaagagcgtctgtaccacagaacttcactggggcccggacatgaccttggacaagtcgctgaactcggggacctctgtttccttatctgtcagctgaggccacaaggactgcatgatctcgcagctgccttccagaaacaacattccagaatgctctgttccccccttccagcccaagagactgtgcagaataggcctcttctcagtcagcaggcacttttgtctcccatggtctaggcaggagtcatttttttttgctacagtggtggaaatgggtcaggctggagaatgctgaggtttccaggctagtggtttcttcctctgaccacagtaagaggaaaggaagctttccctccacctctactcctctgtgactcctgccccagccccatcctcagcttccacctaagaggtagtgcaggaaagtggtgataagcagatgtctgcagctgtgtgacgtgtgtcccagcccagttctgtggcctgctacctggggagcctctggttgtcattgggcctcctgttgcctctcagcttgcctccctctgtaaaatggggacagtaggccaggggctgtggctcacacctgtaatctcaacactttgggaggccaaggcaggtggatctcctgaggtcaggagttcaagaccagcctgaccaatatggtgaaaccccatctctactaaaaatccaaaaagcttagccaggcatggtggcgtgtgcctgtaattccagctactggggaggctgaggcaggagaattacttgaacccaggaggcagaggtttcagtgagccaagatcgcaccactgcactacagcctgggtaacagagcaagactccatctcaaaaaaaaaacaaaaatgtggggacagtaatagcacctgcttcagggaactgctgtgaggactgaatgttaatgtgtggaaagcaccgagagcctggcgtgcagtaagggccatgcaagtgttaggtgccgttgtcatggctgtcacattggtacctgttcaacacacttagaggaccgcctccctccaccttgatgacccttggtaggtactgagttcctgagttttagctgaggactgaaggtgtgactgcaataggattagctggtctgaatcagacttatgtagcaccaggcaaccttcaatctccttttgaaaggggaccaccctgaacctttcagaaaaacgttgctttccccgattgaagtgattcccatgtaaccacagtcgggagcacaactggccaagattttcattcaccgcagactcagtcctcatttcccctttccagatcccaccaggggcagatgaggtgtcacattgcatcacatcacgccatcgccattaccctgttcacaggccaccccagaaactcccggcgggagacagaaactaacttctgagctgtgactctgccccttggggttgacactgaggcttaggctgtttctcactcgcttgccctgcctttcccagctccctgcccctctccgctggcgtcttgtggccagatgacagtgctagctcttcacacctgaagcacattagcaacactggctgggctggagctctgctcccaagcttcctctccctgcctagaaacctgaagcaccgatgtgcagagcaaggaggaactctgctcccacgcctgattttaatgagggatggatgcatcctgcagggctcagaggttctgtttctctaaacccagaccaaatgtgtttgggtggccaggcctcgtaatctcagcagaggaatgtgcatgccacagggctgcagaaaacagtttccagcggtctgtcagcagatgtccactccagaagacagacagggaatttggagacctacaggctttggagtgaaaaagtgatggatattaagagcacaactacacacattcggattctcaaacgcccaataaacataaatattttccatccacaatgtactatatatgcctaaatatagggcaagccccaaatagcacatcctccatttccctaattagataaatttaactctctttttttttttgccaacttaataggaatcagaactatgattgcctttgaggtggggggagtgggcagtgggaattgactggcaagggactggtgggaactttctggagtgagagacaagttctgtactttcatgggggtggtagttactgggtgacataattcatcaaactgcaccctttagatctgtggattttaatgcctgtaaatttacctcaataaaaagaagtttggagaaatgaagaaataatcaactatctgtgtataatgtttaacttaatcatgtggttgaatgcttaaaattttataagaatgatatattaatctataatactcttcattcttatgtttcacacaataattttatccaagtgtgcatcttctgagattgatgggtttcatttctaagccacatttttagtcagcagtttaccagaatatatcatctacaatttgcctaatttatttgaaatgcagaacttcttgaatccatgttggtgctgaaatttgattggcacacaccaacgcccacttgcgtagcactgcagcagttgttttcctcatttgtcttgcaagtgaatattcatgctgctccccacatcaacagcttacgtattgctttctaaaatgggctttcaaatatttattgcaactttcaacaattgaacccaaggaataattaccaaatcttcattaaagctcattgcctccttcccattgtttccctctcgtgacctctaaaatcgtccaaacctgatgttgattgagatcatttcaggctagtgtgttttccccaaatgttgtcgttcaaataaagtaattgaggctgggtgcagtggctcatgcctataatcccagtgctttggaaggccaagacaggcagattgcttgagctaaggagttcgagaccagcctgggtaatgtggcaaaactctatctctaccaaaaaaaaaaaaaagaaaccagcaaaaaacaaaacaaaacaaaaactagccatgtgtggtggcatgtgcctatagtcccagctactcaggaggctgaggaaggaggatcacctgagcccaggaggttgaagctgcagtgagctggactactgtacttcagcctgggagacagagaccctgtctccaaaaaaaaaacaaaaaacaaaaaacaaaatttccaaattattagacacttaaattttaaaggacagtaagtcccaaactgtgagaaacttttataggcaacatcctcttttctaatagtttaacttgaggatataaaccttcaccttatttattttcagacatatatagtaaatcctggaatgtattcagatcaaagataaaatagagataaatttagcaaattttggtggtcttgttttataattcactattaatagattagcattgttagctttagtttatttgtgtagcaaaaactgaccaatagaatctaattaaactgaagagcttctacacagcaaaagagactatcaacagagtaaacagacaacctacagaatggaagaaaatatttgcaaactatgcatctgacgaaggtctgatctctgtcatctataagggacttaaatttgcaagaataaaacaactccattaaaaggagggcaaaggacatgaacagacacttttctaaagaagacatacctgcagacaacaagcatgtgaaaaactcagtatcactggtcattacagaaatgcaaatcaaaaccacggtgagataccatctcataccagtcagaatggctattattaaaaagtcaaaaattggcctggtgcggtggctcatgcctgtaatcccagcactttgggaggccgaggcgggcggatcatgaggtcaggagatggagaccatcctggctaacacggtgaaccccatatctactaaaaatacaaaaaaaaattagccgggcatggtggcaggtgcctgttgtcccagctactcgggaggctgaggcaggagaatggcttgaacccaggaggcggagcttgcagtgagccaagatcgcgccactgcactccagcctgggcaacagtgagcgactccatctcaaaaaaaaaaaaaagcaaaagtcaaaaatcaacagatgatggagaggttttggagaaaagagaatgcttatacactgttggtgggagtataaatgtgctcaaccattgtggaaagcagtgtggctattcctcaaagagctaaaagcagaactgccaattaacccagcatcccattactgggtatatatatacccaaatgaatataaatcattctaccgtaaagacacatgcacatgaatgttcattgcagcactgttcacaatagcaaagacatggaatcaacctaaatacccatcaaagacagattggataaagaaaatgttgtacagatataccatggaatactatgcagccataaaaaagaatgagatcatgccctttgcaggaacatggatggagctggaggccattatccctagcaaactaacacaggaacagaaaaccaaatatcacatgatctcaatgataagtgggagctaaattatgagaactcatgaacacaaagaagggaacaacagacactggagtctacttgagaatggaggttggaaggagggagaggagtagaaaaaataactattgggtactaggcttagtacctgggtgatgaaataatctgtaccaaaaacctccatgacacaagtttacctatataacacacctgcacatgtactcccaaacataaaataaaagttaaaaaaaaaccaacagcaaaaaaagtttttgttccctaccatgaataaaaagttgaaacattcttgaacaactatattttactcaagggcattatagacagggcaatttaacagatgcctgtggttagccatgggattgtaagcacaattctaaattatgaattactaattattaattttctggtttaacctcacatcctgtccagccttcagctacaaccagtgtgatatggtgatatataaagaagacttcatttttctaacagttcctcaatttaaacatcagaaagagtgctgttcttaaggaaatcatcaagaaagactaagcaccattgttttgtttctgatgttgctgtcactcagcaccgttgccattgctgtcagaagcaaaatcaaatcactcaccaagagctcggcaagcatgcaggtccccgtctggctcagggcagagactggtcagttatttttttggtagcaaaactctggctttagagttggaccatgagcagtcctgcttgctgctcattccctttctctagaaggacccctaaggagttttacagcaccgtgggggctttctagaatggttgaaaacctctggcagcagatcatccatcaggcttggtcccaagttccagacctgggttcttgactccatgactgttggccagtgacctaagttcagtctcattttcctcattcagacaagaattgcttgtaaggatgttcttaagtgtgctttcaaaaccatggagtataaggcttattttactccttaagtcttcctatttcctagtcacatctcatttgcatgttatatgccatctcatcaattattgggggacctaagatccacattttctattatttggccctgttgatgctacaacttctgcctttcagcttttcagccattgttctccacttcaaaatggacaaggaggaaaggtgaattggggttctaccactcctgcctctacaataagaggctccagcatcatgattcattcttgagaatgactcctctgacaggcctcttttcatttgcaggtgggccaagagaagggaaactgctctttccagaaaaacccaactccctgcatcatccctcaagaacaagaaaatatcttccacacaatatttgcttttttcacaaagtctggaagaaaagtcttggtaaggatttgtttagtggttggggtaacacgggtggtcctcactcggaagacaccagttttctatttgatatttattatttcctaaatctggttttaatcaatttgacttacaaaggcacagactgtggtcaactcctaattttcagtctgaggtttcaatcaaaatgttaaatttacattccaaatcctattacctggaaaagggataaatctttgcaacccaccaagcacaaagtaaaatgtttcttccactagaatgagtctaaacaagagtgattattcttgtgcaaacattttgggaaactgtttgataatatctactaaaacaaaacgtgtgtatcctatgacacagccattctactcttgagtatatccccaagaaaaatgagtacttgtgcttcccagaaaagacatgaaaaaggatgctcacagaaatgttaaaatagctgaaagctgagaacaatgcagatatccatcaataggagaataagtaagcaattgtggtatatccatacactggaatattacacagtaatgaaaaataacaaactactgctaatgaatgaatctcacagacagaatatattgagtggaagaagctagagacaaaagccacatattgtaatatttcacttatacgaagttcagaaatagcaaaaactaatcatgatgatagaggtcaagaaggtggttactttcagaggaatgtggatgggatggggcatgagggagcctgcttagatgctggaaatgtcctacatcctaatcagggtggtagtcctccaggtataaacacatgtaaaaatttttaaagacaggccaggcacggtggctcatgcctgtaataccagcacttagggaggctgagggggtggatcacctgaggtcaggagtttgagaccagcctggccaacatggtgaaaccctgtatctactaaaaatacaaaaattagctggatgtggtagtgggcgcctgtaatcccagctactagggaggctgaggcaggagaatcggttgaatcagggaggcagaggttgcagtgagccaagatcgtgccactgtactccagcctgggcaacagagcaagactctgtctcaaaaaaaaaaaaaaattataaagacacacacttcagatttgttctatttactatatttgttacacctccatttttaaaaagtgcaggtattgaagatggaatgacaatgcttttccaaagcctccttttttttatctttggttacatttctctaagctccttatttcagccctggcacatctcacctttatcatttcctttctcattcttttctcctgttggagaagggtgactgtttgccacttgaaaggttgggtttttttttttttttttttttttacttacatagtgagggtgatattgttgaaagcccttagacttgttagatgtagtgatacctagtgattttatagttacgactctgtctggctgaaaattttgccgtatagatgaaacatcatcaaggtatgtatacgcattttggaacctatcatataaaaaagaaaacttttgtaacttaaatttgggatttatgtttttggttttttgtttgtttgtttgttttgagatggagtcttgctctgtcgcccagggtggagtgcagtggcatgatctcggctcactgcagcttctgcctctcgggttcatgcagttctcccgcctcagcctccccagcagctgggactacaggcggccaccactatgcctggctaacttctgtattttttgtagagacagggtttcaccatgttggccaaactggtcttgaactcctgatctcaggtgacccccctacctcagcctcccgaagtgctgggattacaggcgtgagccactgcgcccagccgagatttacgtctctattgtaacttttgtgttttcttgaggaagtgtcacatgacttcttagccctcttatttacctacctaataaataggcatgaaagtatatttgccactacacaggtggaagtcacataatgtaggaaacgtgtctgtgttcaaaactcataagaatgctttcagaatgcaaaatttaagtttgtgggtttaaaaaaaaaaacaattatttctctttgtgaattcatccaattcttggtaggataaattagtgagctgttttctcccagttgcttgacttaaaggcatgctctggttcccactgggtgggaaatcccttgaatgccctctggtggcgagaaagaacgattgcatcttcttgtggatttcctctgcctggaattgccttagtcaccaagttcatggagcccactactctgtaaattgttgtggatttgtctttgttcttaattccattggaaatttttctgacttttcttctcaggactgtgaaaaaccaggaatttcttgcctaacagcacactgtaactttagtgctcttgctaaagaagaaagtcgtactatagacatttacatgctgctgaacacagaaatactgaaaaaggtaagccctaatgaaccgcacttgtggatgcatttagaagcatttgaattgttgacatctgattttgggtaaaaaaaaggaaaaaggaaagcatttgaattggtgtcctcatgacaatctggctgcccccccttttggctgtctacaagagactgtttttatttttatgtatttagggggtacaagtgcagacttcttatatgaatatattgtatcgtgatgaaatctgggcttttagtgtacccaatagtgaacatggtacccaataggtaacttttcaaccctcacccccctcccacattttggagtctccaatgtctgttaattccactctttatgcctatgggtacccattacttagctcccacttataagtgagaacatgcagtagttgactacttatgagttatttcacttagggaaatggacttcatttccatccatgttgctgcaaaagacataatttaattcttttttatggctgagtaatattccatggtgtgtgtgtgtgtgtatatatatatataccacattttctataaccagtcatccattcatggacacttaagttgattccctatctttgctgttgtgaatagtgctgcaataaacttaccagtgcaggtatattttttatacaatacttctttccctttgggtatatacccattagtgtgattgctggatggaatggcagttctatttttagttctttgagaaatctcgatactgcttttttgattgtactaatttatcttcccatcaacagtgtataagtgttcccttttctttgcatcctcaccaacatctgttgttgtagttgttgttgttgaactgtttagtaatagtctggctgccccttttgaaacttttccagcaagtgccattggtaattttgctggtagataatgccagggtaaaataccagacccttgctactcaaagtgtggtccgaggaccagcagcatcagcatcacctgagagtttcttagaaatgcagaatcctgggctccaccccagacttaataaatcggcatcttcatttttaacacattccccagggattttgtttggccatttaagtttctcatgctttagcttgcatcagaatcacctggagatcttgttcaaacacagattcctttggggtgcagtctgaggctctccagttgccacaagcacccaggtgatgccagtcctgcagtctagggacctcgctttggatgaaggttggctaaccttttctgtaaagggccagtggtaaatatttcaggctttgcaggccctacagtctcttgcaactgttcaactctgccattgtattgtgaaagcagccatagacaacactcaaataaatgggcatggctgtgatccagtaaaactttataaaaacaggcagagggccagatttgacccatgagtcctagtttaaatgacggtttgttttggtccaacttttgaacctcaggtcactttgctattatgagtttatcacaggtggttcattaaaaaaccacctcaaccagtgcatcggtggctcttgaagaatcatacaaatttcctatgatttattttaaggtgagagctgctgagaggccacttccaacaagttgctgtaaaaataattacatgtgaagataaaactaaatatgcatgttagcctcagagattccaattatttttctttagaaagactaaatgtgttaatctgtacaaacctatccacgtgtgaatgaataaccttagaaaagtcattctgtggttatttttaaataggcacagaggtaacacactgacctgagaggatgcaggcatcaggggatgtttttccattttcaatctgtagccgttacagccctcacacacctgaagagagctgtgcatagttctggtttctctggtttgctctggagggaaactggtttggggcaagttggactcacactgcagtgctttcttctccctttgtacctctccctttataaaggacagtgttggaggaggaccaggcctgacttagagcaccactggccatcctctgattccataagggaggctggaaaaccccacgtctggagaagtaccttcctgaaatgtgtccgcaggccaggctggaggactatgcctctgcatatgtacctgtcctgtttgtattcttcaaaaatggtgctgcagacagttttattgcctgtgccatacttgccactgtccatagagccctggtgacagcactggtggctgtaagccactctgatgtttcctttatcctcaacccagatggctgctgcttgcacttcagttatttgcacttaatcatgcacagctctgcagcctggttcttctgcttttctatcccggcagccagtggtgaccctttgccaaggaacatgtcccagtgactactgtccccatgggccagccaggccagtagagccgcaggcaagagagctgaaagctgtagggtgtcatatgaagccttcaaggctcattctccatgtgccctttcagcagaaaccaggagcacttccaggtgcagagaaaagcttagaacaaagttgacctggaagccagatggggccccagctgctcccagagcttcagttgccctgaagccagctacagcctcccttggggagtggagcccacatggctccaggcctcccgaaggatgtggagcagcgccagccttgtggtttgcctgggcctgcagtcgtgtttattttccttttgacctcaagatctggccccagacaagggaatttgaggttttactgttttgaccttaacaagttttcatttgaaatgtaggatctgatttttaaaatcactgtaggagccgggcgcagtggctcacgcctgtaatcccagcactttgggaggctgaggtgggcatatcacaaggtcaggaattcaagaccagcctggccaacatggtgaaaccccatctctactaaaaaatacaaaaattagcctggcatggtggtgggcacctgtagtctcagctactcgggaggctgaggcagaagaatcgcttgaacctgggaggtggaggttgcagtgagccaagatcgtgccattgcactccagcctgggcaacagagcgagactctgtctcaaaaaaaaaaaatcaccgtaggattcggatttttttggaagtattcttctttcagtctgtaaggcttttctcactgattctacaaccgtgggggcccatcctgtgccagactcctcgtctgcttggcctgtaacgttggcaattatcatcatcattatcgttattaatatccaagtttatttttatttattttaatgtttttatttaaaaaaatatttttagagacaggatcttgctctgtcacccagatgggagtacagtggctcaatcatagctcactgcagcctcaaactcctgggctcaagtgatcttcctgcctcagctagtcctcagctaggactgcaggcacatgctaccatgacaggtgaatttttttttaatcttttgtagagataggatgtttccccaggctggacttgacctcctagcctcaagtgatcctcccacttcagtctctcaaagtgctgggattacaggccttaaccatcgtgcctggcccaagattattgttattattcaagattgaaaatacagcatatcctgatacataaaaccccaactttataaaactgttaaattggtaaaagattatttgttgcttaaaattatttcttgcttaaagtgagttaactggagtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtggtttctttggcagagatgagcaaagggtacccttggaactgttttctgtggagtcctctaccttcctgtttctttgagggtttaaccaaaggtggcatttaagtgtaagctccttgcatgacaggcaagctgggtagatgtaggtggggacaccacaggacaccttgcctgtggagcccctcctgccccacaggtagaatgttgaatgcactagttctctgctatctgtttccacgacagaagccaggctgcccttctgctccacaatcaacctgtaccactggcttgaggttctggcttctccccagaccacagtttttccagtccctgtcttcttccaaattctttctccatccctgttttggcgccattttctggttatctggatcagtgtctttgaatctgagcccacaggaagacctctgcctgcctctggctggggggtgattccagagtcttagctgtgctcccttatacccctgcccctttctccttaattcataagccagatatttaccccttccccatctctccatcaggcatcctctttcaatgtttaatggttttgattccaaaatgacttcatttaagagcaaagaaagagttaaaagcaactcatatgaagggtttgagggttgtggtcaaggcaggaagatgcctataaaatgtagatcagatgccttctgtggaatgccaggcctagatttgctctacacaattaaacagctttatttatcctcaactctttgtgaacatgtcaatatcaatatccaaatatctggctctaactgcttggaaaccacagcacacatcttgcgtgtgttgattactggcaaactccatcatttcccaccatccaccatgatctgcaaagaatccttaagagagaccctagtctgtgtttatgtgggtgcctgggatggagaggtatctagttcaatgataaaatttttgtctgggctacatggaatcatggaatttcagttctgcccagtccctctcaaggcccagccattatcatagaaaaatcttcaagtaagttgtgttgtttcttccacaggacagttcgtctgtcatccagttcatgtcccgcgccaaggtgaaggtggatcctgccctaagggtggtggaaatagctcatgggaacccagaagaggtgacggtgagtcagccaccccaggacagccctcctcagagggcaagggaagctgggtgacttggagacctggagctggaatttgagggtcaagacagtctctgagccaagatgttgggtttgtggcagacccaagactatgcctgccttggcttccaagccccccctggagaacttctgtggttcgttcttgtgatagcattgtcctttaggatgccatcattatgtgaatgtttcctgctatgattgtccaaagggaaaatggtctggaagtacacccacgtcaacagagttggatttccactgtggagccaggactatttatatctttcttagacctttcctaagacagaccacatctgccttacccgtcacattactccatgggtaaatactgtgttttggtttggtttggtttggtttttaagagacagggtctcactctgtcacccaggctggtgtgcagtcataactccctgtagccttgaatacctggcctcaagggatcctctcaccttagcctccagagtagctaggactacaggcacactaccatgcctaatttttaaattttttaaaatttttttgtcgggatagggttccacgatgttgctcaggctggtctcaaactcctggcttcaagcgatcctcctgcctcagcctcccaaaacactgagattacaggcaaacactgggtgttttaaaaacaagttgtttgaatgacttaaagagattacatccaaattgccaagacctagtaactgctctttaactatttaccacccccttctcctccataaagtgcagttggcaccaaggcctcagagacacgggagggtgtggcaaaccacgaggctgagagtggaggtgtgggagaggctggagggaagctatggccttggaattttattgccttttattgttgttcttgcaggagcaggggggttgaggggggttcatcctgtatttgacgcccacactcagatcccaggggagtagaggaggagacagcagccgatgcacttcttttgccagtgagctgtgcaatgatgctacctgtctgcttcccttctgtggaatttaccctctcttagaacagtcagtgttgctgtgacacatttacaaaagtgataagtttataatgattttgtgcttagaaactgttgttaatttactctctgacaacagtggagacaccacatgtcaaaatgtcagaatggggttcaaaccaaagactactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttgtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaaacaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgctctacccacaagataagttgtccaagcactatttttgtttgtttgtttgtttctttgtttgtttgagacagggtcttgctttgtcacccaggctggagtgcactggtgcaatcatggctcactgcagcctccacctgttggctcaggccaggcactaattttaatgatagaaaccaaatggaatgatgctgggtcatttactacttagggtcagtttttctggcaggtcagatatttggagttggtgtttcccttttcttccctgccttctggccatttaactgctaattcagacctccacctgggaagtgaaaaagaaaagtggttccctgctcattgtcatagttctggtttaaaagttttatagaatgaaatacttgcccaacatgagaggtttagaatgttctggtaaaccacagtgttaataagtggaagctaatggaaatagctaacaggttttctacacgtagaatcccttgtgtagatgaaaaaaaaaaatcactgggcatattgccttccattataggactagactgtgggatccaggaaaatgttgcttaacatctcgttgttggattccaagtcatctgtactcccccaaaataccacttccattaattactgttccattttgagcactatggtgatattttcattatcaagagttcttgggaagaggccgagaggttttttttagcactcctaagaaaaaattaacacacatgggaattccacaatgccccttctccctcctttccatgactttgccttttcagtccatgagctacaatgaagttctacaatctgttgttctcaattttcctggcaggaaaaaaaaaatcttttctgagtaggaaggtttgcctttttagaacaaacacgttcttccctgcgtgattcttctgaatgcctggccttctgtcaactatcagtctgaaggggaatttccatagagcctcgccaccaaatttaaattaggcaaagtttcaaagattttagattaggcaccaaattgttatggccttggaaggaacaggaaatgtacttgcatttggtatcgagtgggggaggaaaacaatcagatttttaaccacataacgtgtgcacggtggtaaatttaactgatggagaaatcaagcaattttcctgtgatcttttttaataggagttttaaaatgcattttatattgagtagttatttcatgttttcttaaaacaattattgtattgaactaaaaataaactaggtagtttgttcacataacaaatctacattcaaagacatgcaaacaaattttccacttagtccatttttctgttctcagcattactacaaatgcctcattctgttatcacgttgaattcttcagcatcttctatatcatttccagggcatctctgggaagtagtgatgcctgtcttccctcagaagcacactgataaccccaatatacccacaattcacacttttttccttctctgaggtatgctgttttttgtcaaaacagaaaaaacacactactaggatatgaaaaacttcattctgggcctggttaggtcataaactacagaaccttaggtcatatattctcaccgggcgcttgtttctccactgcaaaaaataattcgtatttgcttggtcctttgtagtactttactgtttataaatgtagtacatttatcttcatgatgacccttaaatttaagtaaggtagtattatgctcattttatagaagaaattcaatctcaaagaggatacagtctcccaaagatcccacaagcagtaatatattaggcagagctaaactcacacactgtcactcaatatcctaatattggtacatgccatgctaataagtgtgctaaaatggatgaagcggcaatttctcaggtcccttccaatgatcctgtcctctgcttctacttgatattttttctctctttcaactagcattaacatccgaaactgtatatcatcaccacatttcatttaccatggttttttaatttaattattctttaaatttttctatttccatgttaaatccagagaaattgttactttttggaaagtttctactgctgcctgcctctgaaggccacgggacttacctgtttgtttgtcaaagcagaaatgcccaacattttgtaaacactaatttttttataactgtaaagatgattattccatacttaaaaccaattcaaaataaaataaatcctcaatacttcttattccctggggtagtaattttaattagattctattgattcattattttctcctgtgtgcctttatttgggaaatactgttagtttaccttgctatcgagtctctttccctaacaagaaaatgtcagccttacgagtcaggaaagcttttactttcactatcacatatgaagaatgaactaaacacctaacttggaaagtaaaacttaaatgagggattcaggacatttcccaaggggtcatctgaccaatttaagagttggtatgatgtgcctaaaatagcaaattaactcttctacttataataaaggtgcagatgtactgattagacatgctgacatgtacatataaaatatgcctaaaccaaattaaaagaaaacaaaatatattccatggcaatcttgaaaagtcagggagctcaatatatattaagagtatgcgctcagccaggcgcggtggctcacacctgtaatcctagcactttgggaggccaaggcgggtggaccacaaggtcaggagatcgagaccatcctggctaacgtggtgtaaccctgtctctactaaaaaatacaaaaaaaaaaaaaaatgagctgggtgtggtggcgggcgcctgtagtcccagctactcgggaggctgagacaggagaatggcgtgaacccagaaggcggagcttgcagtgagctgagatcacgccactgcactccagcctgggtgacagagtgagactccgtctcaaaaaaaaaaaaaaaaaaaaaaaaaaagactatgctctcacaatgagagcattaaacatttggtaattaacataatttaatatgccaaaaatgagaaaatagtcaggatgagggatgaggagtacacataggaaatttttgtgattttcttcattttgattgtattgctttcttgtcttcaggagggaagattttgacttcaaaagtaacaaaatatttaagaagggaattcacatctttctgttctaattggtattcttgcgctattttctcagcagtccatgtttctggataaagtttatgattgttaagaagtgtcagtgcttctacaatggaaattttgcctttgggaatgctcttaatatttatcatatcaaagtgatgacctttcagcaatctgaattcctttggctcttgatgtgtttcagcagcttttacctgcgcggaagacacaagatctttggaatcaacatacacatcttttagaaatggcagcagcttgtcatctttatgagcaatctctcccttaatttctggatagagactaatctgctctcacaggaggctgttggtagaggggtgcctgggagcaggagagggcttcatcttgctgatttcccattctgctcggttctctcggttggaatgcctgatcctgcgagtcactgcagcccccatctcataacatgatgccctcaggtttacgccacttgtgggaacactggcacaggaagcctccagggcgtctggagcatgcacacatgtcctgtgattctttatatcttttatttttatgccatggtacaagttgtgctttacagagcatttgggtgaataactagaaatatgccatagattcttgaggctttgcctggttcactaatgacaggctccagggcgtttctcagggagcgtgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgtttgaggcccacagaaactataaagatgaagaacaggagaaacgtagttaatcatgccctggaaagctggcctgcagaaagaaaaggaatttatctctgagaaggccttcagaaagaaaatgagtaggctccggagacgttcatctgtcttcgtgcagccataaaaagttatcaggtgaggctgaggggtgaaggcgctttctctgatccctgaattggttactgaggcccacagaagaggaaaggacccctgaagccagaaactcccccaaggcaaatcaagactttatggaatcagctctgttactgcaagacatcccctcaaactcccgtctcagtctgtgtgagaagcgtgcatgaattcttgctattttcttgatattttcaaatagcagaatacatgataaacttgtaagtccacagatgagtcggtaagctgctgccatatggagcatgcaccaaagactgaggtctttggtgacagctggaaagactggctctgtctcatttcagcagaatcagaatggattcgaaggctatccagtggaagtgctcagaattgcgctggaaggctggagaaccagaccaaaaatcagagggatctggaaacctgagggctataggctgcgtccaggcgcaggaagtctggcatggtgtcctggacactggacacagctatccctggcttctctctacctcgtgctctggagtcaggcagaaacctttctactttctggagttgctgagaaggttcagtgataccagcatgaagctcctagaagaagggctggtgcatagctgctgctcagggtggcacagcccctccacagtcctgcccacatgtgagttgccccttcacaccactccctaacactgccctcaccaaagatgcaagcctggtatctcaaccagagaggcatctttcaacatggcaagcaagattactccaaaaaaatgccacttaccattcctttggtgtactgcttctagaggcaaagtttactgcttttactgtcatgaaatagactgtgacttgttatttatcatttatgtgaccaattatagttacaatcatgttccatgtgacaatagaatctttccccccttgaacctcacattatgctgagatgtaggatgaagaggagggttgttgaagggtcatcaccgcccccatcctatgccatcagcagtgggtggtgagtagttctttctcttcacccacctccccacatgtgagaattaagctctgaccatcaagaattgagaaaactctcggtatagttttccaaacacacgagtcatattttctaatggtcatcatttgcttatttgtttgatgaatatttattgagggcttgctaagagccaggcactgtgctaggcactggggactcgatggggaacaaaagagacatgatccgtgccctcccagagctggccgagggggcagcagtcagcaaggacgcaaacaagaattctatttccagttgaggttagtccccagggagtagcctgctttagattgggggtcgaggaatgtttctacaaggaagctgagactggcagatgagaaggaattcgcttgccaagcatgaggaagagtgtctcagttggggaggagagctgtatggagccccaaaaggcttggcctcttcaaggcactgaaagaccaggtagcaggaagctggttagcagtgaagagaaccatggtagacctaggcagggtccatgccaggtaacaccactgggcacttacaaaggaaagccattgaaagcttctgtttggagcagggaatggcatgatccagtgtatgttctttaaaaatcgtaggccactgtgtggatggtggattttaggggcaaaggtggaaataaggagctggttagaaggctgcgattttcacctggcaagaggtcagggtggcagaggagacagagcaagtggacagtatgtctatgtcagtgaaggtgcggtgaccggtgccactcacacgtaaggaatgcttatcctggagggctgggagtgatccagtgtcatctcgatgcaaagccccttgcacagcacatccacggtggcactctgttaatagtggctgtcattgcataaagagatggccaaggagatgaaccacatgaaaaatgagcctccttctccccaaatcctcaagtcctggtcagtttactctaaatcaaagtttccagtcgtcatgatgagtatgatcatcatcattattatttttaggcaacagaacccatttctaaattgaaatatgcttcagttgactcaggggtgaggttcctggaactccctcttggtggcttccataccccctcactggacccgtgggctctaaagaagccactgctatggaaagttgtattctcagaaggttgcccagtccatcaaaggctttcactagatgctagttatacccccagtaactatgaacaagatgaaatttttaccctcaagacttccacagccccaaacaggtcaacacacacacacacacacacacacacacacacacacacacacacacacgtgcacacacatcacacccctgcagcactgtatgcatacgtgcccagagtatctgtgctgaagaggtcaagacaggtttcacagaaggagtgacccccgaacaagtattgaaggaatttcccacgtggacaaggaagatcaggcattcaagatgaagtcagatggtgtcttgggctggattctcaagaagcagaccctgagatgagggcatcatgtaagcagtttatttagggagatgctcctaatgagacccagaaataaatgggacaggataggaaagaggagaagggaagcaagggtgagatttcagggaccatcttagctccaccctgatcttgacctcggagttggtcctgcctggaagcaggggagctggggtctcacactcctgtatctgccagtcattggttggggctgttccagaggtagtaaccccaagccactttaccctctaaaagtgaggcaggcctctagaagtgaaggcatgacaaacctgggggctgggcaggccaaatcaagagaggggacccaaaaggatctgggcagagaaccgagtcttggccacagatggaaatgttctgcactcagagcttgggtgctgtgctcagtgtgcgtgtccatgtcccattaagatgaatgacctcattgtgtgaggtgtgctcgaatctgctgaattcctgtgaagtgctaggcatgtgctatgattacctcctgtcactctgacatcacccctgtgaactaggcactacaacttccatcttctttggaacagaggctccgggagtgaaggagcctgctggatgccccacagccggtcagtggaagaggaatttctggccacagctctgcctgttggcgagccctgagtctcccttgaccccttacccctctggcctgtgctgtcctgtagcccagagcccacacacagagcaggtgggaggaatcgcattcctgggtggtagacagctgaccctctgtcttaggagtgacccttggctctaatggcctcaggagcacatcatgctcagacttatttggtggtcagttggctttggaactcttcccattgtgtcctggtccttaactagatgcacagatgtgcagtcaaggggagaatgaagactcctcgggattctccatcgcttgaggtaaatgagctccatccctctctctctcaagagcaatgtgaggattatggggagtagtagatagtaaacctctcagcatggtgcctggtgcatagtaagtactctacaaatgtgatccattaccagtaacaggaattagaaagcccagctcattcctctgcaaactctgacagagaaagggattttggaaacatgacacctggcaggcatggggcatgtttgacatctctgttcatcacagcacagacttacagtgccagtcttgccaaatgtacagtttattttctgttcatttatgtcgtctccataagtctccctgtgcctctgaactggcttgccttctaggctgagttctgagagccatctgaggcatggttctgctgaaaacatttattccagccccaaccaccctgtctccctcctccctcccccacacctgcactggctattagatggaatcagaatcgggtggaaatgtcatctcactgtcacagatgttattctctttccacttcttattttatataaattccttccttctattgagacaagtgtgtgatgttgactgcagagagcatcttgcccttgtcattgaccttcagctggcctaggtctggagttgaacctcctcttggatggtattgaccgagctgtccctccgtctctggaagccctccatccagcagaagcctgggtgagatgtactgccattgtgatcatattctcaggccttgtggagacatgggcattgccagctgttacagtaggcatatttgcattgatcagaacataaaagtttccagaaacacagaagtgaatcaaatagtgtggtttaggttcacccactgcctcagactggaagctggcttctggccactccatgacaccagcttggcaacctcaggtacgttaaattctacagaagcaggcagggtgccagtgtctggacctgtctcaaaggcctgtttgccctcctcaaaggcccccttgagacagatcctcatactccccattttcgtctgttttgttagtcagcgtccagtgtgtgagccctccagccagggtccgcaccaggccatcagccatcccttcactggccagagctcctgccttccccagctcagcctgctacgaccctcacagccactcccccaaaaccagcagacttctcctcctcctcagtcaatcttctcctttcacaccacctcctttcttactgaaagcgtggatctaacctggggaaaccatttcccccgcagccctctcacgggggctttttccttgtactcccacattcagttatctcttctgacctagattcattttgcagtgtactttgcaaaatgcaaatcacatcactgccctgctcaaaatcctccagtggcttctcattcctcttaaggtaaagcatggagatcttactgcagcctccagctcctgtctctccagcatatcatgaacatcttcccgctgcttcttgttcatcctgttggctccagttcactgtccaatggcagtgtctcacccttgccaagttcactcatgccaaagggggtttgcacatcatgttccctctccttggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggttggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttgtatattcatgaatcatataatgaatcagtgccttggttcaggtgacaggaatgcatgcattcatgtctttattgtatacaaatcacagtttactggagtccgtagacaggaagatttatcattaccttaaagagtgagaaggacctagaactgggactctgaagtatacagctgtggttttaaaactctgttttgttggagccatgggttcccttgagtttgttcagtgcagctgaggtcaggttagggaggaacagggcttagaaagaggggctgggtcaggtgcagtggctcacctgcagaactttgggaggctgaggcatgcagataacttcagcccagaagttcaagaccagcctgggcaacatggcaaaatcctatctctacaaataataataataataattagttggctgtggtggtgtttgcctgtagtcccagctacttgggaggctgaggtgggagaatcacttgagcccacctcaagtgattgaggctatagtataggttgaggctatagtaagccaagattgtaccacttcactccagtctaagcaacagagtgagaccctgtctccaaaaaataaaaacaaatgggggctgagtagtctgggttctagctgcccacctaagaagctccattgtatacactgggatgctataggaggttgaaaatcactatgtttccaagagctcagagaatgattaattctgctgaaaacaggagtaaggcaggcttcttgggaaagcagatattggagcagagtctctcctttaaaaaaataaaatggttttacttgcctttaaaatgctcaatttaaaaaatagtaaaacgtagaaaagagaaataatattcataatatcaaaaaaacacctgtttactttaaagggttcctactgtattgctgcaaagctgaagtcttctacgtattagataatctttttattttttattttttattttatttttttgagactcactgtgtcgctcaggctggagtgcagtggcacaatctcaggtcactgcagccttcacatcctagattcaagtgattacaggtgtgcgccaccacacctggctaatttttgtagagacggggtttcgccatgttggccaggctggcttgagctcctggcctcaagttgatccacccgccttggtctcccaaagtgctggaattacaggtgtgatccaccatacccaacctatttattttattttattttattttggacggggtcttgctctgtcacccaggctggagcgcagtggcacagttacagctcacttcagcctcgatatcccatgctcaaatgatcctcctgcctcagctccccaaatagctgggacgacagttgcatgccaccatgcccagctaatttctgtgtttttgtagagacaaggtctcactatgttacccaggctcatcttgaactcctaggctcaagcaaccctcccaccctggcctcccagagtgctgggattataggcatgagccagcatcttctgattttttaacttagcataataaacatcattttcccacattattactatgttttcaaaagtatctaaaatttggaaatcaggcaaaaagatgattacatatcctttcagtgtcatactggagcatcccctcgcccctttctactcaaagtgtggtccacagaccagcagcatcagcatcatgggggagattatttgaaatctaggctctcaggccccattctagactctaattcagaatctgcattttaatagagttcctcatgtgattcttatacacagtaaaatttgagaagcactggtggaggtcccaaattctgtaaagttacctattaacttacggaaggctgataagttataaatgactcttgccagtaaagataaaaatgatttctgtttgactgaaaatatcccaaaggttagaatttattgccttgtagggtattagccagttttgtatttgatttagtaatctgatttcagtaatttttttcctgtgactacacatttttttctggtctttttaaaactagctttgccaccctgctgacttcctcaataataaattaaataaatctttgccacgtattcactatatatttgtatgagaatcatgtttttaactttttgaaaattatgctttgacaaccagctttctgtcatcatttttaatagttctgtggtattctattttgtgattgaccatagtttacttatctattgccctaatgttagacacttaggatattgctaatttagtaccaatataaataattctgcagtgaacatctttgagcataaaactttttccgtattttatatttatttcctttgagtaagttttcaagtactgaattaatggatcaaagggtatgaacatttttattttattttttaattttttatttttttaagacagagtcttgctctttcacccaggctggaatgcagtggtgccaccttgactcactgcagcctccacctcccgggctcaagtgattctcctgcctcagcctcccaagtagctgggactacagacatacaccatcacacctggctgatttttgtatttttagtagacacgaggtttcaccatgttggccagactggtcaagtatgaacattttcagatgagcaataatgagcttgtcaaatggacaaggatggaagggcatttcaggaggcaagagcagcctgcagagaggctggggaccaccggtctcacagaggagaggcctctaactggctagaatgtaaatatgtgtcctgggagcagctggaaaggcaggaaggagaccagagtatgaaggccctggtgtcctgaattagatgctcagcctaaaggaaagtcatggatactgtaaaccgagaagtgacatgatgagacctgtgccttagaaaaacaactctatcagcaaggaggcctttccaagcctcctgaaatagtgctggtgagagaagacgagatgtgagccaggaggtacctgggatggaaacaagaggatggagagaaaagttgtttagaaaggtgtaggggcttaaccaaggatcacccagctcattggtggtgatgacgggacctgatcatcagtgcttcttgcctctccatgtcgtccatgctgctgttccttccttagagttttgttttttaatctaagatatgacttcctagagctacaggacactcagctcatcactcacagatgagtttgagagttgtgatgtgagagaacaggctctgccaaagcatggagcacgcatccaaggggatgaacagcatccctaaaaataataagagatgaagcccacattccggggaagtgacagggcattcttgtggaacttgacagactaaactgtagctgctactttaacctctgtgtccacaaaaccagacctccaacgtggcgttgctggtatgcagatttcagtgtccctaagaagccatctgggttagcacagggggctgggttttacagctaaccccgctgagctcagtgtctcagtctgattcatagtcaacaataaggtttagcagacttttctcacacccaggtgctttcacagaactgccacatttccctatcagaccgccatttcacagaggaagagaaagttggttgcctacggttgcaccaggaccagattaaagccagcgctcctccctctccatctttcctaacagttcctcacagttcatctgtacaagacaccatgagagattccaaatgcaggaagtgatttgatccacagctttttaagggcaggaacccaaagacatgagtctgtctgcctttaaagatgagagctgctcatttgaactagatagaaaatagtggatttaggatgacagacttcagagcccactctgtcctaccacctcctaccagtaaatgttcttccctgagaattgcctattatctgaaaattgctctttttaataaccccaagctggaaataatctccatgcctatcaataatagcatgaataaataaacagtggtatgtccacacagaggaatactgtacagcagtgagagtggacatgccacagcctggagcaatttcccaaacataacagtgagagaaagaaaccagatgcatgcctgtaatcccagcactttgggaggctgaagcaggtggatcacctgaggccaggagttcgaggccaggagttcgagaccagccaggccaacatggtgaaaccctgtctctatgaaaaatacaaaaatcagccgagtgtggtggcatgcgcctgtaatcccagcttcttgggaggctcagacaggagaattgcttgaacccaggaggcagaggttgcagtgagttgagattgccccaccgcactgcagcctgagcaacggagcaagactccgtctcaaaaaaagaaagaaaagaaaagagaaaagaaatgaaaccaggtactgtagttcatacatcatcattccattcatagcaaggacccaaagaagcaggtgatgctaatccaagctgttagacatccttggtgggggtggggactggaaggaagggggaagggagcttctagggagccggtcaccttctgtttcttgatctgagtgctggttacacacatgcatttagcatttggtatgtgaaaattcagcgagctatacacttaggatacctatacttttctctatgtatattcgacttcaataagtaatttttaaaaagtaaaaagagctgggagtggtggctcatgcctataatgccagcactttgggagctgaggcacaagaattgcttgaacccaggatgcagaggttgcagtgagctgagattgcaccactgcactccacctgggtgacagagagaaactctgtctcaaaaaataaaataaaaactaaaaagtagccagccatgcacaacctcaaaaaaaactccctacaatgatgctaacaggaacactccatttgtcaagggcggactctgtgccagatgctatgctggggactctgtgtgcattaccccttttcaatttctgggaaggcactgttctgctcctgtcttgcggatgagaaaactgaggctcagaaactgtggtggcctgtgtgtccatttgcctcatcccctggcacacgcacacactctcctaccccagctgcgggaatggaggcaatgaagtagaggtggtctcattttctttccttatcaccagggaagagccagtaagtaattcattcagttgacaggtagcctataaagaaggccactgtcaaccaggcactgcagtgtggtgatgacaagctcagatttgggggtttggggttggctaagagctgggttcaaatcgtgactgtgcatttgaactacacaatccagagcaaatatcctctctggacctccatgttcccctctgtaaaatgggtgtggaagacctcatagggctgttgtatgacttagacaagagattgcaaaaaaaagcataaactgacacagacaatattcaataagtgttagagagggatggaagccaggccctaaaaaggttaaataagcagtgctaggcattataacatcagtattgtgcccagtcactgcttgggcttgagcaaggggctggaccagtgggcttcagcgatcagtgaggcttcttgacagaggattgaactaggtttagaaaagactttcccaaaggggaatggacattccaaagagatggcaaagcttggagaaagacctgtggttggccagcctgtctggagccaaaggagagaatgactgcccagagctgtgatttttttgtcttttgcagtgaggagcttaaatgggacagtggtgtattggggagagttatttggtagcagaagacgcaatagatgctttgaattctgcaaaaccaaactcccctgtgaccagtggggataaagcagagccgaaggggacaatcagaagtgagcactgatacatgtttaacaatcagttctctggcaggagggtaggggtgccctgatttgtttgccaaatactcccaccatagcccatttcaaactgccattgcaatgtcactaggtacggagttaggaagagatgcacagttgcctctcatgagctgatatgagccagttccacataccactgggtttcaggaaaagttgggaaaacttgcctcattggaacatgggctccaattgctgtggctcccatgggaaactacagtacagcctctcgaacgagtttctccaatgtgctaggccctaccatgagacccaagacagactgtgtcctaactctagtggggtccacagtctactggggaaactggcattaatcaaataattcctctaagtgacacattgagctgaacacttggaaagaagagctgccttacatgcagagcactcccgtgttctttgtttcaaagctgaaacaaaaggtacattgtcgttatctgttctgaatcaagaacatagtgtgtcctctaagtttttcagtacacttttgttcacttcatgatatttaaatcagggttgttgtcattacaaccctttcaagacctagggcttggatttcaagtgccttttcaggtgccagtgaaaaatccatcagtttgcaaccagaaaatcgttcagcggagcttatgtatttatttattagtaacaacagtctggatacttctctgtagttctctccaaatgtcaagcccaggctgggctccatcatgctctgcgcacttctgtttaggaaacgttttcagctggcactgtggctcgtgcctgtaatcccaaaactttgggaggccgaggtgggtggatcacctgaggtcaggagttcgagaccagcctagccaacatggtgaaaccctgtctctactaaaaatacaaaacattagccaggcacctgtaatcccagctacttgggaggctaaggcaggagaatcgcttgaacccaggaggtagaggttgcagtgagccgagattgtgccattgcactccagcctgggtgacagaacaagactctgtctcaaaaaaaaaataaaaaaggaaatgttttcactgttgcgttgcctcctaggtggtcttcgaggccctgcacaatctggagccccgtggctacgtcgtggggtggatcatcgccatcagtttgttggtgggaatcctcatcttcctgctgctggccgtgctgctctggaaggtgagtctggtgattgcaggtccccctggggtccccactcatagatgcccagctctcctgcctttccagggaagaaggagtatcctgttagagcttccttcatggcaccggtacagtgaaggacagtgacccttcaggcagggagtggaatcttggctccccttgaggccattcacaactgaggatttggaccacttcagagtgaaggcaaaagtctcagttctctcttctcttaccttcccttagagccctaacataggatggtgagaacctaactccaaaacagaagtctggggagcaactgccagaagggggcgatttcccatttgcttaaaaaagatcagaaggcgaactatagaacaattcttccttcttttcctctaaggaatgtgaggaagatttctgaccagaaaacttgagtaactgagatgggctacagtccagagtagcttcatcataacttctcccaacctcatggtggttcatttggaggtggcccagggtgcagacctgtcctgcctcaagcatcactctctcaaggagaaaggggtgtcctcatccccatgtctaggatgatttgtttgcctcacactctcctttcagagacccggagtccttttccttcagagcctctctattcatcagtaatggtattggaggctttagctgatgaaggtctgtctcttccttgtttccactgtgtccccagctccaaaacagcaccagggaccataactgcaacttcctgacaccaaagtccatacttctctagaattacaaatttcagatgtaggtgaaaacagcctcttagagtattatagatggatattttaaaataagacaactaatttctttgggattacaaaataatatgtatgtattgacctaacataacatatcaattaccaaaaaaagttgtaaaacaccaggagttcacatcccagaaataaccatgatgagcatagtattgcctcattttgacctttttctctgcatatatagatatagaccaggcattctcataacatcaacttatttttgaatagtgtattagttaaattttacagtaatatactcagcatattttcaggtgaagtacctctaaatttaaaagcagtgggttcctttttttttttaagtatggggtcttgttctgtcacccaggctggaaggcagtggcacaatcatagctctaactcctgggctcaagctgttttcctgcctcagcctcccaagtagctgggactacaggcatgcacaatgcctggctcatttttttatttttttgtaaacatagggtctcactatgtttctcatactggtcctgaactcctggcctccagctatcctcccacctcagcctcccaaagtgctgggattataggtgtgaaccaacgcacctggcctggatttgatttattaatctgggaaaaacgtatacctatttttccctgaagacagtactgtgaacatctttccatattgttcaaagcacgtttccagcacatcttaaagctgtagagtgtctgcagtctactcatccagtcccctgatactggaatttaggttgcttctgtttcacacttcttttaacagtgccacattaaatatccctggagccaaatatttgcacaaatctttcattatgtcgttaggttgaaagcctagaaatagaattgccatcaaaagggagtgtatattttaagctttttaaaaattatatttatttttttattttgagatggagttttgctcttgtctcccaggctggagtacagtggagtgatctcagctcactgcaacctccccctcccgggttcaagcaagtctcctgcctcagcctcctgaatagttgggattacaggcgtctgtcaccacaaccagctattttttttttttttttgtatttttagtagagaccaggttttgccatgttggccagggtggtcttgaactcttgacctcaggtgatcctcccgccttagcctcccaaagtgctgggattacaggtgtgagccaccccgcccggcctaagccttttattactattgcagattgccctgtagaaaggtcataccaattcaccctcccacaagcagtgtatcagaaatgtctgtttgccaatagtggatgttaccttttaaaaacaatctgccaatttgttgtttatttaatccacatcgccagatagattcttaattctcctttttctccaactccaactccttcctgctgagacagcctctggtttgtgggtggagaacaaagcctgctcagtgtttggcatctgaaaagacaaggcttcttgctgagttgagggctttggtgcatgagtgtgtgtgggtgtgtgtgtgtgtgcgtgcgcgtgtgtgtgtgtgtatgtgacttccttctgcctttatatgggctcttaaaatgagaggagctgtgtcctttatggctgggtgtgtggaaccagacagggcacagagtggggagtgttgtggccgtgccccacttccccttatagtctgcatgccctccttctggccgccccacctggctctgcctctcaggggtgtcctgtctcctctgcacagcccctgcctcctccagcccaccacctgctttgccttgcttttgctgtgtttgtttaaaaaagcatggttgcaggagatgctgtcatgggtggggagaaccctgaggtcacccagctgtgtgggatccaaagagccaggacctgagaaggcagactctgccctctgccacagactgggagggagagggcagtcacggccgccagggacacaccgtgtgcccagaccagggcttgccgtaactaacgggtggcaggaaagctttgaggaggctgttgaatgaggccacctgggtcacaacagctttgctagtcaacccagagcagtatctcatttcggctcacatttctcgaacgcttactttgccccagtccttgctttgcctggactaggcactgggatgcagcaataactgtgcccttccctgcacttgaccgcctcaccacctagcaatagacctgcaggcataatggagggtggtgagtgctgcgcagtaactgctctggaaactgagaagaaggtgccatgagtccccctcccttgcccccaaggaggagggaggattaaaaggtcacagagaacagtgtggtagatgagagcagctttcaggctgacagctgtgggcagcaatcctgactctcacacttgcctgacatgaggccttaagggggctgcttaccttctgtgaccctcagtttcttcctctgtaaaaaggagaccatcacctccagtttggtatgtagaggttatgcaaggaaaatgtttagcactgcgcttagcacacagaagccaggggatatttcataaatgaggtgtcattcgagtctgacctttagtgtggtttgagttttccaggcagggaagggtagatgaagattccatccagagggaaggaagaggtgggaaaataagcagggtttgtggagagcagcttgtaaagtttgtcagggcagtcactgacctgcagcaagaccgtctgccacagttgtgaaggccactgctaaccaggacaaagggggagcatgggaggtctgtgagcagagcggtggcatgaccagatctgtgtcgagagagagatctggggctgggtgcagtggctcatgcctgtaatcccagtgctttgggaggccaaggccagaggtttacttgagcctaagaatttgaagttgcagtgagctatgatcataccactgcaccaggtggtagagcaagaccctgtctctaaaaggaaagagagatctagggacagtgtgggggcaagagtagggccattgccatgggtcaaggtaggacaggcagggtttgctgaccagttggacttgagaggtcagggagaaaaaaagaatagctgtctctccttaagataagttcagacaaaggatgggtgcccttaatcagggtggggaaggcaagatgcgaattagtttggcaagaggaggagcttggtgttgggctttctgagtgagtggtgcttagaggaggctaggagacaaggctgggcttgcctcactccctgtcgcccccacccagcagaaggaaggtcaacagaaggaagccccttctctctacttggctacacatccgcatcattctcttcccaccgcagaccagctttctctatgtttccctacacatcgtagggagatagttgcctccagcccctccaaacttgcatctcaaggactactagccacagacgcagaatgatcagccacctctgattcctggtcccacatatctgggagagaggatctgcctggcccagctctagtcaaatgtctactcccatcaactgtggaagggaggaagggagttgggagggagagaatccacctggcccaatgtgggtcatatgtctcccacggaggctagtgggggagaaagatgcaggatggtggtttaggggatactggggaggagactctcagaaaagaaaacaattaggcaggcaccccaaaggagttcgctcctgcaggatttcatcgttgttagtgctgctgctgcctgaattgcaggctgttgtatcataccagctagctatgctgcatacaaactgcccccaaattgaatggcttttcacaaccattacatctgacaaatttctgggtcagggatccaggaagggtttggcggggtgattcttccgtcccacatgacattgagtgaggtcacttagtggcatttacctggtggctaagctggtcttcagagttcaagacagcttcattctcatgcctggcaccttggtagggacagctggaaggctggattcagtcaagtccttcttcctctccatgttgactcagggcctctccatgtggttcttccagcagatggtctgactttttatgtggtggcttaggctgaaagagagcgctgccagttgtcttaaatgctagcccacagctggcatagcatcatttattctgttggtaaaagcagtcatatgccagctcaggttcaagagaggggaaatagaccctgcttctcaatgagaggagtggcaaagccttagtggctgtcttttatctgtcacatacatgatgttcgaaatatgggcaaaatcttttctttttttttttttttttgtggcagtcccactctgtcactcaggctggagtgcagtagcatgatcttgactcactgcaacctccacctcttgggttcaagagattctcctacctcagtctcctgagtagctgggattacaggtgcctgccaccaagcctggctaagttttgtattttttgtagagacggggtttcaccatgttggccaggctggtctcgaactccaggcctcaagcgatctgcctgccttggcctcccaaagtgctgggattacaggtgtgagccaccgtgtcttttccctaaaagtcactattacaaacaaaaattcgcctaactagaagttttgttctattttaaagtagatgaaacctcatctctctcccatagtgtcatagataaaatcacagttgaactcctttggggaagaggaggcaaacagaaaatgttggtgcagcatttatgtcagagtgtgcagtctgttgaggcagtgttgtaatgtgataaggggcttggtggaggggatttctttagggaaaaaaatttttttttctcaaaaggctaactatgacttttgagacttataaagtctcaaaagactttataagaggttaaaagggcaattgaaatgtaggattattttaaagacctacgtatttctagaacttcaactacagacctcttgttaactctgattcccatgtctacaacctaagaatgatacattatgtttagtgaatagtgattcggtatcacactgacagtacggtgcagtaacccaaagacctgttaattgatggtctaaactccagcctcatatttgacttatacgggaggtcttaatgtttccggcttattgccatattccatatgtaatttcctccattcctttcaaggggaaagccactgagtgttacccagctgccactgctgaccggttgcccacttcactgagggcctttgaagacagcggttggcggggacagtgttgaagtcctcttccctttacagaaccgtggctcttgaatgtccttctagagtagctcttggcattgctacctatggtcatttgctgctgccttgaggtccggagccaaaagtggttgttcccaaaagtgttgcataaacgtgaatcgtgacatggtactgaaagctgagcagagcagctggccatgccgccgcattcacagcaccacacaagcctgaaggtctgcatgctttatgcttgcaagatggccagcaccttcactaggcaaagagtagtaggtccctactaggtggcaggccctgggcaaagggacaaagataaataaacaacagccctcacctagtctgtttcttttttttttttgacagagtctcactctgtcacccaggctggagtgcagtggtgcagtcttggctcactgcaacctccgcctcccgggttcaagcaattctcctgcctcagcctcctgtgtagctaggattataggtgtgcgccaccatgcctggctaatttttgtatttttagtagagacagggtttcaccatattggccaggctagtcttgagctcctggcctcaagtgatccacccaccttggcctcccaaactactaggattacaggtgtgagccaccatgcctggcctcaacaacagagccctcacctagtcttgaagacctttaggaaaatcagcttcagcaaagccctgaaggtgagcaggacttggcctgtgccaccagcccctggccccacctacgcatgcactgtggtgctactgtttacctaaatcagaaagcccttatcgtgtcagcaagtgtcttttccagagctgagctccaggctccctgctgatgtgctcagccagaccagcccctcatctgcctctgaccctgtgcagctcctggcggccttcaagaaagcccatctgctggcatctcaggcatcttctcatgcttggcggcagcaggccctggctctgacacaaaatccacaatgagggccccaagctaaccagaccgctcttcaaattctgaaatggatcctaatcagctttcccaaagctgagatgttagcagacactgggagccataatttaaactttatgtgcgaggattacagtagccagccaaaccaccatgcaggaagaaaactttgaaatatgaaatgcttttaaaggaagaaaagtccaaatgagtcccctctcctttcctgcagctcctgactgggttggaagatgcctgggcctggcatctcttcaagacaatcataaaggcctgtttaggaggagaaagttaaattgctcagaggtgcaggagggataacaactttgtgtgtgactggcacctttaagaaataccttcagcttatataagccagcctggtttctgtggaaagaatgaagatgatggggtgtttctccttttgaagaaagacaccccccttcccttatttagggctccaagctcttccctccctgtctttctctctgcttccctctcaccctcctcccctccccagctctgtccttgtttgtttgcagtttgccaaaacatacaggccaccactcagtgaaggagagagaccatatcctccctcactgctgtcaaccaaggaccctctctctcccatttgacccttttgcaaaccgagatggtttggagcaaagggaagtgagactgcttggccagccctatggccatgtcttcccaggaggcccaggacctacttgctcaagtggcaaagagacaggctgcagaatgtgtttgccagccctctgaaaagggctgcctcaaaccctctatcagctggggctgttccaagagcctgctgctttaggactggctttgggctcatggtttttatttgagagcattacttctgacctaaggcagaaacacttagaaaacaaatctgtgaaatggctcagagaatgtgtaaggtttggcaacccctccagaggtcactgggttatcaccttcccttcaaactgggctgggagggcatccttgcttctcctccaaagaaaaaaaatgaacagacacatgcccatgtgcttgcacacacacccttcacactgcctcaattagaaccatgtgccaatgacattcagtgggggcttgtttatgcttgggagtaaatattgggctgatgttgcactgtcgacatctcgagacagagacatgctatgtaaatagtcaagtaactgaagagaactataaacatgaagtcttgagttagtccaaaaaaggaatttgtcccaggtcctcagaatcactgtctaggaagcaacccaaaggccgcggagtgggtaggatcccccaagagaccagatgtcatggtgttgtccagctggtccctctcaccctgcagggggctggggaggaagaggctgctgctgcagggtggataccccagaactcagtcaggcctcatgcctcacgcagcacccatctaagtaaggctgtttggggcaatctgttgtttccctaggagttttctggttgcttttggatacatggttatatgagaaaattgtgtatgtctgttacgagggttcagggagctgctctttggagctgcaggaccagcagacacaaaaaccagaaagcacactgttccttcggcttccagccaagcaaagcttggcttgagtcacctcctctagggtttctatgtttcttctgctacagatagaacagttaacagagccgcttgcccctcaaatggtgaagcaagcactggaaggttccagaaaaaatgcagaaaaacattgactccattggcttggaagtgagtgtggggctgctgggcatccagcttagcccatcattaatcatttcccagcaccttcagggtgggctcagctggcaacaaaaacagagatttgcccagtgtttctcaaagctctccccaaggcacccatgcgtgctcacatgagcgggtgtgtatgtctgaaggaggcctacttaaccttgggatgtgctaatttcccaagtgtagggggactttgggtcctggcagtaatggaataggtaggactggctatgaagtactatagcaggctgaaggggctcgtgggtttcctggcatgtgtatgaagagttacagatttagaccatgtatctcttaagcaaaggaactacaggtgctccttgacttatcatattttaagtcagaaatgcatttaataccccaataaacccatcataaagtcaaaaaactgttaagtcgaggtatggtaacttggggattatttgtacttgttagatcatcaaattcagagtcactatctttagtttagtgtttatctttagtctttagtttttatattttatctttagccattatctttagttgaagtcattatctttacttaaggggatgacaaaaaccttgctaaatttagtttttcacttcctcattcctgattgacattctattagaaaatgttagctaggaagacctgttctttatttattgacttgcatttattgagaactgttgggaataatattgtgcctctagggcatttagaagataacatgcttttttctggttcttgcaaattactttcggtgacttgttctcatgggttgcttattttgagtttttatttttagagaactgatattttttctgttcttgatgaggtaatcaggcagtctctatgttacatgagttaagagtcctagacttacttagcaagtcctcaattctgacacttattataagacatctgatccagagctgcatgttcaactccatcaagccttgcctactttcctcatcggtaaaattgaccttaaaatcccacagttcaaaagactataaaagttaaataagtgaacataactgcatgtgttttgtgaattcaaagacctcataatcttttaaaatattattaaattctgttttatttgtttctttcaaaaattaacagatttttaaaaattgaaaattgaattttcaaaaaatttctcaaaaatctttgagaaaaattgagatgggacaaagactctgtgccttgttcccccttagtgtgagtcctgagtacccagctgtgtggcccacagtctagagccttgaattcactttggggaaaacagaaaaagctgtcatgatgtttcagggctggaagaggtctgagaatcccattgatctcttaggcagagacgaagacactatggctcgaagccagaaaataaccttcccaggctgggcgcggtggctcacacctgtaatcccagcactttgggaggccaaggcaggcggatcatctgaggtcaggagttcaagatcagcctggccaacatggtgaaaccccatctctaccaaaatataaaaattagccaggcctggtggtgcagacctgtaattccagctacttgggaggctgaggcaggagaatcgcttgaacccgagaggtggaggttgcagtgagccaagatcgtgccactgcactccagcctggcaacagagcgagactccatcccccacccccccaaaaaagaaacaatattagtttgacagagccaccactagactatagggtacctttgtgcaaactataatagtaaatagcaccgcttcctaaagactctttacttccatctgtcagaaaaaattcagaaaactctgattttatgagaacaagacactctactgccatctgttggaaaacagttataataaacttatacacatacatgatatctgtgatgtgagtggtatcccccagccccttaaatgcagtgtagcacctgcactactgtacctacaactccctagccatgagagtgcattatgttttaagaaatggtcttcagactctaaaaaaaggaagacatacatcagtggtagctctgatctcccatccaagagattacgcataggctgtgttaggaacaggactggagaccctgcagtgttagagtggggcatagagcttgcaaggctgtttcagccaggggtgggtgggggtgattttcaggcctaatgctgacaccactccactgagagaaagaagcttgcttccgggtgcctgcaagagatgacagtgccttcaccttgttgttagcaagaattgcatacataaaaacttgagcacatgaaagccacatgtaagagtgagttcaggtgctctaaatcctttccagattgttaacacactgtctatgtcaaatccttacactagcatagtgatgagaaagtgagccagcttttgctcttagagatgaacaagagaagtctggttcaggccgggcgcggtggctcacgcctgtaatcccagcgctttgggaagccaaggcaggcggatcacttgatgtcaggagtttgagaccagcctggccaacaagatgaaaccccgtctctactaaaaatatgaaaattagctgggcagggtggtacacgcctgcagtcccagctactcgagaggctgaggcaggagaatcacttgaacctgggaggcagaggttgcagtgagccgagatggcgccattgcactccagcctgggtgacagagtgagactctgtctcaaaaaaaaaaaaaaaagtgaaaagtccagttcagcaaggcacactaactgatgctgtttaaatctagagccctatcagctgtctgtctgattcattaagtcagcaaaaaaaatattgagtctgtaccagttaacttatgctacttgacaaaccaccccagtattcagcggcttaaaagcaatatccatctatgcaggtcacagttctgtgggttggctatttggactgagctcagtggggcagtttgagctcagcgagacttacatgtgcctctgcgggcagctgggagttggctagtctgggagggcttcaaaaaaaactggtctcttagcaggttagacataggcatttgtgtggaagcagggcagggttctgagaaagtaattggaagtgtgcacagccccttggggactgtgtaacagacacaacatctcctccctctcatccaattgtcaaagctagtctcagtggagaatcaaggctgggaaaatagactccacctcacgatgggaagagctggagagtcacatggtaaagggtgtggagggtatgtgggcatctttgcaatttatcgctggtaccaaggacaggtgagatgctgagtactggggattgaaagcacaaagcctgccttcaaagagtcctaagacaaatgcaggagataataagggggcagactgttaagtttctgcttgatagtgccatggtagggaaatgtgacttctctggaattacaactgagtgacctgggattattgacacattacaacatcagcagccaaaggtatgtgctagagaatcctatttccctgttacatccttccacagtttcatgattacattctccttcatggcatgtgaccagccacatctggccatgttttcttagccaaccacatctttatcgcaaaagaatgacatttcaagcagtagcttcttagatttccattcagtcttggtccgtttttctggccttctgtgggtgtgctgtggggatgatgtctatgactttttcttaattatccagaaaattctggccaagcaccttttcttgcagaggggagaaggtgaagaggtttcaggagagaaaagtatatgtgtgggggcgtcagaacatggcattctgatgaatgtggtcttatgctgggaagaaacctccagggctgaaatcaccaggaactcaatatctgtttacaaaactggccttgaggattgaagctcagaacacaagactcttgccagttgttctaagaaagcttctgctctttcccagtcattcaaactgcaccaccttatcgacttcccctcacggtgaatgctcaggatctccttggcaacgtgggtgaagatacctgctggctctcttgacagttctcgtctttggcttggccaataaaccccctttagggaagtagaaagatggtggcaacagacagctcctcagctccacctgccttcccttcttcaggggagcttatgaccatcagggtggctgtgatgcttccctggatgtttggctcacagtgaagaagcatgaggacaaatacacagacaacaaaaacatttgatgtgcccatgacagctgggtttgcttcacgatttgtgtaggacacgtcttatatgtgcatgcactgttggcagcagactgcagagagtcttaagggttttccaatatgacttgggaattgcaagctgatgataccatggtaccacaacctgcagtgtggcaagcctaccagcaccaggtcaagtgtgtgtctctgtttgatttcctctattcaaggggattgaaacaatgatttgagggcaagtcatttatttggaaggtgatctcaggaaaaactgttggagagcagggaaggaagccaataaaagatttgtcatcaagctggttacctctgcaggcaagctccatggggaaactggtagaacgtacacctcagggttatcccacccaaggagagagggagctggggtatttgtacacccgatacagtcagccttgtttaaaggaagatgcagagaggaatgtctgacctcataaacagagcccaccaatgttagtgagccaaggacgagagatgccgagtctctcagagcatgggaggaaaggtaagctttgggctacaaacgttgcttcactgtttggtggtgatgactatgtgagaaaaactagacacttgtcttaccatatgtgaaaagttgtaagaccaaatgtaacatcaaagggcagggtcttttcagaactaagctagaggaaattgccatcctgggtcaggatgaaacgcccgttctaagtgagaatgtgctgctgactgtggtgcacagacagcacaaattccatgggtttgagagaaagatgtaaatgacagcaaggtagaatgcagacctgcagacgctttaaacagcctctcacgtgagagcagtatttattaaattattccacagatggctaagatctctcaagatactaggtttatcaaaagccaaataagcttggggaatgtcaggtccctggtttttttccccaccggaattaatggtaatggatcctttactttccactgtacattaagactctctaaaaaaaaaaaaaaaaaaaaaaaaaagccacacttcccaaacttatttgaccatgaaactttttttttttttttttttttttgagatggagtctcactctgtcgcccaggctggagtgcagtggtggcacgatctcggctcactgcaacctccgcctcccaggttcaagcgattctcgtgccccagcctcccaagtagctgggattacaggcacacaccaccatgcccagctaatttttgtatttttagtagagacagggtttcaccatgttggccaggctgctctcaaactcctgacctcaagtgatctgcctgtctcagcctcccaaagtgctgggattacaggcgtgagccactgcgcccagccatgaaacctttttttactcccaaacacctttgaacagctctcagtaactggtattccccagcacacagtctggaaaacactacaccagatgcattttagaaggaacaaacagcttacgtaatatcacccgcaggaagtccatgcattttgaaaaatgtctccacaggatgtttttcttgccagtgttttctctaatccgaggggtcctccaagcctccccagccctgtgagtgcaggtcacacctacccagggacagactgccttggggtcacaatggctgattcttcagcacttctaactcagcttctctttctttctgcctttcagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctgtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggaactccggaggaaaagttaggcctcagaggtgtcccaacctgaatcaaggggctggctgcacccagaaggagatgtaaacgttttattctcaattcctgctggcgtaatggctccagtagctcaggacagtcctctaaaggacaaccacagatgcatcctcagccaggggagacacagggaaatgatgcaaaagaaatgatgcaaaggatctgagcagaacactgcccctccccaccccctgaatgtgtgagtgctgagttacggccttcagtatccaagctctctgtttgacagtagatatattgtcagatgcactgtgctgcttagttttgagtgcagtgtgattttctgaaagggcaatgagatgatggatgtagcatgctcagcactgacctggcccatagtgatcactcaataactgttaacagctatggctgctattcctactgatggataaccatctaataagacagaaaacatggggctaagagcagggtctaacggagtcttaatggcttattacagcctgccaaagtgccagctacatacacatggcatccagtgcggatgaaacaatctataaaaccaagggtctttcttatagcaccttttttactggaagctaacacgttgggagtccgtgaacattgtcaaaaagacatcaaactcaacttctgggaagacagatttttaatacacatacttggctaatactcacaaacatatctaaagttttggcaaaattatgagggtgatgggtgggtactaacctggcatggagcaggtgtgtcttttggtttcttatgcagttgactctgctgcagggagattacagatgtaacctcatgcttctcttcctggtgaacatgggaatagaccaaaaaaatcaagggtcaatggcatgaactaagctgatcctggaaatcagggatgttgcatctaactgtgggatggaggcacagaggtagctacagggagcaggatgaggcaaagaaagcagctgtcactcagagttcgcttatgagttttatcaaaagcagcaagaaaagcagtcttgggtgggttttatcacttattaacagccatttatgaggcccctgctgtgtgtcaggcactgtgcaaggtgctggaggttccccagagaacacttcagggacattttgcctcagggtggcaaaatgcagtggcatgtggactttttg

SEQ ID NO: 12063 - DNA, 93493 bp, Human
ggctggagtgcagtggcaccatctcagcttactgcagcctccgccttccgggttcaagcaattctcctgcctcagcctcctgagtagctgggactgcaggcgcatgccgccacgcccggctaattttttgtattttagtagagacgggatttcactgtgttgcccaggctggtctcgaactcccgagctcaggcaatttgccggcctcagcctcccaaagtgctaggactacaggcatgagccacctcgcccggccttttttttttttaaacacagggtcttgttctgtcactcaggctggagtgcagtggcaggctcatgacttatcataacctggaactcctgagcctaagcgatctatctacctgccttagcctccggcatagctgggactacaggcatgcaccacactcccagctaatttttaaatttttgtagagatgaggtctccctatgttcccctggaactcccggtctcaagcaatcctcctgcctcagtctcccaaagtgctgagattgccagcatgagcacctggacctggtccaataaatattacaaattcgaattaggcatttcactttcatttatatacatatcctttcacaggattatttgatagttattaatgtatattatgattgagttttaatagttactttgggaaaacagaaattactgttccagtacttacttgtaagttgtaagtccacacaatgcacttaaacttcaccttgttcaacagattctgtagcacatgaaacacttgaaatatggaagagtcacttctctgggcactttgctcatttcgtctgctattcattcactgattggacattttattgatcgactactatctgcttggcaaggtgctagaaataagaacactaagaaaaaggtcaaggttcctgtcctcaaggccctctctctcagtccagtgttgtcaaggcttgatgaaacacaccagtggcaaacaagcacgcggggccttatttcaccggtgtgcggtccttcttccagctctgaaattatgtctatccaaacatcctaaatcaacaaatcagtgtttctaaatcatacaaccgcagctaacaaactgggaataaggcttcgattattctgacttgatttaaaacgatcactgccaattctttgccctgcgaatcctttctttgactactaagttaagctttacatacctcacttgcaagaggctatgctggctttctggaaatccgtaattaagttcagtgtttgtggaatggagtgtaattaacgaccattaattaacagggtttcgttcgtgagagcctgccaggctaagcagcagaaacacgagaaactgataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcgtaagtggccgcacttggaactggagccggccccctcccccaccgcgcgcacccacccagcgtttctccattgggattgatttccgagagatcccggcgtctgtctgtctcacccatcctacctctcagagtggtttatatcctgggtggaggaaatatttggggaaatgaactccctttggtacccatcacccagttacaccccgcttctcacctcttaaaattggttaggggcagcgggagagctttgaagcagacctgtgcttaaaaatcggggaaagtgggaaatcaacaaaggctggtcttgccggactccccgcctcctgtgccagtgtcgaggatttggtcaatatcatccccgaacttctttttctcctctaccagttaggcttcttggtagcctttttctgctttacaggcttaacgcccgtccttttcagtctccctaaacaagccctcccccactctttccgcctctgtctgattctgtttctccttactccttttgcagacattctgatgacttaaaatgaccatactgtcctattgaattcattgtgtcttatctctgggactgtcagacatttgcacatttgaggttgaacagatgaattgaatgtgtcatctgttctttttatagtgattcactatttaggtcattgttcagaaggaacaagggtgtttgctgagttttcactcgctgcaggtcatttgaatactgcagtatttaataattcagttatgttttcaagttgccaacgttccgcgttgcaagggccgtcaggatttataacagttattgccattattgtgttagaaattgtctccgactttactgaatgctgacatcattctcaccaccccacccccgtgttagcgttaggagtactgttttaatgaatgttgactgtttttttaatgatgtttaaatcttgttttcaagagagaaactgttcttagggtgccttctaaacgcttagaccttgtaacaacatatttttgtttccatattttctgtataagatatcccttcggggtgaagtggaggaaaattttgacggttagtacgtggataggaccatcttctactacacacatgcctaatttgagggtggtctcaatggttttctatgactgttaggacactcagcagaatttagtcttagtgtttttctgaatgttactgagtatcattcattttggtaacaacctttgcagcaatacatagattagatgcagttaatggaaactttgttagtggagacattattttatgtagcaagcttagttttatttgttgttagcagttacagtgctttctgtgagacctggagcacagattttccaacatgataaaaataatcattatttaggcaacatttaccaatttcacattccatttagtcattttagtcagcattatctttttatttattgtttttaaccacaggggtgaataccaaacgttatctttaaacatttttgtttccagatactttcaagtgtataccttcatgagacagaacattttagttgctcccaagggttcaatgtgagatataatttgtagagaaattctaatgattttgaaaatatatgtcttcagtcaaaaattagcatttaaatacttcaggccaggcacagtggctcacacctgtaatcccagcaccttgggaggccaagatgggcagattgtctgagctcaggaatttgagaccaacctgggcaacatggtgaaaccctgtcactacaaaaaaatacaaaaattaaccgggcatggtggtgcacacctgtaatcctcgctctgcgggaggctgagatgagaggattgcttggaaagttgaggttgcagtgaatggagattgtgccaccacactgtggcctgggcgatagagagagactgtctcagaaacaaaaacaaaatcaaaaacaacaaacaataacaacaacaaaataaagttgatggcagtgttttacaatgttactgttaattcttcagcagtgctctgagtttagtgtaagataaatgagaggctgataaactttaagtgtttttttttttccatgaaaaatgcagtgatgttgaactcttcatgatatttgctactgctgattacaaaccagggtgactaatctttggccagtcattataatcaatgaatgtgttatgacctcacaggtttacatgacttcactcatagacctttaatgataaagtaaaattgaacttgggtttggttgcatataatattttgaaatattcatcagcaactttgttaccgatagactacagagctctaggtataggtaacttaaaaaatggaaaccaaccttgagtttttttcttttttctttttaaacaaaacgtatataaacacaggtttttacttactgagcttttcagatttaacaaaaatttatgtaaaattttgctgaattttctagaagggcactttaaatttaacaagcattggaatccaaggtacttgggatgccatttccaatattaccagttggatttattgttatttggtattaccataaacttttaaaagaaaaaaagccacataatgaaaaagtatttgtcaattcaagagcgcctttcttctgaggggagaaggatttgtgaggagcagtggttgtgacgtccactcctgttgctttttccagttttggtgtccacataccttggggaagctgtagaattattttatgcctaatttttctctttatagaaaattattattgaattatctgcatagttcatagttttgttgtgaaaattaatgaatcaatatttattaaagggaaggacaaagtactaagcaaaatgttaaggcggcccctcaaaaaatcactccagaaatgagtcaggttcgaagtaaaaattcacaaatatagtgattttcaaaattatgaaaaaacattcgcattctgtttttttttctataagcatttatttatgctatgttgtaaaacttacataaaatttaaagattgtatgcaggctaataattagagtcatacttttcttgtggagactaattggaaaaattaaaaattacatcctaggtttaattataatgatgacatcttattttggtaaacatattttataatttgctaagcacttatatctcatttcattctatagcccacaccaccggggggaagtaaggggaagcagatatactcattcttacagatgaggaggaaatggaggcagaaccgtttgcagtctagttatttgagtaggttggtgtgagtagagggtaaggaagggaaggatccgaagacagggtgtaaaattcaaatcccacttttattaattcaaatattgaatttttaaagaaaataactgaacaattttaaaattcattcttcaaatatatgttatacagttctcattttatgtatttctttattttaaaataatgctataatgaatgacactggattcttgcctttccccccattaaacgctaatggagccttatcttacagttggcaatgtgtagatgtgtatgccttagaagcagaaggtccttcaatggttctcagtcctaacttcatgtttgcaatatctggaaagccttttaaataaaactcttgccctggctgtatcttaaatctaaaagtagatctctgacttgatattccagtggcctggcctgtgaatcatttctcgttgactagcctgtcttaactcaatttgactaaaaagtcttcaccaagagatgttagttgcacctctgtttctattaatgctggcatcattttctctgtcaccttggaaatactttcatattcctccctctcatgttctatttttctgtgtttctcctacttcaccaccttaatatcagtcagtgattagtcaacaggcagaagctcctagaaattcttcctttttaaggttttcttgattccatctctgctttctactccttatttcagtgtagttatgacaagcatagtcagtggcactcaggtcctcccccatccctctgcccatcatttggctcttaaacgtgcagaacatcttgtctgtttctattcattttatctttctgtaacatcctttttcatcctggtattctgttgcaaaaattttcataataaagcttccattgccagcaagaaagtccaaaccgcttaacatggattaaggtcacttgcaatctgtcccaacctgtgtgtatttttaaaacttcatgtaccatttctactcttaccattttaacccttttcacaacactttacaaaatgatgccagctcattttttataaacttcagagtagctctgattatattggctgatttttctcatcataaataatatacatgtatattaggggacataaaactaggctataattttgttatttagaaagcaaatcctatattacttctgattaaggacatatgatgtttcatagagcattatgaaagacaagggaaaatatgtggaaattgtagttactgcttctgttttacagtagttgttgactggcatttttgtttttcttttgattcaaaaaagcattttttaaaaaatgaaaagtaaatctgaaactggaattgtagctttgaaataacattcagtactatttcatacacatttatttctatatacatgtatgatagtttttcagaagttccttttggtgaaggctcattggtcaactcagagtcagctaaatatattaaacatgctttatcttagaaaggtcagtgctgaaagcagacaaacaagttagtttatttggagggtttgaaaaatggacttgtcattgtttggcaggttgcccctccttggttgtcaaggtcacattccgtgaatcaactgcccttcaagtacagtttggatagggagtgcatccaaaggccatcctcctgattggttcctctgagcctcttgtctgtctccctctcactgcctcctctgatacctctccctctgtatcgctctctcttttttctttttctgtctcttgtccttcctctctttttcctttcctctatctcttttcttcctttccatccatctttctgtcctctctcccaaactcaatcctttatattttagcacttcttggcatggatgtaaaccttaattttgaagtcccagagagttatttaatggcagtgtttccagtcattaaaaaaaaaaatgttgaggatggggattctgatgatgttcttggacatactttttggagggaaatggagtctatcaggagagagttgcgggcataggaaattaagtcactcagcttcagatttacactgctaatcagtgaaaactcttgtcaaccttacctcaccctgtgtattctccccacctcgccaccattgataagaaatgtttaagctggcttttctacccttctttctctttttcttcttcatttgagttaatcacttgaccattaatggccctttgaaaacactgaggaaagaaaagcccttttaaagacagaatttaagttttacattttctactcttctagggaataacttattaatggcatcaattgttttcaggacgaagatgataattaaatcccatcatcttgtattttcgtggtgtttcagattttctaagtttgcatttatttattatcaccttcagaaagtttctttttaaagtaattacagtgggcattgttattgccattcgatagaagggaacagagattcaaagttactgcttcaattgatttgcagtgtttgtaaattttaattccaaactgtttccattagatagtgctgcttagatcacaaacattttttttctggtctgtcagttctcttaccctaattaagctgttgtacactttcattagtcattcttagatgaaattcaagtaacaattatttttatggagtgttttattaactttgttttttgtagtatgtgttgctttttttttttttttgagatggagtcttgctctgttgcccaggctagagtgcagtggcacaatcttggcttgctgcaaccttcgcctcctggattcaagcaatttctggctaacttttgtatttttagtagagatggggtttcaccatgttggccaggctggttttgaacccctgaccttaagtgatcctcctgccttggcctcccaaagtgctaggattacaggcatgagccaccgtgcctggcctgtgttgctttttattccttaatttttttatatagcatcttttatcaccttgtacccagttttctatgcaagtatttctttttcactacacagcttcctcgtaagactttaacatatgtctaaggtcattttactttctctatctcttcattgttctctttaaaaaacttaaatatcttaatgataactttaatatcgagatggcattttggatgaaaaacttcatcagcttttttccctcacaaatttagcatgtagatattgacacattccttttatattattctgccatttctgtagcatttcaccagtatgcaagtctgcacatgaaggtatgcttaggaaaacttaatgaacatccatttgtacacctgattaccatcatttcatgcctataatgtgcagatagcctgatgaaaagcaacaggcttgttcctggtattattcaaggaactcatgctatgtgctgccaatagagtggtgttttcattcagagaatgctcctactgggctctttttctctgtctttgttgaaggccttctcctaataacttccgagctctctctgtcttatagtgccaagtaaagaaagtatctgaaacccaaaattaagtagagatgttacacaaggaaattgttttaagggtaatttaaataattggatgtttaatagaggatgctttctgcattcttgaggggttcagacgtagtggaaatgacttatttatatatggctactttaagattgagacatagctattgaatttactttgttactccactgtccatttaaacttttcttgagttcttataatgtggcaggtgcaaaagatgaattagagtaccctacattcaaagaagcaatttatcataaggtaggcagaatagttttgaccaaaaagttataaaatatattgtaagacaggggtccccaaccctcgggccatggaccagtaccagtccatagcctgttagggaccatgctgcacatcaggaagtgagcagcaggagagtgagcattaccacctgagctctgcctcctgtcagatcagtggtggcattagattctcataggagcaaaccctattgtgtgaaccctgctgtgaagtgtgcatgcaagggatctaggttacatgcttcttatgagaacctaatacctggtgatccgagttggacagtttcatcccgaaagcatccccctctatgtccagggaaggaaaggttggggaccactgctgtgagctactatttgaagacaacccagaagtgatttttgcttgtaggtttccaggcaaagcttgagaaccagttctcctatcctgatgtagaacctggtatgatctacaacactaagaacgtgtacatacctgtgcttgtattactctcattaggactactgtggcaatgtcccaagcaagcactattcaagatattgaccctcaaaagcaaacttacctgaactgttcttttgttctagtatgcactcaaaaatcatttaattctgatgaaaaggggtagttgtgtgattttggggtcaaattttagacccgtagaaaaaaaattgtatatgtaataaatttacatattataatttatacacacacacacacacacacacacacacacacacagagtttcactgtgttaaccaactctgctctagaaaaagaaccgatggggttttgatgacgagctgctctcttagttatgggaggtggggactctcttactcatagcatttttttttttttttttttgagacagagttttcctctgttgcccaggctggactgcagtggcgcaatcttggctcactgcaatctccacctcccaggttcaagtgattctcctgcctcagcctcccgagtagctgggattacaggctcatgccaccacgcctggctaatttttatatttttagtagagatggggttttgccatgttggtctcaaactcctgacctcaagtgatctgtctgcctcagccgcccaaagtgttgggattgcaggcatgagccactgtgcccaacctctttttttcttatgaaagacttttgctgaatgaaaactaagttcattttctacccagaatcattttgccgtgatgggagagagccaacattggtgttttactgatgccagatatgactgcatggagctctattaaatagggcgtggtttggttgggagttacgtctttattttgaatttgtggatttttaagataagtgtcagaaagcaggattctttgtaaccctgcaattcgtacagccagcttttgtctactgtagatgagatttggcagctactacccagaataagaaattgattttaaaagttcaagtgaatgcattccatatttaagatgtacattcgttctaatttcacaaaaaggtgaaaagcaattgtaaatgtttcctttgccagaataatttaagtgacttagtatttaatgaaacaaaatgattatggtgatagcattttaggactgtttttgtctgcctgtatcctgctttatttcctcctatatttcaatcagtttcttgagattaaagacaaaaatcttttttactttatcttctttctcttcttgactcctaaatgttgttgtccctgagaactcactcattgcccctcctctttcgacgcttcccctggctgaataaccccaactgtgttctgatacagcatactgtctcaggcagggcttcagactacaactggatgactcacagatatctcaaacaaacatattaataattgaattcatggtttttctgtaaatactaattttattttatttcttgagacagggactcattgtttcacccaggctgtttgcttactttgtagcacttgtaatcacagctcactgcagcctcaacctcctgggctcaagccatcctcctgtctcaggaccccagctccacccccaaagttgggaccacaggcgcatgccaccacacccagtgaattgttttattctttgtagagatgggggtcttactatgttgcctaggctagtcttgaactcctgtaagtacttaatctgccttctgcttctctgctctctaggcttttctcccatcaatgcactcaagaaggaaatctaggtggcattcttgaatgtcttttctctcatattcaggcctccagcgattgctgttgtactccagatgtttttttccatctgtcacctatctttccacccaccctcttactgcagatcacactcacctgctccctgagctgcggccagtcctttgctttccttgttccatttttttctccctctcccttaatgctttccccatagggcataacatttagttttctttagtagatgatttcattcttcttaaaaaactcagtggcttcaaatgaaccttgggataaaatacaaagtttaaccatggccaaaaggccctatttgacttagttattgccaggctccttgaccttatcttgtgccactcccggcttgtcccctccttcagccatacctttctttgtagctcctggagattcaattctttcttgccagggtctttctacctctgcctcacatattccctccatctcttcattccacttccctcatccccaccccccactcccctccatcctcaatacacaaatgctcctaggcaccctccttctgatcctgtacatcttaatgttgtggtgagttccttagaaataacttctctgtctactttatctaaaagagaactttcttccccattctttaaagatgatttccttagagagactttcctttacctagaggaaatctttcccctctcatccttagagataactgctctgtctaaagaaggtctcctctccctattcccaaaaatctctctcagctaattgtttgcttacttggtaggacttgtaatagtaatttatttattggctagtttcttgcctctaagggaatgtaagctaaattcctccattaagagcaggaatcagccaagcacagtggctcacgcctgtaatcccagcactttgggaggccaaggcaggcagatcacctgaggtcaggagttagagaccagcctgaccaatatggtgaaaccctgtctctactaaaaatataaaaattagccaggcgtggtggtgggcggctgtaatcacagttactcaggagactgaggcaggagaatcgcttgaactggggaggtggaggatacagtgagccaagatcatgccattgcattctagcctgggtggcaagagcaagactctgtctcaaaaaaaaaaaaaaaggcagaaaccaaggttgttttattcatctggtatctctagcacttaggaccttgctttatgtagaggaagcactcacttcatatcttttatgaatgaatagaaaacaacaaaagaaaacatctctttaaaattaaaaattttactcctgattattgtgtctttggtttattttaccttaatgacaaagaaattgaatagtggtcctaatctttgaccaagaattgattagattaatcttgtgataagaaattttttattaaatagtcaactattaaaaaaaattaagcctaggcaatgtggcgagaccccacccctacagaaaatttaaaaaaaaaattagcttagcatggtggcatatgcctgtagttctacctgctcaggaggctgaggtaggaggatcgcttgagccaggagttggaggttgcagtgagttatgattgtaccactgcactccagcctgggtgacaaagcaaaactgtgtctcttaaaaaaaaaaaatagaataaaataaaaattacagcaatatttctaatgcaagataatttttctaaatgggaaaatcatatttataattatactttggaataatttacttagaatatttttttttttgctcaacattcagaatatagaaaatgcatagtaattctctcacacacgcacatgcacacacacacacaccagaacaccaaaacaaaactttcctgcctctaggcagcatacatttttaagagctttactgagatatgtgacatacaataaactgtacatatttaaagtgtatgattgacctgcataaattcctaaatgaatgtaaccctgaacttgccttataaagttatcaggaaaaataaactatatcaaataatgtatgcatgcaagagactaccaaatgaataatgaagattatgccctcagtgaatagcaaatggttttaaaaaatatttatagataatatcaagagaatgattgctcctcataaatcagaagatattgcttacactttgtttcatttaaactttggtctgccgcttttgtattttagccggatgtttcttctcgtgggagctcccaaagcaaacaccacccagcctgggattgtggaaggagggcaggtcctcaaatgtgactggtcttctacccgccggtgccagccaattgaatttgatgcaacaggtaaattttgatgcacaattttcttttcattgatttcatttgattttttttttgcaattggtttagtttaaatgtagccatttaatacaattatatagataagcacctcagcttcacagggaaaattatataaagacaaacgatttattatatgattttttcctacaatttttgtggtagatgaaagtattaaaagtacgttgtgtttccattggttcagatgtcttctgccgtaaactgataatatcaacccacagaaatttggggtaaacctgttaggatgtttttgtaccttttctgagaatagggagctcataggcacagaaaggcattctgctgcttctctgtcaaccaaattgaagcatgactcactattgtagaagatcaaatctctgatcatgaatatatccaagccttaggctgtgctataaaaagcagttgaggaggctgggcatagtggctcacgcctgtaatcccagcactttgggaggctgaggcaggcagatcacgaggtcaggagttccggaccagcctgaccaacatggtgaaaccccatctctactaaaaatacaaaaatttgctgggtgtggtggcgcctgcctgtaatcccagctacttaggaggctgaggcaggagaatctcttgaacctgggaggtggaggttgcagtgagctgagattgcgccactgcactctagcctgggtgacagagggagactccatcttaaaaaaaaaaaaaaaaaaagcagtggaggaatcttttgcattcaggtggacttaggtgacgtaaacatttatcaagactttgttgggaaaattatatattatggttctgataacaggagaattttagggataattttcagtgtcaggattgtggtagcaaggagaaaaatagcatgtgtaagatgagaaataagctttacatttttgccagtgaaataaaatatgcagaattctgtacgcatttatattggtatatttatatatatttgtgaaatcttagatagtccttaaggaaatagtgtgacattcttctagtacaatagtcttacaaaattttttattgattctgatttgctggctttgacagagtgctttaagataaacctgcagaaaattaatccttttttccatattgttatttcctgccagtactaaaatatattgattctgggaaatatgtcagtgaaacaggaatcatgatgtggactgttccatttgacattgtgatcagtgccaaaatggttgttagtcattaagccagctgttaatgggaaccagatcacatgcacatgttttcagggttttttttttccatttgaaattatctacattaaactctgttgttgtatttttccatatatggctaatacttggaaaactccaagagtttgtaaaaaggcccaattttaccataaatggagaaatacctgtgactcagaatatgatagttttagggcatttattgtctaacaaaatatgagaactaataaaaggaaaccacagtttagattttgataggtcgaactcttcagatgtttctgtacttaacactgtaggtttttgtgcattgcaagataatttattgcttcagataattttttgtttattgaaaataacatttgcacatggtaaaacaaattttaaagagtctcaaagggtgtacaatgaaacatacaactcacatcagtcttctcagaagcaatcacttttttttttttttctttttgagatagggtctcgctctgtcactcgggctggagtgcagtgatgtgatcatggctcattgcagcctccacctcccagactcaagtgatcttcccacctcagccccacgaggagttgggactacagaggtgtgccaccagcccggctagtttttatgtatttttttttttaaagagatggggttttgccatattgcccaggctggtctcaaaacatctgggctcaagcagtctgcccccctcagtctcctgaagtcctgagactacaggtttggcccactgtgcccagcatgaggcaattactcttaacaatttcttttatccttctagaattttcttacttctatatatgtatgcatccttgaaaaaaaggcaactcaaaaatctgatgcctccctgcaccgttctaacaatagaaatctcttgtagatatttccttatcggcatatgaatttacctcattttttgtaaatcactgatactattctattgtatatgtgtacttaatttgcttaaattatattttctactagtggatactttggttatttccagtcttttattatgaacactgctgtagtgaaaaggttatacacaagtatttgtacaaatatgtgaatatatctgtatgataaaggagatttttggatcaaaatgtatgtatatttaaagttttgttaggtattgtatactttccctcacagaagtttacacccctccagttgtgttttgaaacccatggcaacctcatttattagcatatttttaaatcttcgtcagttttataggaggagatagtatctgttatgttaatttgcatttctttaattaacagtaagactgagtgtcttcatatttgtttgtaagccttcagtatcccttttcctgtgagctacttttagtatatttgcacatattttctgttaatttgtgatttttaaaaaatgaatctcagtttatggcactccatcctttcagtgtttaggccagaatctggagctgtgtttgacattgaatctgtcagtaggtcaaaatttaactgcttcttatcagtccactgctaatatcctggtccaagccaccactgtctcccacctggactattgccctagatttctgaattagggcattgccaggaacgagatggcacacttaaattgaggtattttgactatttacagaggtctgtgcaggtacctggggattgatcgtatatcagcactagttaaaatgtgacctctaggcctgaaggcagcgattaccagaatctgaagacagaatactaggtgtagagagccacgtgacaggagctgtggcttttttcagagggcaggagccagcccaaaatgaccaggggattaaaacaatgagctcactctgcttcctccctttgattctctgtgctgtgcctcataaacagtaggcacattcccacttcacccttgcctgggctgtgtttcctgcctggaacattctttccctaaatatccactgagtatctgcttcaccatcattttgagaattgctcagatattatcttctcagtgatgaccatctcatttaaaattccaactcccccttctcaccttgtacttccatcctcttctctatttttcccagtaatacttacattgttacatgttatttatttgtttttagtgaatgtctctttccctcaattagaatgtaagttccatgaggactgttttttatctttgttcattgctgagactccacggcctaaacattgtctggtgcccagcacaagttagtgctgaataaattgaagagatgaatgtacgataagaggtttttatatagtaaggaaataactaaagtcctttagtggttgtagatgtgtatatatatatatatatatttatatgtataatacatatattcttatgtatatgtataatatattcttatgtatatgtataatacatatattcttatgtatatgtataatacatatattcttatgtatatgtataatacatatattcttatgtatatgtatatcttttgtccctgtttatgatatttctgtaatccttttgtataacttctgagacctccccagtggaaaaacaattaagacttcatttttttacattagtatttttattcaaatggtgtttatttgaatgtaagaggacaacatagatttaaataatccagtcaagaaaatgtatatctaaaatagccacattaaactatatggtattgagtttcaaggaagaaatgcttatagcttatcgcatcctgctaaactttctttatgtctctctcccaaggaactcttcatcccatcttagcccaaacatataagcatccctacaatacaaatgccttctctcttttttattatctcaagggagacagaagctgagcagatatgtggggtttctgaaggcagcctccctggggctcaaaccctggttctgccagttaccagctgttgacgttgcacgggttactgttaggttaccctcatctccctagtgcagtattctcatcaacctgctccatgggtgtggattacatcgcatgagttaatttacatataggtgaagacttctaaagtgcttaggacagggattggcatgttgaaatggctcagtaaacatgagctgtttcatgtcgctattcctcccttttgccttcttagagaccctccctattccttcatttgcttctgtatccctgctacattctcccttttcctttcttccccaactttgaagtgtgtttaaagttttttccctgaaaaactaatcaaaaactgttttcccttgaacatgtatcttttcttagtcagtcacatctttctctcttctttcctttacatccatgatttttgaatacatattgtgtcttcatcacttgtcatgcttcaatccaatagaatcactgttgggttgtggcaccgacccaacccagcagtgattctaactgcgattgttgacagcagcctatttgccagcttcaggggatgcttatggttcctcatctttttggactgctcttttacaattcaccccattggccattccctccttaaagtttctgctcttcgtctgcttgaaatgatcacatccttttatccctcctaaacttgatactattgttaaacctcatggtgtcatgaaaaggaataggccttgtagttagacagacatgggctcaaatctagcctctgtcattttttctaacattaccttgggaaaattacctgccattctacattgtataatacattccaggggtgatcacgaagagtataaattggttagtttatttactttattgtgtttctgagcccagaacagattttagtgcttaaaagtgccctgtcctcatgtttttaatatttgggaagtaatttagtttatgaaacagtctcaagaaaattagctgtaattatatgatgtgggagatattacaacactttgtcattattcacatttttttaaacttctgggaagacctttggtatgcccatgtgactttttctggcccataaaacataaggagaattgtgtcatttctgggtggcagggtttaagagctggggcattattctgccccttcccagatgtcacagggagtagtgatagttgaaatggtagaacttctgtcaacctgaggcctgtggtaaggaagacataaagcttagactcttactcatatgtgtgtggacaaaaaaaaatctattgttctttttaactacttgagatttgggggatgcttgttactatagcataatgggaactaaactgaataacacatatagggatattaaaatggaatattatcaataatcatctgctggaaaatggttattaaaaccactttctattctgcatgccagtttggtcttcctttaagtttctagtctgacttactgagtatctgagtgactaagtgactaggtatcattgcttatgctaaaaatggcccctgacgttaagttgcatttggattgggagaaactataaatagactaagtacctgatagggatgtcatagctttggggttccttgagtatagtgacacaaaactggcatgtgttttgtggcgactctggaagctatggctatggagttgttgcaaaagatatcatttctggggggcaagaggctttgaagccagaatgactcctgcgtctaccaggttttgtttcttcatatctgagccgtcacctggcggggcaaagagaagtactctggacagctgggtggacagttgtataggaaagttcatgtaaggattctcaccaaagaggtatgtctggttctgtcctgctggaaagctgtggttgtgtcctatatccttgcaagtagattggtgcttcatatggcctttgatagttttgtgagtttgaaagtttagttgagccttaggaagccgcagatgatgttgcatcaacatttgaagtctgtaattgtatgaaatattctaggctggttgctgcatagtctgtttctcctttgaaaaaatagaatagtaactatattccttcctacaaaaaagaacaaacctcagctagctctagaatcacaacaaaaattttacagtaaagtgcttggagatactacaaatgcttggcattaagtaatattttgtaaaatggtcctttcctctcccattcaccttttaagtcaggttctgccatactggtagtcttagtgcactgagtacagttctctttcttattaagctgaattttttgttgattttttttttcttactgatgttatagtatgtttgttttcctgagtagactataagctatctaaaggcagggaacacatttatttccactcaccatttattccacttccatatggtgggttgcctgtgtgtatgttccatgcaagttttgggctcttcatgaaaagtaatagaaatagactctagctaaatttaacagaacaagaatttattggaaggatgttggtaacttaacagttatctgaaaaaataagcaggaaccaagagaagctaacaaaagaacaaccagtggattttattgttgctggtactgctattgctgaatgtggagtaacaccatgagaataatttcttgtccatcatgcctctttgcatcattttatagagatttaaaacttttatagtagtgtctgtttgggtgagtctaagtctcatatctgtgaaagacctggaaagcctgtcttatcttacacaactaagaagattatgagcttgtagagggaactaaaaggtataggattaaaagggtgcctttttctccttttgactggaaaacagggtaataggaaggaaacatcctttgcaaataaccctttttatctgttgggctaattagtaattcatgaactaattttactttgtgtttaccagtgacgtccctggatgttagatagtatatcatttattaaaaggccatgtaactgttgcttgtcacgtgcattaagacatacactagtagctaattaagaaaatctggattttgcttttaaggtatcataacacaactttcttagcttttaaagaagacagatggacactttagatgtgctttcctatcctgtaacatgattttggtggtttgagttgggggtaagagagaggctttcaaaaatgtatttgagagatcagtctaaaagttattttactgtaattctgaaaagtagacataaatagattcataccaaaataaaggaggcataactggaaagtatctaactttgcctggggactttgaagaaggcttcctagattagttggtgacatttgagctagctaatgaaaaatgagatgaaattccttagatgtcgaagagggttctagcttgagaaaacagtatgtgtatgctgagtaaaagaagttagggactgataatcaagtaattccatgtgccctacatatatatatatgtatgtgggcataagggttatacgtgtgtggtggtggggttatggtgttgagggcacgatgaggaataaaactggaagtagctgaggaaagatataaatgagtttttaaaaacatactctaaaggtctagccaaataaatttaccattaaatcttaatgcatatagagtattatattagagatagaaggatctagagccccatagggacatcttggactcctggttccttgtagatttcacatgaacattgcagatgaactaatactttcagtacccgtcttattaattttcctagtcacttttttggtaaaatgatagaagttacatgaaataatgaatattatcatatacatatattcaaaatattatagacacgactttaaaaaatgtggagtttcatgatacaaagtttaatttagtagaaggtacaatccaggatagaaaagttactcgctgctttgatttttgaataatatttatgctttagtgagccttcaggagtaaaaaggaaaccttagtccaaaatttagatttgcaaaagttatctccaaaatgtgctgccctgttaatgttctttcaagatcttgactctggcttgtcatctttatttttctttttcccccagatttgcctgatagaatgtataaacaaagccacaactaagatgttttaaaaagtttcttattttatatgtttatgcaatgattgaaatattacaacttgcttttgcttttgaaatagcagttgccctcttggatttgtaaaccttttcatccagtgactcttcataatttatagattttaagcaaggtctgcataatgacggaatagtttttttcccctaaattgaaagaataatgtgaactttgatatgttgtggaattagtgaaaatgaaacagttattttgggtatgatttctttgttttagtctaagatgattgataggtagaaaactcacaagtggatgatttagtttagggattaatgatctatgtattttcagtagtaaagttattccaaactataatagattgcgatgcaaaacaatattgagactattcatgtagcaaacctagactgctcatgtagtctgttatctgttttgccttcatggctgcattcgtttcctgttgctattgtcgtaagttaccaaagataacacatctgttatctttagttctggaggtcagatgtccaaaatggattcactgggccaaatcaaggtgagaaactgtttcctttccatttccagcttgtagagccattggcattctttgtcttgtggttccttcccttatcttcaaagccagcaatagctaccggggtcgttctcatgctgcattactcgaacattgaccctactgccccccgacccttgtgattataatgagtccacccagctaatccagacttacctcttatttcaaggtccttaatttgatcacttctgcaaagtcctttttgccttacaagggtcacatatttatgtgtcagtttctgggaattagaagttgaatatctcagggatattattcgcctaccacagtgcccttttatgtattttcttttttaattatttgttatttttttctttaaaaaagagagttggggtcttgctatgttagaccaggctggtctcaaactcctggcctcaagtgatcctcccatctcagcctcccaaagtgctaggagtacaggtgtaagccacaattgatattggttatactgcaagctatgctgaggcaagaaccatgcttatataagtaggcattgctgtctctcttgttctttttcccttggcagctttggttataaagaatgcaaactagatttagaagatgcaggctcagattcagactctgatacttattaactgtgacgttgggcaagcaccatccacaatttccccatctgtcaaataagcataatacctacctctcagggttgccatgtagatcaaatgaggtaatgtcagtcaggcatggtggcctggtggctcatgcctgtaatcccagcacttcgggaggcagaggcaggaggattgcttgagtccaggaatttgagaccagcctgggcaacataatgagatcccatatctgattttttttaaaaaaggtaatgtctatgaaggtattaggttggtgcaaaagtaattgcgatttttgccattactttcaatgctttgtaaacaagaaagcattataccggtgaagaaaggattgtttatgttgtgcccatactagaactgtagggaactaaataaatacggaaaaggaaagaaataaagataattgtggatattcttaaattgattatagcttgatttgtattttaacttctgttattgtgacatttgagaaaatcctcttcttataacatgttttccttttctagggaagcagatgctactgacagtctgagccttggccatgtttcttagtaatgtgtttttttttccacccaaaaagatagactgctaatgtacattgagaaaagagaccatgtatcactgccctacgaaagtctctttgcttagaaatgaaggcttacctacctgtttaatttttttttttttttaaaggagaagctcctacctttatattccaaatacagtgaatggatgtcacctaccactaactgtttctgtcatacagaagggcagaggtcagattactcttcttcctacccagaacagcttgctggaatgcttgccatttgttcctagaagggcctggctgtaggttgagagcaaaccttggctatgccagttctgtggtcaagaaaaatgctgtggagtattttctgggtataactaggctttgtatttaatagagaatataaaacatttagctgttttctagcttctgcagtacaatttccatctcgttgcaattaaaacactcaggcagaccctaaactaacttcctttaagttttacttcctcctattgatgaattttctgtcttccagagttgtgtctaggtatctctacagttgcaactgtcctgtaaactaaaaagttaaaaagaaaagtagtttcccttcccttgttaatacaaaacaaatttatactaaggattttttaaaaataaaaatgtttctcctgatataatctgttatcccctgttacagaattacacagagagctggtaagcactttagaaatcttttagtctaattcctttactactaactgactgacagtcatacagttagtcagtattttaatgttttcagtattttactgaaaccaaactcacaagctcttttaaagtttcttcctttccctgctcactttgacctgactcaacccattctttaggacttaacatgggattggctttttttttttttttttaatccccagtaaagaggttttgtcttaaaatgttagatgctttcaggatcatttccttttcatggctagaaggaaacaaaccagcattgataaagcagtgagtattttcaaaaggcctgtattctttgtgctgcactccagcaggaccactggaattgctcatggaagaagagggagattttgattctttattcgctgtggtagtaataactaactaactcaatgaataccaatcccagtgaaatgagcttcattcctgttttcctctggttctgcttttctgactctttttgtttatttttgggaaacagctgtatcttattttatgtaaaagatgtttctggatagttctatataaattaataacacttttgcatgtccatggattatggttgcagaacttatttttgtatatataaatgatttatttttcaaatactttggatttagggaacttggtctcttggccattttaagtcaatacaggtaagtttcaagagacatctgaagacactttggaagtttataaagcaaattgtcctttcgttaatagtactagttctaatatcttaccactacttattatttgtcagagtttcttaaatcagttaacaaactgtatttccttactaagtcaacgaaatcattaaccaccagtttagtcttcaggagtatctagaatttttattttttaattagttattttatgcaatattctactctaatagtttaattctataacatagaatagaggttcctaggaaggtcagtgcttaaaaaaagaaggaagaggttcctaggaacgctaatgcttaaagaaagaagagcttgtgtgattaaaattttttcttgaattttatgaactaaaactcctttacatgtaagagatgaaaatgtaaacaaagttaattaagaggggatgtgggagcttcaaactaagcttttgtatatgaggattgaaggatatttatccacactactttttaaaaaacctttaaaacattttataaataatgcatgtccattgatgaaaatatgagaaaaccagacctacttaaatctcaccactcaggaaaccaagggccataggatatacttttgtgtgtgtatttgtgcatgtaccttatggcctgtgtatattctctgtgtgtgtgtgtctgtgtgtaaatatacaaaatacataaagttataatttactctgtctcctgttggacattctgtttgacatgcttattagtcttagttcatattacaaaaagtttttttagttaatttttaaaaattaaacttagaagtcataggaatgtgtgtttcaagatttctgatacatatttgccaaataggaaaatactgacacaagcagtctttgaacgaaatttgatactatcttcctttgcctgacaggtgaaacatatatcttgttttaatttacatttctgtcatttctggtaagcttgagtcttttttcatatgcttattagctctttctgggtttttaaattttgttttctattatccgttttcattcttgatctattatattattcatttttattcttggtctattactcttctgacacatctatttttaattaattttgaaaaagtcattttttatatatatatacatttctgttcaatgctacagctactttttctcctgacaaatctgtcctttttaaaaacagttttattgagatataatttaccataacattgacctgttttaagtgtacaattcaatgaatttttactatatttatagagttttgtaactattactacagtctaattccagagcatctccatttaccctaaaaagaaatgtgtccaacatcagtctctccccatttgtacctccagccctaagcagctattaatttactttctgtgtctacatatttttggttttggatattttatataaacagaattatatgatacatagtcattcctattgtagcatgtatcagtgctacattccatttttattgcctaacagtattcaacggaatgaataaacattttgtttataccagtagatgcacatttgagtgttttctgcttcttggctattatgaataatgctactatgaacattcatgtgcaaatctttgtggggacatatgttttcctttctcttgtatagatgtctaggagtggaattgctgcgtcatatggtaatctatatttaccttttttaaaaactgtcaaactattttcaaaagtggctgtaccattttacatttctattagtaatgtatgagggtttcagtgtctccgtatccttgtggacactcatattctgtcttttttatattataataaccatcctaatgagtgtgaagccatattttattgtggttttgatttgcatttacccgatgatgaataatgttgaacatcttttcttgtgcttactggctgttatttcttctttggagaaacatctattcaaattctttgctcatttttcatttggttgtttgtcttactgagttgtaggagtttttcgttttttttttcatattatttaggatacaagtttttaatccagtatttgataagcaagtaatttccccagttttgagggttgtctttccactttttaaatggtgtttttgtagcacaaaagtttttaattttaattggctaatatatctactcttttatcattatgcttttggttttctaaatcattgcctaacccaagttcatgaagatttatttccttgttttcttttaagagttttatagttttagctcttacgtgtaaaaatgtctgtgatctattttgagttaattttctggtacagtttgaggtatggttccaaattattttttttgcatatgggtatctagttgtcccagcatcatttgttgaaaagactatttctttgccactgaatttgcttggcatctttgtcaaaaatcagttgactgtgaatgtacaggtgcctttgatgttaaaatgtactgtttatgtactactaaaaatactaaaagtgtcaccattataaatatatcactgttgactattgtacacattcagattttaggcatactaatatctgaatatttgcagctctgagtcaatgatataccttatttttttttttttttttttttttgagacggagtctcgctctgtcgcccaggctggagtgcagtggcacgatctcggctcactgcaagctccgcctcccgggttcacgccattctcctgcctcagcctcccaagcagctgggactacaggcgcccgccagcacgcccggctaattttttgcatttttagtagagacggggtttcaccgtgttagccaggatggtctcgatctcctgacctcgtgatccgcccgcctcggcctcccaaagtgctgggattacaggcgcgagccaccgcgcccggccgatataccttatttcaaaatagcattgggttacaaataaatgcatgataacagtagttgtctgacctccaaatcattttctctcaaatttcccttatagtatttattgctctctgaaaatattttatataattatatattacttttctccttgaaaagcaaggacttatctgtctcgtttaatgctatattactagcatatagacataggaggtacccatgatttatgatttatttaaataaattaatggataatctaagatatttcttccactaacctgtccatttttacctaataaataagcatactttattggatattttttttcaagcaaatttgttataggaagtacaactaaacaagtgatgtttgaagtaaaaagctgcttaagaaagtctgtgaattgtctatgaatgcagggtggtattgttttgatagacattttttctttctttttttgttttttttttagcaaaaagtaagttaaggacctgaattatttcattattcataaaagtcatagtgataagtaggaaccaagtgactaaaaccacatttagcttcaaaatggaagtttactctcttgcttttctaatgatttagcattcttgttcactttggccatttcacaaaaaggtgacataatcttgttccaagggatattcttttggcatgaaaagaagaaacaaaacattttgcttagggtaagaaggtaattgtatcttaaaaataagcactgcccataattgtccagcaagttgagtgccaaatgtgttgacaatgcctttggaaacaccggggaaaagagttggctgctaataaggagtagagtcgaaagctacgacaatccggttttctcatttgcttctgtcctcaagcatgcagtcatgggagtttgataaaatgcaaatgacaagtttccaaacctggcaaaataaacatgaaattttcaagtctctagtgatttacttgcttattaacttcaagtttctctagcaaagttttcctctgtatttttgaaagtggtagcatagagccttatgttaatttatataatacagagcaatttcttctcaactttattagagaaagagatttaaagattatgaaataaaataatatttaagatttaagttatttaaatactttatttcgataattaaataaaattattttattgtgtgagatactctttttttcttttttatttatctgggtgaacagagctaatcttccaatggggtttgtgactatggacagaaatctttctattcttggctgttgccggagaaagcatttcttccagcccttgagtttctgcagttgtctgtgtcctgtttccttttcaagtgtgtcagcatagtccaggctatctgaggaggtccaacatcatcctaaatgctgacttcagggctgtgattcaaaatatttacttcactcatgtgcctcaggatagctgccagtttcacccaggtcatgaatgaacttcttgtcagtttgtctggagagcaggctttcttttgcattctcttcacccagtctatttacacttcctctgggtgaaacttctatgtaatgttgaatcaaagattttaagacttggtctccaaaaaaacaattttgattagtaaagacaaacttcctaatgagcaaacttcttaaaaagatggtaacatgaggttgtaactctgttgcaggtgaaggcattgaaagcactggatgatgttattctttttgaagaccattgactaagttttgggtgccaatatacgccaatgcattatatccagttatactggactactttggtttccaaaaagatatgtcaaatttgtactgattttgcatgaattttctagcttaagctaaccctgatgtccacaaagacagatatccataactgttaaggcaagggatgtttttgatacttttttaaagaaataggaaacagaacatggtagctttgcaagcctatgctgcttgacagtgcccagcagcatgttgtgccaccgtatacaaatttaaagaaaagtaacgtttgttaagaaaaacattcatggaggtaaattttcaaagtggtacggagagattggataacctttcacaaagaagaaatttcacttttcaggaatataataattgagaaaaaatgcttagcatagaaggaactcaaaaatcccatcaagcccagtcttagcatggcataaaagctcttgacaaaagtgggaatgtaaattaatacagctactatggagtacagtacggaggttcctccaaaactacaaatggaactaccatatgatctggcaatcccactactaggcatttatccaaaggaaaggaaatcagtatatcaaagagacatctgtgtccccatatttattggaacactattcacaatcaccaagatatggaatcagttcaggtgtctaacaacagatgaatggataaagaaaacatggtgtgtgtatatgtatgtatgtgtatatatatatatgtacatgcattatatacattatatatagtatattttatatatatatatatttagtgtgtacatatattcctgtctcctgtctgtgttcaggaatatgtatacacactggaaaaatgtggtgtgtgtacgtgtctgtgttcagccataaaaagaatgaagtcctgtcatttatggcaacacggatggaactggaggatattatgttaagtgaaataagccaggaacagaaaattaaacactgcatgttttcagtcataggtggaagctaagaaaaagttgatgtcatagaagtaaaatgtagaagatactagaggctgggaaaggtagggagaatgggaaaatagagatttgtttaaagacacaaaattacagctagacaggaggagtaagttctagtgttttctaccactgtagggttattatagttaaaaataatgtattgtctaatttcaaataggtagaaggaaggaatcgaatgttcccaacacaaaaaaacgtgctaaatgttcaaggtgatgaacgtgcttattaccctgacctgataagtatacattatatgtattgaaacatccctatgtaccccatgaatatgtaaaattattatatttcaattaagaaaaaagggctcttggccaggcagggtggcccacacctgtaatcccagcactttgggaggctgaggtgggcagatcacctgaggtcacgagttcaagaccagcctggccaacatggtgaaaccctgtctctactgaaagtacaaaaaattagctgggcgtggtggcgtgtgcctgtaatcccagctacttgggaggctgaggcaggagaatcgcttgaactcgggaggtggaggttgcagtgagctgagatcgcgccactgtactccagcctgggcgacagagcaagactccatctcaaaaaaaaaagaaaaagaaaagaaaaggctcttgataaccactcccttcctgaccattctctctagttatagtgaacaactcacaattctcttaaaaaattcaagattacccactcttctgcctctttgcacaaggttttcttttggcccagaaaacatttcctcacttgtactgtacccttactttcctataactctttacgggtgcctatactattttccaccataattgcttgttcctatgattatctcttgtgttagagaaatgttcccataagaggcagactaccatttcatcatgggttagcatcatgaacagacaaacacacctgaattttcagttaggatttgaatccagagtggagggaataaagtttccgggcaagaggaccttggacacaaatgcctgcaggtggaaataagcatgacttgtttcagagactagggacgaaggataagagaactcttccgcataaaaataagtatatcagccaggcatggtggcttacacctgtaatctcagcactttgggaagctgaggcaggttgatcccttgagctcaggaggtcaagactagcctggacaacatgatgaaaccctgtttctacagaaaatacaaaaattagccaggcatggtggcatgcatctgtagacccagctactgtggcggctgaagtgggaggatcgcttcagtataggaggttgaggccacagtgagctgtgatcacactactgccctccaaaaatagaaatattcctaaatttgaaattgagggagatgtaggggattgattaaataaagtattctatggctgtataatgggatactacacaacaatgaaaatgatactataggtctgcctttataagtgccatattaagggagaaaaacgtacatatatttataaaatgataattttaatgttatcttaaatattgacttaatatcaattttacatataaaaaacatgcatgtattcatgaaacaagtctttaggatagatactaatgtgttaacagaggtcatttctttatggtggggttgtggtatttagatctgtctttatggctttgttttatgttttggtttgttttgtaatgaataagacatctataattagagtaaatacaataaagtgttaaaagggtaagaaggtaccattggtcttgtacatatattttgtacttattgattgctgtgtcttaaaaattattgtgaaaattttcaaacttatagaaaatttcaatttcagtaatacaatgaacaacgaacaacacacttgttcacctagcttcacccattgttgcagacattgttacacttatccctaaatacttgagcatgtatctcctaaaaactaggacattttcttatgtaagtacaatatagtcatcacatgttagaaatgaatcattattatgaagaatattaacagtaacaatgtaattattgctgaattaaacattattactgttacctactctagttcacaattcaaatttccacatttatcccaataaagtcctttgtaactttgaaaaaaaattgtctggacataaaattcaatcaaagatcacatcttgcattcggtcgacatgtcttagtggtctcttttaatctagaagtgtttcctactctttttgtctttcatgatattgacaattttgaggactctatcccaggtgtcctgtaggcaagtaaacttatattggtaagaatatagtgatgttcgatctatcccaatgcatcattttgtttttgacactggaattttagtgtacagaaataattttctcaatagtgagggctgaagtaataaaaataaatgtttgattgtagtgtgccgtattgaattcttttttctaccaaccaaatcaagtttcctggattctaattcttgcattgttatgtcttaggcacacgtctcagtcttgtcttttatagcattttacacaaaggtgtttcatagcatttaattttcataattatctttatgccccaccgaaagatcttctgggaataggcgatcatacgtatttgtttaatagttaattatctaacagttgagcaactggaaaactttatttacaattgctttttcaatcatgtgtattatgataatggggctaataataacactgagacacttctgggtcatcatgtatcctatgtttctgattacttgaaagtctctaatgtatataaactgtatatgagaaaaataaccagtggaatatttgattaatcaaaggtgtactatttctcaacctagctggggataaaaataaactgttatattaagaatagtatattttgtgtcttaccactcacaatattcttttttaggcaatagagattatgccaaggatgatccattggaatttaagtcccatcagtggtttggagcatctgtgaggtcgaaacaggataaaattttggtgagtcttctggatatttacttacaggtgattttagtcagtttatgtggagacacagaaggttttatattttcaggctgatagtaaaattcagtatgctcaagggcacagggtataacaacataagatagctctgatcaaaggccactctgtccaaggaggccatctctcttgcccttcttgaacaggctttcacattttttcacccttattcctactttgttttacctgccccacttgacagttcctatcagtttatttccacctagccaagtataggaatagtgtggctttggctaacaagtgctttaatacttcctctctctctctctctttttttttctttccctgagacggagtcttgctctgtcacccaggctggagtgcagtggtgcgatctcggctgactgcaacctccgcctcccagggtcaagcaattctcctgctgcagcctcccgagtagctgggattacaggcacctgccaccaggcctggctaatttttgtagtttttagtagagacagggtttcgccatgttggccaggctggtctctaactcctgacctcaggtgagccaccgagcctggccacttcctctctttgaaaatacgacacgatgttgaagtggaatacagaacaaagaaaaaaaaataacaaccttccttcacctcatctccccctatgccactgtccattcctctgctcctcttctcagtttctgaaatgttttctatggtaaccatcgtagttctttacttcacattccctttcctatgtcatcattgactttcaggtcactgaaatccactagcatttatacatatgtgcatacatacacaccattatgttttgttttctctgctggtatttatttttatctttcttgcactgtcagcattattcagaatggtcaacatcccttttttttttagaactaaatttttcttctcttggtttctgtgaactgtattttcctggtttttctcctatcttactggctgctcttttgtagtctcctttaatggctgctcttaacgttcagtttccaaatattggggtatccttgatctctatttagcttcctttgcttcctctaactacaacttttacctagaggttcctagcctaacccatggctgtaagtataatccccaaatctatacctctagcttttaattctccctggatccttaaaggcatatttccaggctacctatttggcttccaaatgaacatggccaaaataggactcttgtttccttccatcaaagaagaaaaacaaataaaaaactattattatatatatttcccaattttttaggaggcctgggtttccaccctattcactagtgagcactcacaatctgcctcaaaaatatatctcaacatttatcagtagatctacatgtccgctatttctaccctgcaacaagccaccatcattacccccttggaccactgcaacggctcttctcatcctgctgctgcttctcttaccctaactgcaagaaggaccagagtgaaccagagcattttaccttcttgattaaaacagtcaagtggctttctgtcactctctgcataagtatgacaagctcatactgccttaaaaacatctccaaaaacaagtcactggctatgtctttggcctcctctcactccatctcacatactaaagccaggcttatctttatttcttatacattccaaattatttcagttagtaccttagtgtttgtgtttcctctgcttgtataagttgtctttatgatttctacttggctagccctttgtcattcagatttcagctgtcactcagatttcagagactgctccgcctattttaattatttacgtagtatttattgttgcctttattttttcatctaattatgctgcatagggaaggatttgcttaggaggtgaagttttagcagactttaaaggatgtgccacatttcagcaattggaggtgaaggatggggttaagagtggggatgttctaggcagaaggaggtgcaaagaagcaggagtaaggaaaaggagcaagccacccactctggagcgtcaagtacgtgtagagaagtagctgctatgacctactttcactgttttcagggtatatatacaataagtcagtattgatgttctgcagtgcttatgttagcactttgcttcaaaaagtattatagaaaatcaattaaacctttttcactaaatgaattgttacacatttggtagattactatgttgttaaagcattcattactctactgctctatgtggtattacagtctagaatgctgaaaacaaaaaggtcatggtttatttggaaagtaaataaaataagtactgcgcattattttactctcttaataaactatttgctgtataatttagggggtatattccatatgcatgagtgttacttagttcaaaagctagtttggtctctacctttagcatagcatattacatcaagaaatatactacctgaaataacaattttgctaactattttgaaaaaaaaaaattggactacaaatatggccttcagaataatgtgagaaaaagacttcacttaatatctttatttaccactatgataagaaatttaaggtataggataggtttgattaatttctatgaatgctttgaaagttggccaggtgtggtaggtatggtggctcacaattagcgctttgggaggctgaggcaggaggattgcttgagttcagttagagaccagcctgggaaacatagtgagaccccgtttctataaaaaaatttttaaaaattagccaggcatggtggcatgcgcatgtggtgccagctactcaagagggtaaggccaattatttgagctcaggagttcaaggctgcagtgagccatgatcacgtcactgcactccagcctgggcaacagactgagaccccatctcaaaaaagagaaagtggtattatattctgaagtagtatagagcatctgaaacactaaatttttagaaaatcttcgtgtcgtggactaaacctttgattttaggcctgtgccccattgtaccattggagaactgagatgaaacaggagcgagagcctgttggaacatgctttcttcaagatggaacaaagactgttgagtatgctccatgtagatcacgtatgtataggatattgtaccagcttttaagaagaggggtgggaagcctagtttgtgaaaaatatgtgtgtgtgggtgtgtgtgtgtgtgtggagagagagagatattaaaagatatagacatattatgatgataacaaaatgaaaacaatcctactaatgtaaagatattacaaatgtgaagtaaacaggtttactttttctaagaactcattttcatcttccttcgttagtataataatagttactacctgattttaagaatctgtatttttgatgactaacagtcaaaagatgcttagttgaacttctcttaacagagaagatgtagaccccacaactaaagattctgattcagtaggtctaggtcaggcctgggtacctgcacttttaacagactctacaaggcaattctgatagataccaaagtttgagaactcctgctttatattaataatgatgttgaaaataaagaatattatgtcttaaagagccaaagtttatataggaagatgaacattgaactcaggagtcttgactctgaattttcctgctcttaatcagaatttctttgttaacctgctaccaagcccacccctttttggtgatccagaggattttatgctctttgctaatattacttgaaatttcaaaaggaattaatatcatggctaaagatgacttcaagcaattataattttgattatgcttttccaaaatctctacatcctcttctctttggagattccagtccttttgtgccccgctaccctttgttgaattggctactgctttagatcttccttgtaccagaagcataaaaataggttactgaaatgcagtatagtgtttatgcctagagcccttaggccattattttttgtgttccactggtcaccacatagtttattagagaaaattagtaacaaaagcacaacatgtaagactcttactcctacatttgttttgtccatgttaggtgacctgtgacaccaggtcaaaggaactattctgtcctccagattctaagtagttgaacctacaggaaactgcagattatttcaataaacacttattttcttagcccaacactttgatcctacctgttataagtgggaagtgaacattaaaagagtgatacctactcagatctgtattgtgtgttaggaaagagaaaaaatcaggttagaaagcatacactgcacaggatgagggaaattgaggctttatcctcagtgcttggatgccatctgtactgccatctttatgttggtattttggttatggtactgtcatcttcggtggtatgtagagaatctgaagattaaatttgtatttttaatttctatattgcaaaaatgttcctatttgaaaagataattttatagctacgaagaatgagttaacccttgtttgccaagtttgttacttattaattatatgatgtacacacacacgcagtacactcttattttcatttgatgcatgtgggaactgaggttcacatagttgaagcaatcttatttccacatctcatggggttgagagtggggatattctaggcagaaagaggtgcaagaaagcaggagtaagcaaaaggagcaagccacccactctggagcatcaagtacgtgtagagaagtagctgctatgacctactttcactgttttcaggatacatatagagtaagtcagtgttgatgttctgaatggtcaaatgaggatttaaacccaagttgttctattccaaaagaacctttcctctacattattcacaatagaaaatgttttccatttcagttgcttctgtattaagcacagcttttctacaaagaatacctcctgctttcatgacctaggtttggataattcctgatatgtaagaatacatggaactctcctgaaaacatgcgttctaacaatgattcccttgttcacagaatgcttttatttggtttaggcacagaaattataaagtcatttaaagccatattttctaaggtatttaacatccaaatcaggtcaatgaactgtggcttgtgggcctctttttgtgaataaagttttattggaatacagccacacccatttgttgatgtgttatctataatcatctagtacagttgtgagagttgagttgccacactatgtggctcctgagcctaaaatatttactgttcggctttttacagaaaaagtttgctgaaccctaatctaaataataaaacctcaaatcttaggaaaagcttaaagaacagtctcaaaaaacagaaaagcaaagtgcatgcctttgtttctaataggcctgacactttcagtaacccttgattattgtacatgctttttgattcaacctttgaaatgttaagccacctataataggcctaaattgtgaggggcatcttgttcagagaagaagactcaggagcagaagtctgagaacctgggttatattctgactttgtgctgacaatccacctatagctatgggtaattcacctaaccactctgggcctttgtttcatcattggtaaaacaccaattcacacaaaaaacttctgaggtataaattcagtgttttttatctgtttcatacttcaataaattatgcaaacgaataattggttttatgagatgatgtctgttttgtaggactacactgctaactttttaataactttgcttgtcttgtgggttattttatttatttgtttgcttttgagtttttgttgttgttgttgttggttagttagtttggttaattggtttgttctgtttttaacctgacttatatggacaccgtggacaaggaacttcactgtctgtcactaacttaccttattactgattacatttgctttcagcttttcataactgcatgataaaacctcagaccttaggagaagagcataaaaaacaacctcaaacaacaaaaaagcaaaattacttggggaaattaagtaacttgaccgtggctaaccagctagtaaataagagagtatagacctgacaccacatgtgtctacaccactacactgcactatgtcaaatcaacaatatacttatcatttcctgagtaatgacaaaggacattatgcagtagaccagatgttcttctgttctaaattgcctagccacttttgttccttctgtctgctttctgatgctaatattatttgaacatagatttttctcagtaatgatttctagttggcttttcctttccttttgtcattactcagggaatgataaagatattattgatttgaaacagtacagtgtagtgttatagacacacctgggttcaggtcctactctcttatttactagctggttggccatggtcaagttacctaatttccctaagcatcagtttccctatctgtacaaattattgagtaataatagtatctcttataggattggtataaagacttaaaaagttaatgtcatgtaaaatgctttagcataatacctgactcagagtaaaggcttaataaaccctagctgatcttactgtcagaatcaataatattactatttgtaatataattaccagacttaacaaatgggagaagtattaaccatctgcaggaataagtaccagagcctgcatcaaaatagtttatattcaacatgaagtctttaaattggcaaaagcactcagtttaatatatacctgttaagaaaattttaagagacagtcatggtttttagctggatactctgggaaaccaaataaagcagataattgtacagtatgataatcaaaaaaaggatgtctttataaatagcttgaaatagttccccagatgcaacttgaataaaggaaataaatagccgacttgctctaacttgaggttagagcagaattccttagtctgattcactggatgctggaaacccctgccccacattttcccactccctcttggttagaaaaatttacattggtttagcattatactcttgaggctattttctttcaaaaaaaaaaaactttaaaaaaatttagatattaagtgtgtaatctttgggcagtttccaggctttaaaaatgggttcaaaatttctgatgggattatttagcagaagttcttagaagtttgtccttgtgactgaaaacagatatttttggttcctgtatttgggtggcaaacaaagtaacagtacagctttaatgtatttgtaacattggccacagtgagtctttgataactgaaggatagtgttttccattgttctctgttatcctcaaagtaaaataaggggaaagtgttcagattcatccttacatgtgttctaggtactgtattgctcatgattaaaattaatttaaattaattggctaattgttcagaattaatccctttctatgagaacaactaaaaagggaacaactacaaaagagtacaactattgagcctactatggttggaaaatacttgaaagtatcatttaaagatggttactttaattagatctccgtactaaacgtgggaggatagctttatattttactttttgaagagcattaagttctggtctgtccatttcctgaaattctgagctatgttattcatctctgttgttggctctataatgtatgtatctgtttgctgctattcataataacaaaggtcttagcgaagacctagcaatcttagggtaataggaagacagaggaatttcatattggaatttttaacttgcagatcacaacttgttagtgttttatgaaatcagtgtagtgggtcaaaaccactatagtttttctaaaaaaaaaaaagaatgaaataaaatagaaaatgtcagagagtattctatataataatacaaatattgtttggtaagattttaagttgtatctatatattttatacacacaatgggtgttgggttgtgatataaattataatctttttgtggattgtggttaactaaagggtttaaaatttatcattttagttggtttctttgttctctggtgactggttcaggtatttaatcttcgtttccgtatctgagtaaatggtgctgataaacatgcatactctcttggaatgtggtaataactaagtgcccgagtgaatgaccactctcaaaaattggtacattatcttatgattctagtgatatcagattttctcatgttttgttttgtgttgtttgtttttgggtttgtgtatatttccaatctttttattttagaagatattgatgctgatggacagggattttgtcaaggaggattcagcattgattttactaaagtaagttcttatttaagactgaatgagattcacatctaccttattgactagactgtggttaaaaataaactggtcaatacctcaactcctttacagctgttagctctttaatgaaaacagttaataaaacgatccattcattttgacattctttgtcttatattattccctccctagtaaacattgcttatttgaaatagggagacatcccccatcactctgggaatggaggaaagtagacactctcctcagtaaatgataggtaactattatgacttaatattaaaatttccagttatatgaatttatagcatattaaagttttctatttttaattaaagttgtttttcttacaaaagctatcaatgagagctttattacaaaattagagttacataaaagctgggaaacatgtatgtttgccatctattatgtgcctataggcactaagtgaagctgacttcacttatgtaatgtgtaataattgtaagaaatctcataggcagggctctatgtatttttaactaaattaatattctcttcagaattgatatttttaatctattttttgaaaataagacttccatttaaatgttcaaaggtaaattttctgaagtacttttctttatttacttttcttttgtgtgtttatttattttggtggtgggggagtatgcacattttgaatatcaaattgagaatattctttctagagaagtctaaaaactatgttgatggattatatgtagaccttccttagaaagcttatatgtacgctttcttagaaatgtgagcaaagaggagtgccttaaatgtatgaaaacaactgaaattgaaataatatgatgcataagaactaataaagcattttcttattttttaaaaatttgtaggctgggtgcagtggctcatgcctgtagtcccagcactttgggaggctgaggtaggaggatcactgtagcccaggagaccagcctgagcaacatagtgggacaccatctctacaaagaattaaaaattagccaggcatgggtgacatgtgcttgtggtcctagctattcgggaggctaaggcatgaggattgcttgaactgcagtgagtgaggctgcattgagccatgttcatgccactgcattccagcctgggcaacagagcaagacccagtctcaatgtttttttaaaaattttattttatctgtatttgtattttattaattttttttctagactaggtactgataattatagttaactcttcttactaggtaacttgtttttaatactctaaatttcatactatattactcaaaattcagaatgtaagccaaagagagataaagtatattaataaatgttaggtttaaacttgtatgatacatttccaaataggtattatatatttttaaaatatataatgtccatcttttctgtattgatgcctatacaaccataaccccagaagtactctcatactgtgaaagtcattgctaaattaggtattcactttcttaaacacatttctgagaaaagggtgtctttttagggcagatgacttagaagttcttttacgtagccaaggcaaaagattgtctattgaaagcttggaagggctatatgtacatttggaggggaaaaaaaatttatcttacctccagcaagaagagatttctaaaatattgtgctgaaacacaatatacctaggattagacacttttagatagttaaatataagaaatgctaggcaagcataatttgtatatgtataatacaccctgaaaattttattctcaacttcacttctgtttagatctgagacactaaaaatatttcctttagcagaaaattcttcaatgattatagaaagaaaatttgctgtatagtcacaaatttaatatacaaaattaagaagtgccttaaaaaaattgtaacctgataatacttcgcattagtcctcatttcaaatatgtgaagcagccaagatccacaaaagtgtgtattttcatgtattgaatgaatatattaaaatgtttcttttaaattttattttagaaaagatacagtgaaaaccactgaaactgagttagatgaatttgagatttgactttgtttgctttaatatatactagatagatagatagatagatacatagacagatagatacatagacagacagacagatagatataaatctcagcactttaagaggctgagctgggaagatagcttaaagccaggagtttgaccagcttaccagcctggataagggaagactttgtctctacaaaaaaaaaaaaaagtcttattaaattttaaaaaatataattaacctggtaatgatataaagatacaatactgtattgttcagtcatgtatacatatacatatatatcttatgtttttcattgatttctattttgagagatatttgttctttaaatatatatctttttgttgtgtgatttcatctaggctgacagagtacttcttggtggtcctggtagcttttattggcaaggtaggttaatattttttaaattacaattggtgactatgtgtcgctgattcacctggctaattgtatgcctatgacattttacaaattattttaaagaaagaaatggaaatacaattaaagtatataaacactccattttacacagtgttttttaaaagaatatatataatatatattaaatatgtgtatattcctagaagaaaataaactgaatatttaaaaagtaaatacatacttttatgttaaatatattttaaaagtaattatataaagtaatttatttttattgtgtgtgatatatacttctccatgtctgtactctaggggccatgacatagtcattaggcagtgtgcgaaaccaatctgtataggccaactgtggcattctaaaagttgaaggttttgaaagtattttgaagttgctcattaggatatttaagtcattattttattattactgatattgagaatgatctctaagtgtttggggacttcttaaaaattgaagctgggcatggtggcgtgggcctgtaatcccagctactcgggaggttgaggcaggagaatcacttgaacccaggaggaggaagttgtagtgagccaagatcatacgactgtactccagtctgggtagcagagtgacactctctctcaaaaaatatatataaaataaaataaaattggaggatcttaataggtttttaaaaaatattaaactggcattgatataaagatgcattattatattattcagtcattctgggaggcctaattaaattaccatttgaacatatgtacaatagattattgttgacagtgtgaatatagataactaaaactttatttgctttatgtttctttatgtatcattagagatacacaattatttatctcatcaatatattgacatgtttagtttctgctaaaaagtgccatttatgaggtgaactattttgtattagcattctgatattcaagcattgtcagtgtttggaagaattagaaaacctttgactggattgatttgaaagtttcaaattttactctattttctacactatgctttcctgacttgcttctttgtagaaaacatgcttgcttttgccttgtggagagggaagctaaagaaagagatttgctggaggatgacaggatggaaggagaataagaagaaaagaaaactaggaataagtgaaatattgaaagggaaggcaaaggagggaataaaaaaatagaaaattcaggcatcacagacagggatcagaatgtgagacatagcaaagctgaaaaattggaatttctatgcattatacatctattgggaaataaaatgatttagaaaaattataattgagttttactgttttaaaacaaaaatagcagttctaaagtacatatgagaaaataggggatattaacactttatagttagatatagaaatatggatttatttttcttctttattgctgattatgtcattcagtggaggggaaggaagtatctgatgagcatgcctgggaaccaaaactgtcaaggaagctaaattttgtgattctcagttaggactacttgttaactctgtctttttaagagatacagctgtgaaaatgtatgacctttttttttaatgccatgggtattgcataaataggaataataataaataggaatgtgtaataattaggacacagtaataaattaggacagagaggtactattaatattatatttattagaattttattacaagttgtctgtaatatatagctagcagactcagtgaattggcaaatagtattttgttttaataagattaaaatcagcagatgtcaccctggataagtacgttagaatgaattttttcacagatctcagaattgtcgttgttagaatggagaaaagaataatgttttattcagaagaaataatgaattttcctctgttcttcaattcaggaaatgtttattgaatttcatatgttcttggtaccgctgaagcccagatgataaagtagtgacctggacagagaaagtgcttctgtgctgtagatccagtctctgtgactgaacagatgggaacaggactgaaaatgttagctgttacacatttctttctaaaacagcagaaatgataagagattactgtgtccatattgtggagacaacacttgataaaccagctatcctttcttggcatggagggcaggctgatttttgtgtagtcatctagatttcttgtctgcttaataacaaggttgtgaacaaaggtgaactcatccattcaggttgtttcctaaagatgtttaaattactagttaaaaaatatcaattgaaccaattattctgattataaaagtaacagtattgtttcagtaaatttttcatgttttaatggattagttgggtgatagcctttgattttattattccgtgtatttaacattgctttctagtgatttaagacaagtcctgttttcttaaatttttattagcagagactacttttaagtactggcttaaacagaaataattttaagttaagaatatccattttcaaattgagtatgatcaaggagagttatgtacggctaataattagaagtactaatatctaatattgttttccttcatgcaggtaccatacattatctgtatcataaagtttccatttgaaggttatttattttatatatacacccttttttaggtcagcttatttcggatcaagtggcagaaatcgtatctaaatacgaccccaatgtttacagcatcaagtataataaccaattagcaactcggactgcacaagctatttttgatgacagctatttgggtaggtaaaaccaaaatttactcatttttggaactgtggtacatatatcttatatctgagtatggtcttttaagtagaaaaatattttatgtgaaatagattaggattttttgaaacatacagaatatacaatttcaaattgttaatgagtactttggttatgttacgtttcagtaattgaaattgaagacagtgattatttgtgcagtgataataataatagctagcctttaagatatgcttactgtgttctgggcattgttcaaggtgacttggtttgtattcactcatttaatcctcacaagtcaagcatactgtattattctcattttgtaggtgaaaacactgaggcactgagacgcaaaataacttgcccaaagtcactcgcttgtaacttgctgttcagagattcaaatggagacagtctaactcctgaagttttcttcatgatgttaaataaaagttttggtctttaggacttattaacatgtgttctctctttcaatttctttatgatatattaaaacaagtcatatatgacagaaatagtacttgctgattgagagaatttatttgttctttatgatgagttgtaaatttggtgtttttaacagactcctttgtaaagttaataagacaattgtagttttgtaataaaaatagactatttgagtatttaactcagtttcatttaaaattcatatgtcatatatatatgaatctgttatgactaggggacaaaatattgcataagtaaaggagtttcttgaaaatattttcaaggaatgcttactcagcaagcctgctgaagataacgtccttgtcctgatggttctcccctttggtttcctgtttaggttattctgtggctgtcggagatttcaatggtgatggcatagatggtatgaagtacttgaactatatctaatctttaaaaaaattagattaagtatttgaaacatgtggcattgaaaattttaagcagtttgagtggctgggtgctgtggctgcagcctgtaatctcagcactttgggaggctgaggcgggtggatcccttgagccctggagttcaagaacagtctggacaacatggcaaaaccctgcctctagaaaaaacacaaaaattagccgggcgcggtgatgcacaccagtgtctagcttctcaggaggctgaggtgggaggatctccagagcccagggaggttgaggctgctgtgagttgtgattgcgccactgcactcccgcccgggcgacagagccgagaccctgtctcaaaaaaaaaaaaaaaaaaggaaaagaaaataaaattttaagcaattttaaaccattgttatggaatataacagaagaaatgaggaagatgttagcacactggtgagagtccaggctaggtctgtgctgaacttcctctagtggctgctgaaattgagacagctacacttggcttcagtgcctttcctttctgcttctttttagcccccaacactgttagtgatttccttagcattttcctccttgtcttcagcaaattcattcctctgggaggaagaattagtgtcttctttctttaggcatcctttgttaccttctgggccatctctgtacggttattaccccatcctctcattgtccatccatcttccttcagagctccgtttaggaatcacagtctttacctgattttgatcacatttttgtgccacagccacttctaccccacttcagtttgctctgtattatttttcattactgtactactaaactaaatgtagtttttcttcattcttaggttactttatcttgtctattcttgtttaacaatattacaaatgacttgagggcttatttgcatatgtttgagagccctccagaatttgtattttgtaaattttgattttatagtttaaaaatgctgggctatttattacggagtaccaatttttctaaattgattgtttgttttgaactgaagtagtaaaacttaaagcttgctgacatagtcacttctggtctgcaacttccagtgttgtcctaaaaaatgaataatttgtttgtttgtttgtttcagactttgtttcaggagttccaagagcagcaaggactttgggaatggtaggacagttaaaaggtattttttaaaaaatctctaagttatcttctattttaccagatttcacatacttctatttttccttcacaggtttatatttatgatgggaagaacatgtcctccttatacaattttactggcgagcaggtatgcttccaaaatatgatcgtcctctcccactataaaagcagtatgtactcattggagaaaatttgcgaaataaaactgtaaaaatgaactataatctcatcaaatagataattcttccaactcttaccattttggtcaaactattatcatttctcttttgagcgtgtgtgtgtgtgtgtgtgtgtgtgtgtgtgtgtgtgtgtagtatataaacaaaaattggtttactctgtatttttcattttgtcttgcctttttcactcaatattttatcatcagagtttctaatttcttaaaactttccttggcagtatcagaatggtttaatgattccataatattcaatattctagatataagatgggctttaaatatttcatctttgttttaaccaaagtaatttggatattttggcttgtttttgtttccttttttttttttttttaggaaatgcaaaatcacatgcatacaaaaccacaaagacttcctttttctttactgaaaagaaaaaagagaaaagaattctttaaattcttttttaaggatgatcaatgccttataattttattagatgcaacagaaagcatggcacagatatgtgtattatagatattataagcgaacttcatttttactacatgaaataagatatttctcagctaaaaaaatgctagtactttttaagtattagacatttctctgcgagtacaggcattttataatattctctgttgtatgtctcaaagaattataccataagttggtaatgatgaataaacatttaaacagtaggtagagaaaaatctttctcaaagtttgcagatctgggattcaagcctttttgttcagttgagattgttgggctttgggataggattgacaggctgactgactagactcatggtccccagaaacctcctcccatttgtatggcagtcaagattgatgcacaacctggagggccctgcagttgacaggcagttagggttgctgcaggggtggtccctttgttccgttttgacttctccagctcaagcagcttctcctgtctggtgaccatgtatgagtctggatcctactgcatgcactcaatgatacttgctttattcctccttccactattgggaagtgggggtggctagagaggagtgggaagcgtggcttttagatgaggacaaacctgggttttccatgctcaatctgttattgcattggataaggtatttgctgctgaaaatctgtttcttatttataaaaatagggatgctgacaacttcctcatgggacagttgtgagaatcaaaagaaaacattcgaatcatagtgcccgggacaaagtgtgtctcagtaaatgccatcctttctttacacttccaagccaaacaccataggtgactaaggcccatgaatattattctgttacatagtcggcacatcaaccttgtaccccaaacacagtatattttatttcacaagctctgaacttgttatttaatacagaacacacctttcattttcccaattacactgtatcaacccaaaatagataatgcaggaatctcccttatcattctcccttgatatctgagccaatcaaatttgagaagcattgctaactttccttttttggtttgttgactcatttttcaccttactttatatttaatctgtcatctcttttagttttgttttgcactttcagctctctttagagctttcctttttcacatttatttacagctaagctgctcatcctatgcaagcctgtggtctcctgtggtagggaagaggacatttctgctccctgtgcattataagctcataataaacccaaacacatttgtactgtgtgtgattcaaaagcaaaatcatgtggcaagtaatctatagagatatgacacaaaaatgagctcctttccatatctttccaaacagtaatttttaaacagtagtagtagttacacataggggagccaattattatctgttattaataattattatctattatcctcatgacataggcatccatataaaacttgttgggttcaatcacaacatttgtctgtgactatatatctttgttagtgtgcttgtgtctggtatgttttgggaagtggagagaaagggagatagtagggtaggcctgagaaggagaattgatagtccttagacttaaatgtcatatatcaacaacactggaaggatatacatgtaatatattgtgtatatacatgtaatatattgtgtccatgatctaggaaaacaacaagcctcattacctgattgtcattgtgttggtagaataaacaaaagacaagacatttagattgaagcactatatgcagagaaaaaaaataaccctatttggtacatatattacaaatgttaattgtctaaactaattggatgaaatataaacatttcattttcatctttttatccagatggctgcatatttcggattttctgtagctgccactgacattaatggagatgagtaagtttaaaaaaaaatgtttccagaaagttatcttctcatgtttacgaatactttactcaaactaaacatttttttcttctgtttttgtattccttttctgctaatctttctgtttaaggaaacaatttgaagcaaccttaatcatgaattctagaaaacctcatatgtttgttctgttttttttcagtagcttttataacatgaacaaataaagtaattttatgaattattcatagtttcttaaaagaattaaaggaagtttcaaatttgaaatgagtgctctggtaatcattttgtgtttcactgtgggtgtgagagatgcagaaagaggaaaagtgagttgtagtaagaaagaaaatgcctactaagacatgaaatttgttcttgctttggtgagaagtttctgttcttctagttatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatggtaagatcaaagtttagcagctacaggtccctgattatctgtgtccacctggaaaagttctgtaagtccatctgtagaagtctacacgagcaaatctccttcctggaaaggtggattgtgtgtaagtgagtaacacaccaaatttaaagacagtttgctatttttctttaaaaatcagagcaaagatttcaataatggactctcatgagttattattcacttggcctcaaattagaaggtcagaatgattactttctgaaaggaaccttcattaccctggtgcctactgctagctggtatgtgtttctgcatcctgcttagcagcagtgccctcttctgttcatttggctacaagtgttaaaaaaaaatgcttccaggcacattgtcaaggcaatgctgactaatgcatacctcaaaggtatgatttgccattaatatttttaaagccataactttgttgtagctgtccaaaatgttctaagggatgttatatctccctttatggtggcatattaaaagtataagcctattcgtttataatagtaccattttaatagttgtcgatatctttaaaaagcaaagttagcttttactttagaactcttttcagaaacctgaaatataggttacaaattaccaagattttttttttaatctgttaaaaacctttctagagatcacagaatggatagttgaactagtttgtgtaatcaacagtatagtaagcctatgcccccttaaaacctaaaggaaaggtatacattaagaagaaaactttaaaaatacagatgacttgttgtatgtctcaaacagtagtggaaaggtaaatgttgtttgccctcaagatttcacacctgtcttgtgggtaggtgctgtcatttactagatgtgtcatctggaagattaaccgtagtcatttctttttctttgtttctttcttttttttctttttttttttttttttgaggcagggtctcactctgtcacccaggctagaatgcagtggtgcaatcatggctcactgcagcctcaacctcccagggtcaagagatcctcccacttcagcctcctgagtagctgggactacaggctcccaccacctagcccagcttattttttttagtagagctgaggtcttcccatgttacccaggctggtctctaactcctgagctcaagtgatcctcctgccttggctgtgcgaagtgctggaattacagatgtgagccactgtgcctggccaacaggagaagtttcagtggtagggaacatctactcagaggtacatctgctacctaaaatagaggcttaaagatttttaccacaaagagaacttagcataaatcaaatggagctatggtatgaagttcataataaaatgtgaaaagaacactatataacagaccaaatcattacttaatcataacaaaagctacataggaaatacagggctaagtttgaggttccatcatgaataaagttaatgaattctttgctatgtagctgggcctctgtctcccaggttttctgggaagcctggtcatgtgtgatcttcaccttgtcttgatgttattccagttactttaaagaaagttttctcattactgtgatctagccaacatctcttccagctttctaagtttttgttataatgtgtcgtctgtcagtagaacaaatatagacaacagctttaaaaaatgtgaagttttacaatgattttacaaagggctaaaatatagataaaatcatccatagaggatgattatggtctcccaaggtttctccttgggtcttactgtagcaaatagtagattgtgaatgataatgtctttagtgaaaaattatctgagctgtatttatgtatagtatttagtacatatgtgcaaatatagttacattatacatgtatatgttctattagttatgttagatcttttgttgttgttcatacatgaagacattaagtgtcattgttcctgtattcctatattcctctctttccacctacccccaccctaggcatcatcaagagggatattgaaaacaaaacaataaagttatgttccaaaattttatatagccccaaggtaattatgtgcagttttttatcagtacttttccagaaaaagcagaggaaaaaaaagaaaagcaggaaagagcatctaaaatgatcaaaggaagaaatcaattgcatgaatgtgtaggattttccagactcgacagatgatagcgaagagagaagatgattaacatgtataaaataatgaaacgtttaggaaagttacagataatttttattaaacagtcactcaacgttggagccatcttttgttgcaaaattatgttttaatgaatactttatttattatttgttgagacagggtattgctctgtcacccaggctggagtgcagtggtacaatcacagctcactgcagactcgacttcccaggctcaagcaattctcatacctcaccctcccaagtagctgggactaccaatgtgcacctctgtgcatggctgatttttgtattttttgtagagatggggctttgccatgttgccaaaactggtctcaaactcctgggcttaagtgatctgcctgcctcggcctccaaaggtgataggattacaagcatgagctaccgtggccagcctgttttaataactactttattaatgcatatgtcagtagagaagttatgcttatctttggtttttttgtttgtttgttttgttttgttttttgttttttttttagactgagtctcattctgtcgccaggctggagtgcagtggcacgatatcggctcactgcaacctccgcctcctgggttcaagcgattcccctgcctcagcctcctgagtagctgggactacaggcacccaccaccatgcctggctaatttttgtatttttagtagagatggagtttcaccatgttggccaggatggtctcaatctcttgacctcgtgacccacccgcctcggcctctgaaagtgctgggaatacaggcgtgagccaccgtgcccagccgatttacctttaaggcttaaaaaaggataaaaagaatacttttacataagttaggtactcatttttaaggataacaaattcttagttggtgtttactgcaggccaggcactcttctaggtggtgaaaatgagcataaatcagagtctactcatgtctttaagaaactcagcatccaatgggggcagcatatatgtttaaaaaaaaaaaagtacctcaatgtgatcatcacagtgtttgagatcccaggcttaatggtctcatataaaggatgagtgatcaaggcatcgttgatgtttcaggggagccaggagatgatgaggcatggcttattaaggagctatgagacagctcgtgtacattaaggaaattgaggcaatttgttatgactggtacgtagggtctgtgataggcaagatacgacatgtccttggtctcatgaagcttatgttctatagcttacttactttgtgtagtcatagaataagtaaacaatggggaaatccagatagtgataaagatgatggattttttagaaggcaaggtaatataatagagtttcgggatagagagggtgatagagaaagtagggggtcgagaggggtggtgcactgctgcgtagggtggctagggaatagcttgctgacagaatgacagctgatctaatgacagaacgacattgatctatcatttggacaaatagaaggaatagagttgtaaaagctctggagcaaaaggcagagagaatagcaaatacaagcccatagttggaagctagcttggtgtgtttaataaacagaaaaaaaggccaggattgctggaaagagtaaataagggtaaaaaactggatggcgtgggggtggggatggggagaggaatgagatttgcatggtaaacaatggaaataccaggtagggtttagaacttactctaaatgctttgggaactaattgaaggattttaagatggggatgggtgtgacatgatatggtgaatgtttggcccttttgaagagaaagttacaggcaagagtagaagtgggaggccacttaaaaggctgtttaaggccgggcgcgtggttcacgcctgtaatccccccactttgggaggccgaggtgtgtggatcacgaggtcaggagatcgagaccatcctggctaacaccgtgaaaccccgtctctactgaaaaaaaaacaaaaaaaattagccgggcatggtggcgggcgcctgtagtcctagctaatcgggaggctaaggcaggagaatggtgtgaacccaggaggtggagcttgcagtgagccaagattgtgccactgcactccagcctggggaaaagagcgggactctgtctcaaacaaacaaaaattaaaaagaaaagaaaaaaaggctgtttaagtgcaaaatgcggcaatgacttgtctagggtggcagcagcagagagagaagtgggcagattggtaatacattttagaggtagaaaagataatttggtgtttggggttttttaaagatttaaaatgttattcatttatcttctttcagtgtaagttgagcaagatcaagatgaagtcacaacttacgaatttctgagcagattggcttctgttcagaaaaaacaataccatccataaataaattatctagaattttgagagtgaaaataaactttagatgaatcttttgatgtgtcctcctccatcccctacccctagttttaatgaggaagcatttgtggtccagaaagtttaagtgattggtttaaggtcagagccagattatctggccctaaattaatgtcttttctgtacagttttgcttgagtttccttgaattagattattgcttatggataaagagtaccctactgaactttgaattagtatttatcatgatgaatgggttctataaatattaagatctgtacaaataattacaagtactgaaactttcttctcttcatccttgccctcttccccccttctctcgttccttcctcattcttccctttcttttcctcctccttacttctgtcattctccttccccctcctctttttttccccacagatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccaggtgctttcttatcaacacatagagcccttagatttttcagtcctaatagcaaatagtattagttactgttcttgatttatgttataaattattgcaattcagtatttcatatgttgatcaaacctctaaaatattcaaggcatcattcccgtcacctaagggtatatgaagaaaagtcagctctctttcctgggagtgtacagtgtactctgagtttctcctgtagtctttaatgaaatgagaagagtattacagaagttataaacaaaagttaaatgctcattctaagctgttttaatgttagctatcttttttatttttttaattatgtagaatatatgtacttgactaatagttgtgattttttttttttttttaagacaaggtatgtctctattgcccaggctggagtacagtggcacaatcttggctcattgcagcctccacctcctgggctcaagccatcctcccacctcagcctccttagtagctgggactacaggcaagcaccaccatgcctggctaatttttgcatggtttgtaaagagtggtttttgccatgttgcccaggctggtcttgaactcatgagctcaagcgatccaactgccgtggcctcccaaagtgttgggaatacaggcgtgagccaccgcacccggccttcattgtgatttttttttcaagtatattattttatttaattctcccattaatacatgagttaatataagctcatttttatagctcattattataccatttctgaatgtaaaaagagactgagaaaggcagtttacccaaggttgcccactgcataggtccagtagagcaagcaagacctttttctggttcttatacactttggagcattataaatggatctaggatcaaaacagatcttttctttaaatgaaatacagtgtagaaaatttagatgacctttgtgttgaaacacttaatatgagctcaatatacaagtgtgttggtctgtttccagaaataagacatgaagtggattctcataaattagtagtattttagagtttttttgttataaatgcaatatatttgttatagaacttttagaaaatacatcaaagcatatcttttcaatgtttttcctgtgcagtcacacacatttttttaaaaaggaaatcatgcttttatatgctattcatagtgttttattcaacgtttcagaaacatttctttattattcttctaaaacatgaattttctgtttccctttgtaacaaatagctgcatcatatcttatttacctttttttgtggcatttttatctttctttataattcttttgcatatctctgattatgtcattaggacaaaattcaagaatcactgtgtcaagtgtgtgcacttctttttttaaggttattaatacacatggtcaagttaccatcccactccctccacaggaaggtttttgtcaactttttaaagcactcaccagcagtaaatgagtcattgttttcccatacttgtgcttcttttaaaataatttttaactgtataacaggtggacagtgtattttaactaacagtttgtgattctagaaataaggcatgagtttgattcttttttttgagatgaagtctcgctctgttacccaggctggagtgcagtggcgtgatctcagctcactgcaaacttcaccgcccgggttcaagagagtctcctgcctcagcctcctgagtagctgggattacaggcaggcgccaccacgcacagctaatttttgtatttttagtagagatggggtttcaccatgttgatcaggctggtcttggtcaggctggtctcagtcaggctggtctcgaactcctgacttcgtgatctgcctgcctcaacctcccaaagtgctgggattacaggcatgagccaccacacccggccatcaggttgattcttaactatacataaataaaaatgattatttttactaataatctaatgtatagttatgaggttgattcttaactatagattattagtaaaaataatcattttcatttgtgtgtatatatatatacatttgtatatatatacatttgtgtgtatatatatatacatttgtatatatatacatttgtgtgtatatatatacacatttgtgtgtatatatatacacatttacttctgtgaatttcctttttgtgtctcttttttcttctttgctactgggattgtattttgcttttctttcattcattcattttttttaaactttcacagtgccttaaatgttgcaaatattaacttcttaactcttttatgtattttctagtttgtcagatttgcattttgagcataaagttttaaacttttatgttatttaatctgtttttattttttttttcatgtgattttctgtttagaaaagacttcctcaaatttagcttgggtatactgtgagatagagctctcatttgactttttctgaatcgtgaaccagttgaacctgtggcatatgaaaactaatgcatttcattcttgctgattcgagtgctatctgctatagtattttatatatatacacacacacacattatatatagaaaatagaaaggaaattttacagtaagattgtaaaatccacaggcgtctataaagctttttcctttggcagtatgtatgtttggcaggtgtatgattatcattgctactttttactaaatattcatttaaaagatttatatccacctagatgaaagtctactttatgataagcattttccactggtggtagtttgtttacagttttcatatattttagccttttatatgatgtcttacaacctcttaatagttttgagaatttgttcaaacctttttatattcattgaaaattttatagaatggtatatacattttaaaaaccattatcattattaacatgtttttccactctttcttaagacttaattgtaggagcttttggtgtagatcgagctatcttatacaggtgagcattttctgtatcctgcggtataggaatattctgaattatttgaacgttttttaattaagtgtcagtgtttgaattttagtttaattttcttgaaataatgataaaatttgctctttctattcatgatttgctatgggcaaatagtattatttttattggtacataataattgtacatatttatggggtacatgtgatattttgatatattcatacaatgtaattatcaaatcagagtaattaggatattcatcatctcaaacattgatcatttatttgtgttgggaacattcagaatcctgtcttccagcctctcttctagttattttgatcttttgttttctttggagacagagtttcagtgcagtgggaccatctcggctccctgaaacctctgccccctgggttcaaacaattctcatgcctcagcctcccaagtaggtggggttacaggcacatgctaccacaccggctaatttttgtatttttagtagagacagggttttgccatgttggccaagctggtcctgaactcctggcctgaagtgatacacccgtctcagcctcccaaaatgctgggattactgttatgagccactgtgcccagccagctattttgaaatgtacaataaattattattaactatagtcaatctacggtgttattgaacactagaacttcttttttttttttgcccaatctggagtacagtggtgcaatcttggctcattgcaacctttgcttcccaggtcctagtgattctcgtgcctcagcctcccgagtagctgggactacaggcatgtgccactaccacacctggctaattttatgtatttttggtagagacagggtcttgccatgttatctgggctggtcttgagctcctgggctcaagtgatccaccagcctcagcctcccaaagtgctgggattacaggtgtgagccactatgcccgccccttctttgtcttttaaattatgttcagaggtattctcctgtagttttaatctctctaaaaattgtctgggtttacattttcctataagaagcaggaaattaacctcatgcttatgtcttggtattctctgaccacaaggtcagtatgtaatgaaaccccaaatgaatatttttattagagcaatatgtatgaatttatatatttctatttcccaatttcttatatatccccagttattctctgtatttcatcaattcctcatgacgtagaatatcagttggcatcccaagtagttaagatgtttatatatctatgatctgagtttatacatggcaggaacactaacattagtgctatgtagcggagtttgcgatgggtcaatttaattgtagctatacaatacttaacagatttcagatctttatcattttgagacaggcacattgacttgagccagctgtatttttgtataggatttaaacctgtgtatctgaactcaggaaaactgtatttattttaatttattgtttttagtttttaaaattgctgttaattgtataatgtacgtggtaaaaatgcaaacactataagaagggtatataaaaaaaagttttccctcacaccagctaataatttatttgtttcttctattagaaatattctatgcattaaaaaatcatattatgtatgtatgtatgtatatcagtagacattctttgtactttttgggtttttttttctctcccactaaaactatatgttggttatgtcttagaggtcatcccactcattttctccacggtagtgcagcgaattcggtagatatctcacaacttatttagccattctgctttagtgactgaattcatataggccagccattgtcccactttgtctggaactgagcgatttcccaggatgcaggagtttctgtgctaaaattaggacagttctgggcaactaagacagttgatcacctacggttatgttgttcctgttccttttactattacaaacaatgcttttagtagacatggtactatatatgtagtgaatatgaaccaaaaatatttcaatcaacctaactttttaaataattttttacttcatcttcttttccctcccccgctagggccagaccagttatcactgtaaatgctggtcttgaagtgtaccctagcattttaaatcaagacaataaaacctgctcactgcctggaacagctctcaaagtttcctggtaagggtatttgtttaataatagttattattgtgattattgttcaggcattgtaagaacaattgaaaatgaaggtggtagggctgaaatattgctaaaacagtttctgtgagtatactgttttttctattctttttttatttgaagcaaggtctgcctctgttgcccaggctggtgtgcagtggcacaaccatggcttaagtgatccttccaccttggcctttatagtagctgggactacaggtgtgtggcaccatacccagctaattttttaaatttttttagagatggggtctccctatattgctcaggttggtctcgaagaccgctgtgctcaagcagtcatcctgcctcagcctcctaaagtgctaggatttacaggcatgagccattgcacctggccttatactctattttcatgttataaattggattatagaaatagtgctccaaaaaggatatctaaaggctgtaaagatactctataaattagtatgaaattaatttttaaagaattatgcgtggtcaatgaatattttcaaaaagaaagaaaagctaataagatctcagttcatttatatgtaattccaaacaggcccatgaacacttacatttttaaaagatatcttgtttttctgatttaatatctatgaacagttgtatgaaaaaaattattttgctctaatatattaattttctgcttattcctttactagtttccaaagaaaaatataataatttttcataagttaaatgtctgaattcttctctactccattctttctctcatctttgtcatttgtatgctacttcagtaatttttgctctattttcattatagatttttttttttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccaccaacacgcccggctaattttttgtatttttagtagagacggggtttcaccttgttagccaggatggtctcgatctcctgacctcatgatccacccgcctcggcctcccaaagtgctcattatagatatttttttaagttgtctcgtgctttacttcacagtatttaaaagcaaaatgtagaaaccagtatctttctcatacatatcaatataaatataaaactaatgaaaaatcttgacccatatactaccaaaatcaccatgagtagtcattcatgagttcccactttgggaaacactattcatgttccttacttacacagacgagttgcagagaacttatgatcaaggagaaaatgattggtgcctaaaaaagttttacttcaaaagagccaattaaagatattgttcctgaatttgtttttgaatatttttgaattattgttatagttattaaaattttgaaactttcatttctttaattggattacatttaaaaattcagtaatatttggtcttcatttttattgaactggcaatgaagttgttttcaagattttgctgtaagttttactgcttttctaccctgcatacctctgtgaagttgccaataatctgcttctaattatgttagtaattcaaaggcttcaaatgcactaactagagcagtaacatcatatgatttttgagtatggcacatagaaatacattttgcattataaacacataaaagtaattaaatcaagcatttcagaaaatcgtacttacctttgatacctaaatcagttttatttatttattaaaaaatttttcttaagatgctgaacacaacccattaaactggtttcacaacctgctaataaattgtgaagaacactgctgtaaaggaggttgctaattaaagaaagttttggtgggtccttttatcaatgagacagtttttaaaatctgaaccgttggctaggcacagtggctcactgtaatcccagcactttgggagaccaaggcgggcgaatcaccagaggtcaggagtttgagaccagcctggccaacgtggtgaaacactgtctctactaaaaatacaaaaattagccgggtgtggtggtgcatgcctgtaatcccagctacttgggaggctgaggcaggagaattgcttgaatccaggaggcagaggttgcagtgagccgagatcgtgccactgtactccagcctgggcaacagagtgagactctgtctcaaaaaaaaaaaaaaaaatctgaactgtcatacccctcatttagatttatcaataggttctataagcttgagagaaagttaggacattatttttctttttttcatcaaggtaccatgaaaggaaatgtgcttaaattactgaaggatgagttaggttagtgtatatagtttcatgtttttagaataatattaagacatgaagaaagatgtaaggcttcacaatacaaactatgtagtagaaagatgagatgtgggtgataataaaaatatgtctaaactgaattatagaatttatgtatgttttttatttttccacagttttaatgttaggttctgcttaaaggcagatggcaaaggagtacttcccaggaaacttagtaagtgttctatgaaaaatcatattattttaatgatactgcatacacagcacttaaaaaatattttaagatattcaaatagttacttgaattgttattataattttttatttgaatgtttatgcttaaagacatttaagatttcaacataattatattctttggtaacccttaagctaattcaaaaataatacacttatttatggacattatgagctaaatagcccacagaatggtaaatatgacctttagaagtttaagcagttacgaatgtgacataatgaactctggggaaatatgaatattatggtttataagtagatgatctgctgagaagtctgtattttatgtctttgagcagccccaagcaatctcaggagtagaggtggtttagaaatagtgagaaggaggagaaaaagttttggtcatgcaatttaattcacacagcaaactctactcttcttttcctaaaatggttgatgtggtcctgagagcaagataggcaagataggagtgttaaataattattgccagggtttgtcagtatgttaatggcaagtggtaaggaataatagtaaagcagagaagaaactgaaactgttgggtgtgtgtttgtgtgtgaaagtttacatagggcagccaagtaaggtctccctaggagaaaacttttcagtagagacctgaaggaaataagggagctatgggatgtgtggaggagtgtttgccacagaggaactggcagtttcagcaggcctgaagcggaaaatgtgctcagtggttgagaaacggcatggaggtcaatatggcctagtagaacagaacatgaagcaaaataaccccgggtattcacccaaatttgaaataaaggtcaccttttagagaaacttgcgacgcgaattctggttttaaagatttgcactctcttaaactatttaaagaactgaatcttacaaggcagtaatcctaattgctacatccttttacaatgattcttgatgcatttaactctgtttgatcacttgcttcctgaaggcatattcatctgacagtttgatatgatagcttcactggaagcaggagtttcaagtggggcaaactgttcattcatcatagtgtttaatatgatggtatgagtacatatgagcaaatacttcttaatcaaaatcagcaagactcttgctacttgaatttatgatggaagtcttaattcacatgtttcatcctctggatttcctcctctcagcttaaattaaaagatagcatttctcctgtctgataattggcttactactatcatttttttgggaattatttatgacattactttagggaaagtttgattaattatttaattattattaaatattttttcagaattaatatgttgtagtctcattacaatgtaatgacattttaaattaattagaagcaatttacttcttaaggaataaagatctctgtttacatgaaaactctagagtaggatagatagatgtccataaagaatatgttggttataaatcctttggtttacatagatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggtaagagctaacttttctgctaccttgttgttcctttttagtcattagttttttatctaaatgattttcactttctgtaaattagtgttagatcaaaaggaaaaacagaaaaatacacaaaggaaatttagctttgtaaagtgtcatacctgaatgatggacttctacttctggcagattggatattccaaatggcctttccacaacaatactactgaacaaattatgataaacatatttcttaaatgcaactgaactttcaagacagtaaaagaaatcaccagagtccaaaaaaaaaatgagcaatcaactaaaaaactccagtggcaaaaatctgaattgtgagttataagcaaatatatgagcgagagttgctggcaaaggatgaagcctaaggagagggcaggtggtaattgcagacaccagcacaggaattccgacagttgtataaggctaagtgttcttacgacagaggtgcattctgattccagcaagagccaaatgtaaaaccttgctgaaggggagcaatccagtatgggccccaggatttccataggttaagtttgatcaaatatgaattcattaaacacacacacacacacacacacacacacacacagaagccactagaagaagcatcagattttagacccacaaagaccagctacagagcacaaatttgtataaaatgtttaaagaaataaagggcctgggcacagtggctcaagcttataatcttggcactttgggaggccaaagcaggaggatcacttgaggccaagagtttgagaccagcctgggtgagactctattttatttaaaggaaaaaacaaaacaagacaaaaacatcagtaaatatttagacaacaacataattaatgaacttgatttaacagacttatatagaacctacacctaacaactaaagaatatgaaaactgaccatgcataggccataaaggaagtctaaacaaatttcaaaaagtaattttatagaatacatactatcacagtgcagttgttagaaatccataacaaaaagatcaactgggaattgggaagtgtgatttttaaataacttatgggtcaaaaacaagatcataatggaaatttacttgcaaccgtattacaatgaaaatgtgacatcaaaatgtataggctatcacaacagtagaatgtaaagataaatgtatagccttaaatgctatttaatttaaatgaaagttaagaaaaaatgaaggtaagaaagaaacaccacaaaattaagaattgagatgggacattacagataagggaggaattaacagaatattttgaataaccttgggccagtacataggaaaacttttagacaaatcatggaaattcttagaaaaacaatacaactgtcaaaagaagaaacagaaaacctgaataatcctctaaacacttaacaaatagaattggccattaatctttacaaaacgacaaagcccagatggttttataggcaatatctatcaaacattcaagaacaagacttctcaattttaaatagctctttgaaagaaaaaaaaaaccaaaatatttcaaagtcaatctgtgaaactagtgtaattggttcctggagtggtcaaggatagtaccagaagggagaatttcattctagtcttacaatagatgtaaaatgactaagccattataagcaaataagtcttagcagtttgtaaaaaaagatacataaaccaagttggatttatcctagagtgggttaatattaagtctaaaaatgtaatttaccacatgaatagattaaagaagaaatatgtgactgtcttttttaagtgcaaaaaaggttttagagtaaattttaaaaacttcaagatttaagaagcaagacaaataccccaagttatgactatgaagaaatagaatcttacatttaaacaaagtccaccaatacctattaattggtcaagatgtgaattaagaattcttatacattgcggacggcagtgtgaattgttttgaagactggaaaataatgtggtactacagaactgacaaatatacttgtcactatatataagaataatcacagcaatttctgtaatagcaaaaacaaaacccataaacaatcaaaatagcctttgacagaatggataactgaatgtatatttacatgatgaaatagtactcaacagtacaaaattaacgtaggctacatgcaatagaatggatggatcttaagagtgtaggacagaaagcaagtcacagaagactacatgtaatcctattgagaaggaatgcagagggaggaagagaaagaagtatttgggtagcttaagcagtatcaataatgttcttattatgttgggtgtgtgtgtttgagtgctcatgttgttaacatgtctcgtactttcgtgtgaatcaaatagtacattgtaaaacaaaaattgactaaaggctcttacttgataaggataatcttcttttggatattctatttctacataagtataattttccagagaatgttgttagaattgaaggctcagggatgaatacagctggctttgtaatgtgcacttatggatttctccagataatttaggttgacgttatcattaattcaaagcgtttccatttctaggatgaatctgaatttagagacaaactcactccaattactatttttatggaatatcggttggattatagaacagctgctgatacaacaggcttgcaacccattcttaaccagttcacgcctgctaacattagtcgacaggtactgtactcagtttaccactaatgtgatattttgttatttttttttacaattcatatttttaaatattagaggagatttcctttatcatattgatagatgtttagtcaaagtcagaagtttaggaatctgaattttctatttttttttctttttggtttttatttttttgggaatctgaattttcaagtcagagatatttaaagccactcaacatggagatatacagagaaagacatttcatatacatgaaataggaaaataattcaagaacagcaaagtgccagtttgtttacatagtattttagtattttgctaaatatatttgatatctgttatttttgatattttaattttaaaaagtgcatatatagtaaataaataattcttttcagaaaaccaaagaaagcaacaaaatttgataggtggtattctagttttagaaaatcttatgtgtaatgtatttaaatattgttaattctagttactatttctcctttttaaattacatgttcatgtttttacattaatatttcttccttcataactctttgccctaaatttagtttatcattttttttttgtctttctgagatcccataagctcttttttttttggtttgttttctgtatatgtgacagtagcaaaaggcaaattaaaatatttttaaaagtcttttctaatttttatattttaacaatttcatatttcatcctgtacattaataatcatagtatatgtgccattttctagtattcattaacatagaacttataaccatacttctgtgtttatattctttacattttttatttttaatgaatgcacaatattatgttgattaatagtttaataatgaccatctgagcctcttaatgtctgtcattcagtattatactttctttgaaagttaattgttacttgtcactttatattatgtgctttcatatatgggttatggttattttctgtttatagttttataattttttagaaatcttttattatcattgttatcactacttttgattaattttccaaactccccatccaatttctttaatgccaataccatgttaaaaccagctaatcaagtaggctaacttttgaaacccttggagggcaagaataactgcagtaatatttgacttcctttttttcccacctattctcattcttcattgtttgaaaaaaatttgttttggtctcctctgtgtcctacatttgttccatcagtgacattattaagttttaggtatgtttctttctgcgttcttagctttgttattcgctcttgtttttatgttaattacttaccccaccattttcatcatttccttttctctaaaatggatgcttcatttcactggttacgttacaaactcttccatgcactctctctttgctgtcaaatagaaatacaaagttttaattgtaatttttaatttgtaatttttaatttgctggttagcaacatttttttaaaaggtagaaaaggtataggtgaaatttattttaaaaatatatctatattagttttctagggctgtcataacaaagtaccacagaatgggtggcttaaacaacagaaattgattctctcctaattttggagcctagaagtctgagatccagagtcagcagggctaatttcttctgaggcctctcttcttggcttgtagacagtcaccagtcaccttcttgtgtcttcacatggtcttccttttgtgtgtgtgtctgtgtcctaatctctttttaagcatcagtcattggattagggcccaccttaaagacgttttaacttaataacttcttgaaagaccatattgccaaatacagttccattctaagatactggggattaaggcttcaacttatacattttggggggacacagttcagcccttaatgatatttaaaatattgtcatttttacatggaatcacttaaaaattatcagtggaatattttgcattctgttttttactgtcttcaaaatccagaatgtattatatacttttaacacatctaaattcaaatatttaggttttattagaaattttttttgtatttagaatccatgtaattcacagttgaaaaagtagattcaaatactcaagttgttctaaacatactaaaagttttgtagtaagagaattaagcatcagcttttaacattaaactaatttaaattaaataaaatttaaaaatcagttcctcagtgacactaagcccatttcaagtgctcagaagccacatgaggcttgcgagcggttactatattggacaatgcagttctagtgtttccctttctgctccctaatcctttggtgttagagatttagtgctttctgcagaaagagttgggtttttttctctcatttttttcattcaaatacacattaagttttttttgtttttgttttttttttttttttgagacggaatcttgctctgttgccaggctgaagtgcagtggcgcaatcttggctcactgcaacctccgcctcctgtgttcaagcgattaccctgcctcagcctcctgagtagctgggactacaggaacccaccaccacgcccggctaattttttgtatttcaggagagatgagatttcaccatgttgtccaggacagtcttgatctcctgacctcgtgatccacccaccttggcctcccaaagtgctgagattacaggcatgagccaccgtacccagcctcaaatacatactaatttcttactttgtgcaagatgtaatatatataactgtagagacttggttttctgagcatggaagacattgcttttccatttctgaaactatctttcctgacagcatattttaatactatggctgcttcaatgccagctaagtcctttttttcccctatagagtgatatcagccaaatatctctatattacagttttattaatattttatacatatgtctcattgcaaacttaagatactcatctaacattctaactgggaatgttatacataccttatcactagttaatttgttatctgtaaagtccacactttgatctaatcaagcgttgatttatatttggcatgatgtaaagaatcaccatatagttcttctaatagtccttttttaaaaaggcttatagcaactgcttatatctaggtaattgaattaattcacgtatatttttgtgtttccttcaaattaaaacgacagttacgaatctttgtccaatatatagccacttgcaagcctcatgtggcttctgagcacttgaaatgggcttagtgtcactgaggaactgatttttaaattttatttaattttaattaatttaacgttaaaagctgatgcttaattctcttactgcaaaacttttagtaagtttagaacaacttgagtatttgaatctacattttcaactgtgaattatatgaattgtaaatgcaaagaaaatttctaataaaacctaagtatttgaatttagatgtgctaaaagtatataatacattctggattttgaagacagtaagaaacagaatgcaaaatattccactgataatttttaagtgattccatgtaaaaatgacaatattttaaatattgttaagggctgaactgagttcccccaaaatgtgtatgttgaagccttaattccggacattccttgtgacttggaagtttacaatcatcatcctttttttaaaggactctatctttcttttcctttaaatccttttctctcttctttttgtctgcttctgtgcttgaagccctttggatgttaccagtaggcaaagcaaaaatggcctcatctttattttccattcttttcttaatttttatgtttcttctttcacatcctatccagctcctctgcttttttcccactgtttctctcttttgggtgtttccattttgctctagctggaacattctcctggccagatctagtggggaaaaagttcaggtctttgtttttttcacctaccctgattggttaactataatgcttcaagttccttttccttcatctttttccaaatgaccatgcaatgctggactcattttatccagtttcttttgccccttggtctctctgcctgtctgaattgctgctgaatatctacagctccttattcttttatcctctgcagccctatttcctgatattggtagaggcacagtccataatgagaaactctagaagggagtctattttgcccaacatctcacaacttaactagcagcagggtaaaaatgaagcctcatttcttggctattactttcttttctacaccagtcttcattcaaatatgataacagcttaatctgagataaaactgaaaggttccaaggaactgtatcatatcctatgaatctttttcttctttctctttcttgactggctacactgacctgcttaaaaataagtggccatggtctcttttgcattcaggtatacaacaaacaagctgatgagtatctgaaaatatatacatgtgtacatataggcttaaccacatagatattgataaacactgcttatgccacctgcattggtatttttcatgtagaaaaataaaatgtttttttctaggctcacattctacttgactgtggtgaagacaatgtctgtaaacccaagctggaagtttctgtagataggtaagttttgcttgaaataataatgtagtaagaaatttaaatggaagggcacatttttctattcaaaggactaacatattttaacgagaattagttatcctggagggtaatgcctgattttctataacactaaaactatcaatattgagcttctaaagaaaatatccactgtgttttcactagttgcctaggttgaaagagttattaccattcaactttgggtaatatcacaaaataatattgtatcattttaaagatacacttcatcataaacattctttgaactcaaggaatatccttaccattttgtaaggcatatgaattataaagaatattgtgagaattatgacacgtgattaatttagcttttagaaaaatattggggaattacaaagtacatgtaattcacttcagtaatagatatgaatgatagtgatatattagtggcatcaatgtttatttttattgagagaagcattcgatttgcacccagtgtgctattttctgttttctatcaagctgtgaagtagtcttaaaataccttgagacactgttgaacatgtcagtgctgtgtatttatctcttctttctttgaacagtcatactttccccatgtagtctttttttctcagtctggatttgtattgttaacttgtagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagtaagcaggctgcctctttaaaaattgaaatgcactcacggatcttattaacattaatgagctgttcccctatttagtgaagcacaagcttagctattctacctaaggctaaattgatagacaatggagtgcctatcttacataattccttttaagcctaatactttgcataatgcattgatatgacatttttagaattgcaagctaagtgcctggaaacaaggttagatagataaagtgtctaagcctgtccatcaaattatttgtcagaggctgtatggttatgtatggtagtcctctagggatctttcagaaacacttctgcatttccatgtggcaattgtacccaattctggctttttccttacctcctggtttgctcaactagatttatttgcttaggacaagaaactgaaatatccaactgcgtgatactttatttcctttcatatccatttttttttttttttttggtctatcaaaggccttagcaagactttcctgtgcatttaagacagaaaaccaaactcgccaggtggtatgtgaccttggaaacccaatgaaggctggaactcaagtaagacaatttaattaaacggatttttctccctggcaaatagaaaagcatattgttgtctgggctcatagtaatttttaaaaataaacacttcaaaacaatgtccttaaattggtttcgatataatagttaaatgattagcagagttttgcttagttttaactaagatacgaaaacaattggttgtgctcctacacggtttgcaatcagctgctctttatgcctccttcactttagtgaatggatgagaacgtggtttaaactaaggactgaaataataatttttgctattttacactgatgccttaatggatcctgaaaagctactctggcaactaccaagactgtcaatcctaggtgagctagattccatcacaggccccacacagaggatcaaagtgaaggtcagttaaatcaggctccccttcagatggtggagcagggtgcccaggagcttgaaaagaagcagccaatggcttgctttccgaatcctctaaaaagtaaacaaaatataccttgtagaatttctagtagcaaggacaaaatggcagcatatgctgtgtgactttttcaatagaatttatttaatgacttattgatactggtactttgaagatctgtggtaatacaggtctaaatattccatatttctttagtatgttttctattacaagtcattagtatttctagatgtatggtatcttagggatgagaacttgaacaaattaccctaagttcagtttttcacgtgtattcaatgttttattaacaatgagcatgccttttattttctcatattctcattctctctaactttctggttattatatagtttctgcttattacaagtagccagctccaggttttgtggagtgggaggcagaacccaggaagtactgtttttatatgtcatttgtgtgatccccaagaagccttcttttttgtacctggtggttcaattgttttatttaaaatctaccaattttctgcctgcaggaattaggatatttggtgttgggagtgttatgagaggtgtgtggagaaattctggttgtggccctactcatgccttctttagccatgttcccttactctagtaaaccatccatttcttctttcctggcctatgaacacagcacatactttggtggttagcttcgtgttatcaaattattgtacccagttgctagactttcactggatcaacaaacatttacttttgcactttttagaaagatggttagtattataaggaggtataattatgattaataattgttgttaaataggctctcttatggattggtccaggtatattaagtaaaataggtttgatagaaaataagatttagttatctttgttcagttttattgtaagctcagaaaaaccccattttagaacattattttttatttagacattggatttgaaattttgctaattagacattgactagcattactatcttttcctctctcctttagctcttagctggtcttcgtttcagtgtgcaccagcagtcagagatggatacttctgtgaaatttgacttacaaatccaaaggtatgaaaacaacttatattcacttataactatcaaataaatattatttgttgtaaatatactatgtaatatactttaaatataaagtagcagattaaattttattgcttgactatagcattttaaaatcaatatttacattataagaataattttattgtcagatttgagtttgtaaaacaaaatttaaaatccagaaagaaaatgttcatcttcttggaattaagtgttaatgaaaataactattttgaggtataagctttacacttgtttcgtttgttaatttttagtttcactgggtttgcctctgtatgttcttggttgttatgcataattcatttttaagtttttttttttctttttcagctcaaatctatttgacaaagtaagcccagttgtatctcacaaagttgatcttgctgttttagctgcagttgagataagagggtcagtatgaatacttagttgagtatctcattctcatgattgctttttaaaggtaactgtcaggccttagccttttctggacaatagaccctgcatgtttagtggtggttttactagggcattagcttctgtagaaataaaatcctaggtatgttccaaacccccaatactgggtgatcctcaaaaggaacaagacatggcaacaacatgcacaaaataattttgttgaacttttacacaaattgtcaattcacctgttacgtgtacatttcataagagcagtttttgtgcatgtgtgtgttcattagttttcttttaaagtattttttaaaattaaatctaattttatttatttgagtaatgaatatggggtacttttgaaaatgaactgactatatcattttgatattcatggtaggttttctttggtcattgtttagagtctcgagtcctgatcatatctttcttccgattccaaactgggagcacaaggagaaccctgagactgaagaagatgttgggccagttgttcagcacatctatgaggtttgcagttgttagattttactcaaacctcgtgagcaagccaacgaagagaggaacaactaagctactttaaaaaaaaaattctatgtaatttttatgtaaactctacattggttaagtatgtgtcagagatttctttgaatattttccctatacataaattcatttttatttgacaaatagacttgtttaaataaagcagtttatataatttgttgtttaaaataaattagttctacttgaataaagaaatgtcattggtactttctcatgggcattttgtagttctggctaaaaattgaaaatacctatggcaaataatcaaaactatttctataggaagaaattttctttgtcatccttcattaataacttttaaatattttgccttttgtttatacatacatacatatatatatatatatatatatatatatatatttttttttttttttttttttttttttgaggtgaagtcttgctctgtcgcccaggctggagtgcagtggcgcgatctcagctcactgcaaactccacctcccgggttcaagcgattctcctgcctcagcttgctgagtagctgggattacacgtgtgcaccaccatgcccggctaatttttgtatttttagtagggacagggtttcaccgacaggtttcaccacgttggccaggctggacatgaactcctgacctcaagagatccgcccgcctcggcctcccaaagtgctgggattacaggcatgagccactgtgcccaaccttgtttatatttttatcctgacacatattactctgtgttagagacaaatgttgagtttgatcatttttgcataaaaatggtcacattgtaattagaggttaactgtggaaattgctgttatttaaaacctattgctaacatgatttctaaagttgatgtaggggaaggattatggaacagatttttgcccaaggtgtagatacattttcttttttctccttagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaaggtaatatgcttaatagcagctcttcattacaatgatatttcattgccttctttctaaacctgtaaaagaaattcataaaataaaacaactattttaatataaaacccactctgcaaaaaatggtttagttcataagcagtacacttaggataagttcatttgtataatgggtaagaattgattctgtgatgtctagtgaaccacatcttcatagagtgcttactgagcctcatgagatgtgtccttcagtgactcagtttgaccttggctccatcacgttgttgtttcttcagggcataatatcacatcaagggtgttttgttgttaaaatttctacctttgggataagctataccattttactcatgattatcttgacttttggatatagtcatctccatcatagatttgcactagaaactattacacaatatgatctaaggaaaggtgaagaaacaaaataaaagatatacccatgattgacatcacaaatgtactgtggaatttcaggccatttctgtatgtttcatcagtttccactctagctaagcaagggctgaaaataatggttagggagagctaacttttttggtacatattaaagactctaatctttattttctgtccttactgctcactatatactgagtggtaaatattctgtcatactaaattttcattcactattttttaatcatatctaagagtttatatcaaaatgctgatgtaaaatgtttttcattatcatttaccaccattttattaatgtgattgcattagatctcatctttgcaaacaactgaaaagaatgacacggttgccgggcaaggtgagcgggaccatctcatcactaagcgggatcttgccctcagtgaaggagatattcacactttggtaagtgccatttcaaatatgtgcaccatagacatttaaaaatatgtgactatagaactgacgccaaagaacatttcaaaaataacaacagctgtgcttgaacaactacatttatttttataccatgcattcctctcactttcctttttcctagtcagattaatgccatattttcttcaaatgagctatttttgtagatggctaataaaactagtttatgtcccaactttgattctcctactctagttctttaactgtcctctttctgggcctcctcctaatctctgaggctttagtacgatactaaaaaatccagaaggtcccaacaaaaatacattggaataataattagcacttgattaacctttgttgagttagcctatataatggctataatgtttttaaaggcaattgtttttcttttttcttttaattaacaaatctccagatctctagtagagaacctggtatagtgttttttgtttgtttgtttgtttgttttttgacacagagcctcactttgtcacccaggctggagtgcaatgacacaaacacagctcactgaggccttgacctcccaggctcaagcaatcctcccctatcagtcccccaagtagctaggactataggcgctctcccccatgcccagctaagttttgtattttttgttgagatgaggtttcaccatgttgcccaggctggtctcaaattcctgagctcaagcgatctgcccacctcagcctcctaaagtgctgggatgacaggcatgaaccaccatgcccagcactgtttatgttcaatagtgatcactagttacttttacatcaccaaattctgtggttcttgttagtcctcaaccattcaattgcctagtggctttggttcacttaatcacttccttctgttgactctcatggctgtaaataccatgtggtgtagatgctttgatttatatttccagtctgatcttctgcattgaacttcagattccaatatccaactgcctactagaaactgcttttaaatatctaataggaatctcaaacaattctaaatatatacccttgggttttcccaagtctgctctttccataaagttcttagttgattttagtaaataccaacttcattctctaacacctggacctcatgcttgactcctctctttctctcaaatctcacgtcttgtatttcagcaaattgcatcagtattttctttcaaaatacctagaatctggccccttctcaccagtttcatcactaacacaacctaacccaggctcctttcccttctcgattggactattgccagacccctggttggcctctgtatttctgcctttctccccactatactttgtatgctatagaagccccagtgatccttttaaatataggtcaggttgtgtcactccagtgccttcccatctaactcaatgagaaagcaagaggctacaatgacctttaagcccaacatcaacaggcccttcctgcctctctgcttgcatctcctctccttactattctctttctcaaattttccaccttgctttcattgaacagatagccccaagcatgtttattcctccatgctttgaaaattgctcttccatctgcctggaattctttgtccagatatccttgtggcttattttcccatatccttctcatgtccttaaaagtaaaattatgtcagagatcttccctgaccaacccatgtgaaatagaaactgccttctacctcccaaccccacttttgatcttgcactttctgtcctccttcagaatctgttttctttaattgagacaaaacttacacaaaattaaccattttaatgattttaaagtgcataatttagtgttttttagtataattacaacattgaaccaccattaccactataattgtaaacatttttgtcaccccaaaaagaaatgctgtacccattaagcagtttatccattctcccctatcaccagcccctggtgaccactaatctgcattcctactgatttgcctattctggacatttcatacatatagtatcatacaacatatggccttttgtgtctagccttctttcatgtagcatgttttcaagatctatgttgtggtgtgccttagtactccttttttttttttttttctttttttgagacagagtctcgctctgtcacccaggctggagtccagtggcgaaatctcggatcactgcaagctccacctcccgggttcacgccattctcctgcctcagcctcccgagtagctgggactacaggcacccaccaccacacccggctaatttttttgtgtttttagtagagacggggtttcaccatgttagccaggatgcttgatctcctgacctcgtgatccgcccgcctcggcctcccaaagtgttgggattacaggcgtgaactaccatgcccagccagtacttcatttttatgcctgaataatactccattgtgtggacataccaccttttgtttatctatttatcagttgatcaacatttcgattatttctactttttgtctgttttgaatgtgttgctatgaacattgatgcataaatttccatgtaaacatgtttttcagttttattgagaataaacataagagtgcaattgctaggtcatgtggaaactctatgtttaacttttggaggaactgccaaactattttccaaagttgctgcagcattttgcaatcccaaccagcaatatatgagggtcctattttctccacatctttgtcaacacttattattttctgcttttgtttgttttaaaatttttataatcatcctggttggtgtgaagaagtaactcattgtggttttgatatgcatttccctgtagactgatgatattcagcatcttttcagttgtgtatcttttttagacaaatgtctattcaaattttttgcccatttttaaattgggttatttgccttttattgttgagttgcaaagagttatttatatattctggatactaccttcattagatatatgattgcacaggttttgtctcattctgtgtgaactgtctttttactttcttgatggtgtcctttaatgcacaaaaatttttaaatctgaagttcaatttatctatgtcttcttttgttgcttgtaattttgtcatcatatttttaaaaccattgcccaatacaaggtcatgaagattcatacctaggctttttggttttataagttttacacttacagctcttacatttacatccctgattcattttgggttaatttatgtgtatggtgtgaggtaggggtccagattgattcttttgtgtgtggctatccacctgtctgagcaacatttgttgaagaaattattctttccccttaaatggtcttggcagtcttgttggagatgaattgattataaatatatggatttatttctagacattcagttctattcagttgacctatatgtatatccttaatacaagtaacaaattgttttgattaccatagctctggagttcaggttttgaaatagggaaatatgaatacattttattccttttaagattattttggttagagtcccttgcgattccatgtggattttaggatcagcttgtccatttctgcagacaaggtagttggaattttggtagcaattttcttgagcaacctagggagtattgctatcttaacattacatagttcagttcatgaacatggtatgtctttctgtttatttattctaccattttttcaacaatattttgtcacttttagtgtacttgtcttgcacatccttgattacgtgatttctgtgtattcttttcaatgctttttattattattattattttattttatttctttttcagaaggagtttttgctcttgttgtccaggctggagtgcaatggtgtgatctcgactcattgcaacctccacctcccaggctcaagcaattcttctgccttggcctaccgagtagctgggattacaggtgcccacgaccaggactggctaattttttgtatttttttagtagagacaggtttcaccatgttggtcagtctggtctcgaactcctgacctcaggtgatccacccaccttggcctcccgaaagttctagaattacaaatgtgagccactgtgcctggtctatttttatttttattttgtagagacagggtcttattctctcatccatgctggaggacagtagcatagttatagcttactgcaacctcgaaatcctgggctcaagcaatcctcctgcctcagcctcctgagtagctaggattataggtgcacccaccacacctggctaatttttaaatttcattttgtagaaatagaatctcactacgttgcctaggctggtcttgaactactggcctcaagtgactttcccactttggtttcctaaagtgttgaagttacaggtgtgagccactgctcttgacctcagtgctgttttaaaggaagttgttttcttaatttcttttttggatttcttattgatagtatactgaaatatgactcatatttgcatattgatcttgtgtcctgtacctcttctgtacttgtttttttagcttaaatagttttaatttggattatttagtgttttctatatgtaagatcctgtcatctacaaagagatagctttactttatcatttctaatctggataccttttacttttttttttctttttgaagaaagagtctagctctgtcaccgaggctggagtgcagtgacatgatcttggcttactgcaacttctgccccccaggttcaagcgattctcctgcctcagcctcccaagtagctgggattacaggtgcccaccatcacgcctggctaatttttgtattttgagtagagatggcatttcaccatgttggccaggctggtctcgaactcctgacctcaagcgatacgcctgcctcagcctcccaaagtgctttgattacaggagtgagccactgcacctggccttaatttttcttacctaattgcactggctagaaccttccgtacaatattgagtagaaatggcttgattgctattgtcttatttctgacattagggagaaagaaggatgaagtatgatattagctgtgggctttttatcaatgccctttctcaggtcaaggaaactcttttctactcctaatcgtcaacaaatggtaccactactggataacattgtcatgaggtgtatatatgtgatatgtctaatacagtgtgatcagcatatagaaggtggtgaatatttatttcttttggctgccaacctcgaagttactgattaaaacattaaatgtgtcagaggccatcagcatgcgatttgatttctgtaggccctccatggaaaaaccattaaaaattctgttttcttttccatggggatgttgagatctggttattatatcttacaaatatcaccatgttatgggtttgcctaaagaatattgagttctagtcatagagtgaatcttttaatattatggatcttatctttctataacaaatcacgataaaaccaaccctttcatttacaaggaactacatgtgtggcaaaagaagaaaaagaaaagaaacataccaaccccttcacaataaaaagcattcatagactcaactattagcctgtttattttcaagacagaagaatctggataatctctttggccatcacacaaaaagaaaaaaaatggcaaattttcaaatgttgaagagatgatagaatgaccttttcttataagtaaaggatttgttttggcagggttgtggagttgctcagtgcttgaagattgtctgccaagttgggagattagacagaggaaagagtgcaatcttgtacgtaaagtcattactgtggactgagacttttatgaatgtaagtagacaggtgcagcatttagcaaacatacccagtgttttcaaataaatataaaaggcctgatatctgggaaatcatctaattgttatttccaaacagaaagaaaatcagaatcattcctattctctgaagtcgtctgcttcatttaatgtcatagagtttccttataagaatcttccaattgaggatatcaccaactccacattggtaagtcattggtttaggcaaatagaataaatttactcaattcaaatgctgtacatgtttttattttgttttttaaagaacgacagcttaacttttttgataatttaaactaatgaagttatatgatagcattataacctagtttaatattatcattttactccttaccccgaagtgattaaagctagaccttttagtttagcatcttgtccagtgtaagagatttcttagtatatactaaattatattggagaaattttaggaattttcgtttacaaagttagaaagttggaaattaactgcaacaagtgaggcattttgaagatatttaaggagtaaaaatgggatcagcacatagtaaactggattggattatttaaaaatcatttcaagctgggtgtggttgcctcacacctgtaatcccagcattttgggaggctgagacaggtggatcatttgaggccaggatttcaagaccagcctggccaacatggtgaaaccccttctctacgaaaaatacagaaaaattagctgggtatagtggcgcaggcctgtaattccaactactggggaggctgaagcatggaggttgcagtgagccgagttcatgcccctgcattccagcttggcctacatactgggcgagactctgtcaaaaaaaaggaaaacaaatcatgtcagatgcaatcagaagtcagcctatcattgggagtttcatgtgtgtatgtgcatgctcttgatatcaaatgtgaaaccactaaattatcatatgcaggaaaagaatatactgtgaattccattaaaataaaatataatatttactcagatatttgttgattaagtcaatggactgtttttaaaactaaaagcttttttcctcgataggttaccactaatgtcacctggggcattcagccagcgcccatgcctgtgcctgtgtgggtgatcattttagcagttctagcaggattgttgctactggctgttttggtatttgtaatgtacagggtaagtaacggacttagaaagaaggagagagggaaagcagaagaaaagggaaagggaagaaggaaaagaagaatgaaaagtaagggaaggaagaaagggactgtaatgatgatacttgatgagcattacttattatatgagggaagataaattttatgaaatacaatttaaatgttcttagtggtaatatagtcacccaaaaaatacttttcgtattctacactgatgtgacagtaataatggtttttcttcaactgacagatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggtaccacttttgtgtatggggtttatcctttctgtgatgtgtttttgttttttgattacatgagctagcaataatgcactaaaaggatgacctcagaggtaactttctgtaaaacttcaaatcttgaatgtcagttatttgatgaaaagaaacacaaaaagagcaaaatgtaccacattaaaattcatccttagaaaggcaaatatgtatttgcctgaaatataagaattattttatttctaaacaaacatttctaaattcattatgctaacctttattatttttacattatcagattccttttaaaatgcacatttacatcttttataatttttaattatagtgtatatatgtcattgcatatatgcagttgcaatatacatatgcaattctagtataaaaatacctatttttataaatgaaaagtaccaagaagaaaattaagtgttgagatgcttgggaaattatactgaagtagcataatacaccaccgtaaattcctatggaaataagatagagtattgccagcatccacaagcccccttctgtctctttctaatcatatctcaccctgccctgcaaaagtaaccactgtccttacttctaacactatatgcttagttagatgtgatatttcccctggaccagcaagtcataactacccctatcctgaccaccatacttgatattttggctccaattaagatgtaaaatgtacagcacctacacatggaagtattttgagtgtgagaattagaaaatgggcagagcctttctgtcctgcctgacttactagttgctctttaggatcaaataagataacacatatgaaaggattttatttttttgagatggggtcttgccatgttgcccaagctggtctcaaactcctgagctcaagtgatcgcctgccttgtccccccaga

SEQ ID NO: 12064 - DNA, 61735 bp, Human
cttatcaggatttcctgtttagcacgtatgctgaccaacctttgcttagagtattcataaatttcatagctcactgtccacccattatttgtatgaaatcacaagtagactcgtattcttgaccaatgactgcagtttttagagaacatgtttctttaatttctttttcctcaaaactcatgacttctgtacacaaattgctacctcacacatcagtttagtcaagtgctctagcccagtcccgggagagcaaaaggacccatttattcatttatcagatattatctgagcccctattatctgtccttgcaacagtgcttgacggtggtgttaaaaagctcagtaaattgtcctggaggaactaatttagtttagagttgtgcatatgtaaatctcataatgttcttgtagcaaagactagctagtgcctccaccagtcacgtacagggaaaaaaattctggaaattgtagtgcaaatcaggcacggaccaattatgcttttgaactatacagttttctgtgctgagactgggccaattctgatgaattctgaacaatggtaaaaccgatacctttaaaattcaagaatgttgagttctaatggcagtttgaccattgagatattaatataggaacatcatttagcctcttaagcttgaacatccattaagtgggaaaaatagtgctcatttcctagaggtcttcagattggctaatcaagttttgattttgctggtaagtaatgagcaaattttcttagatgtgatcgcttcattttctcttatattgattggcagcagccaaatgggcattccagtccctaatctcctgcaagagaaacacttctatttcataaatctggtaatttttgagctcttttcccaacagggtgctgcagctcaccaagcggaacccacagcattttctgctaccaggatagcagcttgccagtagcatatactaaattactgggtttcagtatgattttggctggtacagacttcaatcatcgaatcgacatgcgttcagccattctcataatgaatgtttccttctctttcaaacgttgtttccagccccaatctccaaattttttttttttaagaggtgaaacagaaactgtactccttaggaagaaacttttccttctcatccctgttccccataaaggtacctccagataaatctatcaaaagcaggacgcaactcaccaggttttctaaaacgttccccagtctcaccacccttcgtgacacccatgggtttcccaattcttcacctttctcttagacacaggcaagcacattatcactccagaaaagcagtcctggcttagccagttcccttccagaaggaccacgtggtttttggccccatggagccctgcagggtaggggggctcacggtcccgatttgcctcgggactcagggggcttccgagatgcaggatctcccgggctcgaaacgggacatcagtggacaaacgggagcgagggtcgaacgcgcggctccgaggaagaggaacttaaagaacacgggcccagcaggctacaccaggaacgcgcggggctctagggcgcgtccgactcctcccgcccttcgcagaggaggaaactgaggcacggcgactgtctcaacgcagtcccggccctgccccccgcggcctccctcaggcgcgctcccgcgcagccggttcctttgtcccggtcgcacttcctgccccatcctccgcctcctcctagccccgggccgggctgacgcggcgggagaggaatgcgtttccggagggagagggcggcggcggcctcgggagcgggatcagacgcgcagaggaggcggggccgcggctggtttcctgccggggggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaaggtaggggccggcgggcctcgggtgtgggagcgcgggccgcggcctccggtctcctgtgcgcggcagcacttaaagccgccggccgggccgcgccgggacctttgtgccgggcgtgggggtgggggcgggggcgggggcgggggcggccgccagcggttgggggctggggcaggattccaggctagtccaggaggaagtccgcacgccgccacccgcctcgggtccccggcgctggcagcccccgggcgcagagccagcccagccgcgttccgaacgtgagggtcgccggcctgggcgctgtcacgtcggggctgccggagctgcgggggaccgggcccgaacggcccctgacacctgcggtctcccgccgggctgggcaagcgcaggtgggagccagcgaggccacccggggctcggcgtttgggactcggcgctcccctggacgggtccggtgcctttgtctctcgctccctcgcgagctgctgtccttggagcagcgtcgagccagccgtcggcgcccgcgacggggactggtctcctccggctgccaggaggcggccctggggccagcgccgcgggcgggggcggcgggagccgggtagaagttggcttagtggagccgctggggaccgggggtgcggtggcggcagtgcagtccacttccccgtgtttataaacgtcaagagtcgccggtccctgccgggcaccccgggaccaggacgcatggccatggccagcttgtgctcagacccggtccgcgagcctgagagcccggcctgtgtctagtatcattttaccgcgtgtcatttcttaggcttcataaattggatttatgagactcctactctctaagtaacttttatttaatcaaattcgtgcttttgagtccaaaactttgcactcattggtatgatcattagtaagttgcattctctaagcttccgtttcctcatctgtgaaataggaacagtaatatctacattaataattcatttttataataatgacagtgagggccaagtttagctctaggcattttacatgtattatttaattctggaaccgctctaatgagattggtactgtttcgattcccattttccgagtgaagaaactgaggcacagggagcaaaagtaagttgcctgtggtcatcaggagctcctggagaaggcatggggtctagttccagagtccgcgtttaaaccacaagtaaccttcctaactatagttctgaaaatcaaatgcaaaatgtaaaaaacttagcttgagagtagatgctcaatgagtattgactccttttcagcccttcttttatagtaaaaagatgttaaaaatatctcggaagataattggtaacatcattggtaaggtttctttgggccaacatgccacatggttaacttaggtgggtagaattactaggttatttcgttttgttttgagacagggtctctgttgcccaggctggagtgcagaagagccatcacagctcactgcagcctcaacctccgaggcttaagttacttttccacctcagcctcttgagtagctgggactacaggcgcctgccaccgtgcccggctaatttttttattttttgtagagacaggatttcactatgctgcccaggctggcctcaaactcctgggctcaagctgtcctctctcaccgagctcccaaagtgctgggattacaggcgtgagcccctgaacctggcccttaggttttttgttttttttttttttaattgtagttttaatgctacaaaaataacatgctagaggaatttagattagacatctttcttaaaccacatacgtcctttacgataggttatacagtagaccaattttagaaatgattaaggaacttcagttggcagttacctgttcatttgtggacatcaaggcccagaggggttaggacttagagtctcactataattctcatatttttaaataatgttgactcattgatcaatattatataagtgactgaagatggtgaagtgttaaataaaaaacattggtattttcattacaggcatttggggagaaagtcattttacttatcccaaaattgagtatgaaggtggaagatgttattagaatgctagttaaaaggacaaagaatgtggttaatactttaattctgtaaacaggaagcaaatagattgtttaactcgtctgtgttgacttcagacctaaacctacaattttaagtgtttgtgattttcttaatgtaaagttctatattaaagttattttttaataccctcaacattctgcacatgagaagcatggaatcagcaattctgaaagtcactggatttagtaattttaacaattaggcagctttctggtcagtataatttaatttaaatcagccccgaattaccatcacgaatgaaaatgtagctctacattggtgttcttcctaactctgggagtgacactggggacatctggtcatattataataatgaaaagtggtcaaacaacttaacatggtgccagttttcctaagcgtgcttgccactgattgtaatgcttttattgtttggcttcttgataagtaagttatggcttacagcggtgagtagtatagtgttctgtctgaaaacatattcattaatattctgtagctgctctggtttgcccttaactatgctgctagtgtgataagctgaaacatcttgtaactggtaaaagtttcagagaacttaactttctgaatatgtaacaagctgcatgtatctgaaagggttcatttagacttctgttagatattagcagattttctcactctgccagagagttaggatctgttaggttgtgggtggaatcctggagattatgccgggtaaatatgtaagtacctgtattgtattagcagtgtttactctgacttggttttaggttctgagagtttggctggttattttttcagaggtgggaggtatggagtagagacgttaagatacagaaaggtacattcgtcttctgaatcctgaagtgttatgctagaggtatctatagctgtggaaaactgaaaagatattatggtatgtacccagcttaaagggggtacagtccgtaaaagtcagaatattagcagccttccaatatgtctgtcggtaggtgaaaaaaaaagtttctctctttcaggagctgtgtacaaaaggatccaaactatactttgtacatttgttattgttttaaaagtggctgtgagtttttagaggtcagctaactttaaacttgccgtttggtttgtgactttagaaggtagagttaactatatttagcaatatgcttaagcgtgtgcatatcacctcatgaaacgtgtgtgtgcatgagaaaagctgcctccagtacacatacatatgtatatacacacatacacacaagcacatatatgtatgtatttcttataggaccaatctcattgtacataatttcaaagcacaggttcctatctccagggatgcataaaaagactcactgaagtatagggagaaaattttaggtctactattatgtttgttgatctcatcactttaaaatttaaaattttgattatgattgataatcttactatattgctgtagaagtacatgtatctgaatttataaattgcatttattttgggtacaggtatgcctagaatttttttgctgataaaggtgagtggtcagaaagctttgcagatccctatatggaggatgatttgagtggggttcaagaactactgtatttgggagggagaactgataagacttgataagagaaataaaagaaacccagtgtgacactggtttctggctaggaggtgctgttcactgaggtgagagggtgaccacaagctgggggtgctggttggctggagcagaggggaaatgatgaccttatgaggccaagtttttttttttaaggtgaccatgggacataggtggagatgtctaaattgcagttgaatacacagattgagagcttaaaaaaagaaaaaactctgagagatttcaatttgacaattcttagtctattgctggttgaagctataggctgtgcatgcaaacaccaaaggagggtgtggagtgaaaaacgggctgaaggaggacctgggaacacttttaatagtcaagggggggtggaggaagaggaatctagaaaagcatttaccttccccagtttcttctctgaacttctaattcctttgagtggcatttttgtgagtgacataggtatttctgggtttttccagtgattggcatgtttgagttaaagacagaaagacttcattggtcacatttctttgtggtaatttattttcagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatgtaagtagagtgcagttctctctccatgagcaactttttttttttttgtatcaccagagagtgtaggcactgtgccacttactctgttaaggatacctgccagcgctgaccagcaacatctgtccctgtcagctctgcatcaggatgtagcttggctgtacattacattttattctatcagtacattgagtaccagttacctgaaaaatgctttactcagtggacatgaatcaagaagttggcatgctctttgatgttgagtctgttgtctaattggaacaagttgtgttcagttcaggaaaacataaataccaaagagtgttttatacaatgtactgtaccataaaatactgtaccatgtaatattccctaacaatgttagaaaaatctcagcattggcttgtgtggttttggaacacgttgtgtaggagatgaggcctgagcttggaatggtatgagcgaaggttggatgacagatggttgtcacattcaaggacagcatgggaagaatccaatctaatttcacagatagtacctggccactttgttacctattaggagttatgtataatatcatatatatcagaaggatatgtgaaggctatataaaatgaaggcctgggttcttgccctccaatactagcctgatgagagacacagacatgaatacaattagttacaatagaagtttgaatagaaataacactatattattaagcatcactgaagatttgtcattcactctgctgggcactatcaaagctgttttggaaccacagagaaggagtagttaattaagttgattgtggttggtgaggagatgaagaggcaataaagacagaaaggaagaagaaaaatcagcattctattttgtgtagggagtatagtttcagtggagtgatgaggaaaatatttacatacgaaattaggtatgtaccatttgaagtatggaagtcacatttttctgtataaatgtttattgaatgaatatgtaaataacttaagctttcgtaatctatgaaattagcaatagattattcttctccatgtacaatattttatggtttatgtatgattttcttcatattatgatttcagtgcttcttttaaaggggtggtacagggtcatgtttgattattggaggaggaaattggagtttgaaaaagcacatttggtagtataatgttatgttagaaaaatgttacaaaaaagtacaatagggagtaagatttatgcttattaaagaagcatggattaaaaagattgagaaacatttattaaagagtcactgaggttcttgttttagaaggccatgattaatgagttggagaacaagaagcaaatttggtaatcatgtaaattatgagctgctgaccacctagaaagatatttgctgataagagctttcatataatgatcatattttatctttccaacaattagatactgtttacagcttactgatgtgtaaaatgagaaactttttttcctatgtttatcatggttttaaaacatttatcatgtatttaaaatactgtatgcactccaccacagacaggatggagaggaagatgtgacaaaagatgtggtcaaaattagttttaatcaaggaagcattttggaatgatctgcttaaaaagtggatataattacgcagtttgagaagataattctccttaattgaaattacggggaataagtcttgctctcaggtgcttattgataccgttgatcatgctggttcttttgctggctccactcacaattatctttgacaacttgccccaaagtaaactttctcaaccaaaaccgttcccaacttctttcctcctcacagggaaaggcaaaaaagtccgcaggcatagagagtggaaagaaggaacagcatactaggctggtttgaaaaacaatcaattgctaggtaataatgtcttaccttttgagtggaaggaggagctgggaagaattaagttcgggcaggttttttgctcattttggatcagcccttcatattatggcttaatagctttgtttatagtgtatttttctgcttttacgttcatcctctgaagtcttgagttaattttgtgcccctttacccccatttgaattaaatgcttcatttttttcccgtttctcacataaagctatttttttttcaggacagggaggggctggtggtggtggtggtgctgtaccagttgtctgtttatgagatcaccattagacaacgtttctcattggcttgaattatttgaattttgtgtgattttcctgttatgttgattctgttcttggtgtctatgagttctgtagaggattccagcctaaattttcttccttagttctgtttacttttcctcgacttttgtggttttgctctttgatcactgtcaagatctatttgagattttctgactttcttgaagagcagaatgagatctagattttctcttatttttaaagaagattcttcactgacttcctttcactttttgttctgtggaagtctttcctaggtgttaagtttccaggctttacctccccctacccccaacgtattatctttaggcattttgtttgccaatgcgtactatatccattatttatctttcccttgcacttgtagattgggtggtgataaaaatcttccatatttcattttcctggagaaggcgggtagagtcactagtgatgaattttatcttcaatctgttgtataattttcttaaagtatctcgccgtgttgtgagctgttctcagatttcaaattgttttgtgaacctatagctttggagcagccaaacctttgttgttagagcttcttagcccaggctatcattatcattgtgtgagaaggggttagtgctctttaaaaagccatttttcttctgggtgggagtggtgaattttagatggttttctaattcagactacttttctgtttgtcaaggagaggagaagaggacttcaaatgtggtgttacatctttgggatcccttagcctcttctctttcatgtctccttttttttcttctctattctttctgcgaagttttgttaatcattaatgctagcttattaatatttgggccataaacacctctgtagtgaccaacacacctcttcctgccagatggaaggaaaaaaagtgttgagttttaattgttcttcctgtaaggggaaaggttccctttccatgggaggaactcatctccacatgtcaccctctcagatggtacagaattcagaaagatttctcagtttcttccattcatgtttttctcgtttttattactctctatgtgggataagtgggaggaacctcatgtctttcaatttggctctgtgttcttcttctggaatatattgatttttaaatactaaaatctgttattggcctatttcttccccttttaaaagcagatacagaaaataatgatggtagaacagacttgggatgaatccaagtttattataatttttaggagacatttatgatatacctctataggtatcagaatcttttctactattaaggtgaaaagatttgagattttgtgaaatcttttgtgtattctttttatttgagttggcttttaggtggcttatttttcaactctgaaatgaacataacatgttacatatgttacatatgttacaatttttttctaaagtgtagttgtttaatttctacaaagatagtccatataaagtttctaaagattgtaaatttaaaaggaaatgccaaatgaattatttgtaaaattgtttaaaaaaattaataaataatgagtgtgtatttaaaagtttgaacatgatataaaaccatacttttatggataaagattagtttacagtgaagattaaaacaattatgcactatttttgacagtggaaacaattgcacatatttgggttaaccactaaaatgagattatttgtgggtggtgtttaagattgtttattgttcagggaatgaattatgaccccttagataaaatttcatatggtaaaaaatgaccttaaggtgaaatgcttttataggaacaagacacaaaacctttgtctgtacttatgaaatatggcaattaaaataacttttcttggcctctattaagttcaaatgcccaagaaataaactcatagaacattataagccctttccatttctgtgccctgagtcagttctaacactagaaggatgttctttgttttaaaatagtgattaagtaggctttgaaaaaattacagtttaatgaagtcaggtcatagcttctggatacagatggtcaggtttcaattccacctgtgcaacttttgattccaccattgcaagttgtttagtctctctggttttgtttcctcatctgtaaaacaaagacactattattcttcacctcattgagttacctggaggagatagatgctattattttatcattattattatcatatccatttgaaggtgctgaaataaaattctaattttttaaagttctaaatgaaataactttttgttacaaattactttaaatcatcaaaacttagtgtattatactcttcttcttgcctgtgcctagtctggccctctcaattgagaagtcagtctttttttttttttcagtaatccacagtgagcagcagtccctgaacgaaatcatattgctagttgggtttgattaataaaacacagaattggtattctagtcctttcaggggggtttgcttccttgtgatgtaagaaccttgtcttagtctttgtgctgctataacagaatgccacagactgggtaatttatgtcagggttctgggggctgggaagtccattatcaaggggttggcatctaatgtctttctgttgcatcatcccatggtagaaggtggaagggcaagagagtgagagaagagaaggaggccaaactccgtcttttatctggaacccattctccactcctgtggtaatagcattaatccattcatgtgggcagagccctcatgaccttatcacctcttaaaagtcccacctctcatcactgttgctttggggattaagtttccaacacgtgaaccttggggacacgttcaaagcatagcaaacctcaaagcttcctccttatttctgtttgtattaggtatgttattccctcccctcaatctttttttaagggtttctgtgatatcagtgttcagagcatttgtattttgtctactatgtttttatgatattagtgttcagagcatttgtattttgtctaacatttactaccttaaatattttgtcagtataaaatatttaaggttttgctgcttttattactttatgaacacatttgtcaggaatctgattgttagaaagcacattaaatagaattctacttggatgtggaatctataaagagtataataaggttttgatattgaggatgtcagtgtatgaacagctataacaatccacattaatctattttctgtagttgtgttacttctaactttcagactttatcctttctttcatatcttgtgtcttccctaaagtggatccagtcagttttctggttataattacaattgaaaaaaaaaaaaaattcaaccatagttacttctttattcaattacgttgttattgagcgcttcctgtaacatttggtaatgatcataacaagtaacacccaggtacttacaattggccagacattgttttaaatgttttatgtgtatcaacttatttaaacttcacaaaacccctacaaggtaaatactgctgtccccattttaaagatgaggaaactgagacagattaatttgccagtgtaactctgcactacacaatgttgtacaacggtagatgccacaaatatctgctgtcatgaagctcagtgttttattttttgatacctcagagtatctccagttgtttttatcgttagtttcttcatttattcaatataaagacattgcgctagatacagaaaacatggagaaacttctagaagatgacaatttataaggcaagtcaaccatgtacatcattagtagatgtataagagctacatatgccccaaacaggaaaccttttaaatgaagattattatatatgttttaacatactgtgtgtatgtacgtacacacacacacacacacacacacacacacacacacacacacggctatatgtgaatcacctggctttagtctttctttcctccccagttcttgccatgattcgagggcttcaagagttcatgcagatgatacttctcacaccttggtctggcagttttctttctttctttttttttttatttaatgaaatttcagtttattcagataaagactaatgtatgcctcataacctagtgataatctataagtttgggagttcacaacatttttacaaagcacataatattaacattcaagtgaggcattatagaaagttttataaagaatgaagtaggccaggtatggtgcctcatgactgtaatcccaccactttgggaggcagaggtgggtggattgctggaggtcaggagtttgagaccagcctggccaacatagcaaaaccctgtctctactaaaatacaaaaattagccagccgtggtggcacatgcctgtaatcccagctactcagaggctgaggcaggagaattgcttgaacccaggaggcggaggttgcagtgagccaagatcatgccactgcactccagcctgggtgatcaagtgaaactgtctaaaaaaaaaaaaagaagtctttactataattcttttaaaaaaccttggttcatcttgaaagactgatgaatttttgaaatacctgcagaaaaggaaaataatcccccccccccccccagaaatacatacaaaccacttattggcacttgtgttttaagtacctggagaaaaacaggacagatttttaaaggcaattaataacagcttatacaaggccttgtttcatttgctttagcaccaagtaaagtaagagtaaatatgctgtggaagatggtcaggtttttcctccttctctcatatgccccacttctcctaccaggtcacagtacatcagcagccatccttgttgccccactgaggaatcactttagattccagtatttaaatggctgctcagatgaaaccagtagaattctttccccttaagataaggtggcagtgaatgctagcaggtatcaatttctttgatcaggaacaaagaactccttcagaaaactcacttttttggtctttgttaacctatcctgtgaattctttttattggcacaccttgtttacgaatcatgattgattgctatttatgccaagggaacattccgcaggcatgcctgatctatttactaatgacaaagtatgcttactttacataattccataggttttctcttttatttttgggaggaggggtataataacttgttatttatcagggcagatcatatatttggatcaaaaagagaaactggcaagtagatcctaaaacacatttcttaacccgagtaacatctgaaaacatagatttcaattatattttgttgaaaattcattcaactttggtgcttatccaagaacttataatgtcaatttctgacaaaaattataaccctcaatacatatgtattttcaaaagaagagtcatcttaaagtaatatttttctgtatgttaattgatacatttttatagcaaattgaaaattctgagtaaattgaaagtatgtttaacaacaaaataaatacagcatatatggttagcttatatatttattagtgtaaaggcagcagtgaatttgtatcttacaacaaatctgtgaatccagttgcttttttttctggaattttatgtagtatcaccatgctccacaatgctagaaatgtggcattaatctgcaaaaatttctgatgagatactttccccaaatgacatgtaactttttaaaacttttccaaaaaatatggacattttatcaatcacttaatcttttttttttgagacagagtctcggtctgtcgcccaggctggagtgcagtggcgtgatctcagctcactgcaagctccacctcccaggttcacgccattctcctgcctcagcctcccgagtagctgggactacaggcgcctgccaccacgcccggctaatttttttgtgtttttagtagagacggggtttcaccatgttagccaggatggtctcgatctcctgacctcgtgatgcaccatctcggcctcccaaagtgctgggattacaggcatgagccactgcacccagcctatcaaccacttaatgaacaaaaagttagattactaccaattgttcatttaattttgctctaacgtgttttaaaagttaagacatctctgatggttttgcaggtgactggataaaacacactagatgatttcaaaagattaatcttagtatctgactcgtttggcacatcctcagtatccagaataaaatcagtagaaataaaagtaatataactttcaaagaattcatacatgctggaggtcttaggaaaagcagtttttaaattcaaggaataggaggtttgctcatcttactagttacacacatttctcctcatggagtaatggcagctttctggcttctttgtggaactttagtttgtagaaaagcttggtaatattccaggactggctttgtttgggcttcataagcctttagtcttttgataaccgtctctggtttatcatcctcatgctgaatgagaggatccccagtcagatcatcagtgcccacagttttgggagggttgaattcaatgttgtagactcagccactggcaggatgaatctagcgagcagtaaggcattgtttaatgacctcaaagggcacattcgggctaatcactttgtctgtctaagaagcttagtctagggcttctgcctgtggaagtgtccatggaaaaccacccaacagctagctatactaagtgagatttttcagctcatatagggccagctgagtcatgacatcatctcggatgagtttcctttggtcaatgaaagcgttagctaacacattaatttctgtgccccacagcatgttgatcctggagcaggtctccgctagagaggtgcttcacagtgtttggtgacgcgcgacaactagtgctgttgcctagcccagggcccccatgatcacggctgctgccgcgtagacgcccctttacagaccaaggcccacgccgcacccgaacaagggctttggcccagcctgtgaacttaccttctctgccgcccaggcccagccagctggcagcgctgctagtgggcggggactgtggctcccaggccttccctgaactctggtctagcagttttcttgtctctcaactttagtggccattggtcactgtactggaaacctcgtgtgtctttctcacatcctcttggcctctgattccagctggtgctgctgggaacagtcggtggctcactcctggctgactgcatgctgcctcaggtgcctctcttttgctttttcccctgcggctcctctaaccaactttcttgtctgttccctcttgtctgtcgctgggcacgtgcactgtagttcttagaagtgttagtggagttaatgccctttgaggcgactttttacctatgcaactggagttgatccatttccccgttgactttcactggacagactttctacgtacttctcaaaagttttccacaagatcaagcccccaggtactcagtatggtaaagatagtatctttgtattggctttttctctttttcttggttcactgtcttcaaagtgtctctctcttttcctggggtcaccttccaataaactgcctgcacaccagttctgttcccaggctctgctttggacagaaccctagctaaaacaatgacctggtactgtatttttaatacaggccttttcccccaagactgcctgtctctgaaattgtaaattcttaactgtcgtaggttccagctcttttcacttccttgtttccgtggtcccctctcctctcacctccctgttgtgatgtctggtcttttgactttttcctcttgttaactttttggtagcactgcaccttctttgccccccacccccacctttcctcttgcacctgccctgcacaccagggaatagatttagtgattccaaattggagtctgagggaccatgggaggtattctcagagatttgggcatttctacaaaatttaaaaaaaaatcatgctttcatgttaataataaacatttagtttatctggttgaccatcttataacccagtaatataacttcagaatctatgtttgtacttggaagttaattttggtttcataatgtttaagagctatgagcatgagacattttatatctatctataagttggcttatatacttaaagtaattgaaaatttaagttgtcacttggatgtctatagtaacacttttctgtttagagaagttctgcacattaagtaattctgagacattcttctgagtaatgtcagagaaaaatgtcatacaattcaatatggttcagtgaaaatatttttaattttttaactttttgaggcagggtctcactccattgcccagcctggaatgcagtggtgtgatcatagcttactgcagcttccaactcctggactcatggccccttcccctggcccccacttccaccaagttttgctatgttgcccaggctaatttattttcttgtagagccaggatctctaggtgggcatgatggctcatacctgtagtcccagttacttgggaggctgagatgggaggattgcctgagcccaggaggttgaggctgcagtgagatgtgatcacaccactgcattccagcctaggcgacagagcaagaccctgtctccccaaaaaaaaaaaaaaaagagagagagagagacagggtcgaggctagtcttgaactctttgcctcaggcagtcctcttacctcagcccctcaaagtgctaagattgcaggcatgagcctaacagcaaagagttttgagcatggactttgtgccaagtatttctaggtgcaatagctataaataagatacacccaggccctattttcttggagcctagaatccatcagggaagacatgttaacaaatagttagaagtgaaatgagtgttacaaatatgcctgtataaattagggtgtccaatacctggtgggctctcaccattgcaggctctcactgtaatcccattgcatcttcctaattttctgcaacccctaagccgtacctcttttcctaggagttcttcctatttcagaaaaaaacagtcatgcatgaatgaactctctttgctttctcacctcctgctctgccttagaagaaaggcaccatgtctctgtttagggtgatccacccccttgggctgcacatgccatccctctttgctccaaggaggcctggcttcatcactttccttttctcttttcctgtgtcttcacctcttcaagtttgcccccagttctcctttcttcctaagtattcttttcatcccaatcacatccattttcataagttcggttagcacctagattatgacaactctcatgtctgtgtctctaactcttgacttatctcctgagatccatactcatgtcctagcttcccaataggcatcttccctagattttgcaataaaacaaacctcattttttcccctaaccccattctccctcgtacatcttctttattttaaagtgatgattattctaaattcctttctttctcccatccttccttctccaagtaagcagcagatccctcatagctaccttctaatcattgtttgttcgtcttcttgtttgttgctgttatctgaatttagacatttgtcacctctcacttgaacctttgcagtaaattctgtatttgtcttccagctcctgtcttgccccctgtccttttctccactgagtttctgccatgtatatgtagaggtattactagcctgcccaaattttttcagttcccttcctatttatagaatggaatccaaactcttttagcatggatggtatttggctctctgtaacgtagctcttcctgcttgcttggtcttcgttcctgttatttccaactcataatttaagtctcagaaatacttcaagattccttttggcctttctgatattttaagattttaagataatataacttatacttacaatagaaaattataaggataaaataatcactcattccaccaacaagatatagttacaaaaacatacatttttctagtctttttttctataaagagagaaaaagtgagacagttccaattttgggttgcagggagctgcccaaatgcatatgcttagaaataagattaggaaggagttattataattcgcctcgggacttcatggctttgtatatgcaggccttttgcttggaatatcttctctccacttttctccacacccatctcctatgtgccttcaggtctaactgaaacactgccatgtgcctgatgcctctgaacttgtccaggcagatttcagtgtcctcagtgcactgtgtccttgtttattactgaaaccatcatatcataataatttgtatttttgtccttgaactgaaagttccctgaagcagtgacccttgtatttcctgatatggctcaaaacctgacagagttgtctgaagaggaacctccagaaaggcagggggaaaccagtagagttcaagggagtagagtgtgttaaagaatggtgaatagtcttacatgttgctttgtgtaaattctttggtagtaaaccgatgtacttcttcaagtgcatattgtagtgagtcaaaaaatttgtgaatgaatgagtgatgaacgaatgaatgcagagagtaaggtaaggcctagaaagggttcttttgcaagagtaatttcacatatatggttgggcatggacatcagttacacagttatgtgccacataatgacttttcggtcagtgatggaccacatacacgacagtggtcccataagattataacggagctgaaaaacacctgttgcctagtaatgtagtgtcatagtgcaacacattactcacatgtttgtggtgatgctggtgtaaacaaatcgaccatgctgccagtcttataaacgcatagcatctaaattacagtgcataatacttgataataaacaactatgttactgctttatatatttactgcactatattgttaatttttttttttttttttgagatggagtctagctctgtcgccaggctggagtgcagtggcgcaattttggcgcactgtaacctccatctcctgggttcaagtgattctcctgcctcagcctccagagtagctgggactacagatgcgcaccaccacgccaagctaatttttgtatttttttgtagagacggggtttcaccatgttggccaggatggtctccattacttgaccttgtgatctgcccatcttggcctcccaaagcgctgggattacaggcgtgagccaccgcccccagcctgttgttatttgagagagtatctctccttacagaaaaagtaaaacagcctcaggcaggtccaggtccttcaggaagtggtcccgaagaaggagatcttttaggagatgacagctccatgtgtcattggagacaggatatgcaggcgcaagacagtgacattgatgatcctgacccagggcagctgtgcaggctttaggctaatgtagtgtgtatttgtgtccacagtactgtgtatagtaatgtcagtaatgtcctgttcagtgtgtgttctgtgcagtgtactcacttgcccctctcactcactcactcactcactcactcactcactcactcacttacccacccagccatccagagcagcttccagtcctgcaagctatattcatggtaatagaggtgcatcaattttaaaatcttttgtaccatacttttactgtgtagtttttctgtgtctaactgtgcgtagatacacacatgcttactgcagcattccagttgcctgcagtattcaggacagtcttgtgctggacaggtgtgtagcctaggggcaataggctgtaccgtagagcctggatgtgtaggaggccacaccatctcggtttgtgtaagtgcactgtgatggttgcacaaagatgagattgccttcgcatttctcagagctctttctttgttaaatgacacatgaaggtactgggttgaggagagggaaggtaggtaggaaatggagaccagtgtagacaactgtttctaggtctttgaccgtgaagaggagacaagcgttagaattaggacagcaactgaaaggcatctttccctgttatcccctcatactctgttttatatggaatgccattgggaggaaaccccttcaggtccttttctcagcataagaatcacctggagtccaggccccatgctcagggattgtggattttaagcctagggcatccaggtaaacccaatgcagttgttctctaggcccacttagagaagtgctgtcctgggagctttgtggcgtaggacttgggcacctgttccttccccttccatgcgcatgtgcagggggcacccagtaccggtagaagggaaggccagcagcattgaaagcgaggctccctggccctctgcctctcctttcctgtccgggtctctgtggcttgcttccctcaggccacttctaactgtggtctcctctccgccccctggtcctgtagctcttctgtgttcttaattggagtcatcctctagcctttccctttccctgagagaaagcctcgccttttacagatatcactagccaatggcagtgcctctctgtttcttgccagtgccccgccagtcgccagtcgcaggatcgttgacatctgtcattaaactgtttccagctgctggccttgttctctcagctgttcttcaacactgaagccttgtttcgcctgcttccgggtttggagctcttccggaggcacaagggtttcagaaggttgactttttgccttgtcaaggtttatagaaggaaaggacagtgacatttaaagtagtgtggctccgaatgttaggaatcattttctgttacctaataacttcatcttagtggtgattgtctgaattgtatgatatgttgacagatttctcaaagcagtctctagtgatcattaaacagcctgagttgtatcctgaagaaacatgtatctgtccatatatggaacaaatatttgttccattccctttgtgtggaaactgcctgcatgcttcattcatcacagtaatgcatttcctcaggaacttttaatgtttcaggtgtctgttgtcatagctttggaatcgtgataacattatttgacttgcttagaattatagtctaatggatttactacacactaaaccttttagacaggccttgaaaggtgaatttggtaggcatttcacacttctgtgacactcagattttgctggtctcttggatacagtcacaagtgatatgtaagcaaaactgcaagctcaggcataacagcctgctgggctgagcacgattgcagaagtgaatgacttttcacgttacgcttaactcttttctctcgggtgctcagagcacaacttaaagcattctctctgagccaggggaatagcatcctggaatgtaagcccttgaagatggaggtctgtaaaagaaatattcagtgttaacttggaattcagtgaacttttttcatattaaaggaaatttgtcaagaaaaataattgcacagttaaattgtgctacagttgttttcattaagaaagtagaaagaagaccctaacagtttaaaaaacaaatggccctcattgtctttatattgtgcatataactctttgttatcttcagattatatgaaactattagtattatttttatattcttctcatctttttttcttttgccttgagaaagtcacgttcttctcattgtgtactttacatccaaaattattttgtaactctttttttttttttttttgagacggagtctcgctctttcgccaggctagagtacagtggcgcgatcttggctcactgcaacctccgcctcccgggttcaagcgattctcctgcctcagcctcctgagaagctgggattacaggagtatgccaccacacccagctaatttttgcatttttagtagagacggggtttcactatgttgtccaggatggtctcgatctcctgacctcgtgatccacccgccttggtctcccaaagtgctggattacaggcgtgagccactgcacttggccctctataactctaaatgttgctgcattttattattgcaatgactaataagtccctaaacttgatgcagttagatttccctgttattggatataggatatttacatttttgctcttgtgaatatactagagtactatactgaatgtgtgtgtatatgtgtgtcaccttttatatatttaagtatttccttagggtaaattcccagtagctggattattagagggtagaaatttttttatggtttttgatataaattgtcaaattatttcccaaaaagttgtatcagttcacagagctaccagttggtttctcgcagccatctgctatagttttgttgggttaaaaaactttctatttttgctagttcatcttatgttgctttaatttacattttccaataacgattaaacctaaactttttttgtataaatttgcttttttgagtatttcttcttgtggagggacagatacttatatataattattagattggctgctagtccaagagcagtaagtagttaagggatcaagtcagcaaccagtggccgtagccatctttgaccaatcaaagatatagattcatatcatcgtgaaagctttgattcagagaaaatagttatatatgtacctaatggtaggaaattggggtagttgtatttagtatatagaatattacctaattttttggttagaggttctagaagacaagactttttcagtttgtcttatgccctctttttttttgttgggggagaggtggggggtctggacactctaggaaattaaaactgagtattttacttattgcatgcatagaagttgattttcttttcttttctttctttttttttgagatggagtcctgctctgttgcccaggctggagtgcagtggcataatcttggctcagtgaaacctttgcctcccaggttcaagcagttctcctgcctcagcctccggagtagctgggactacaggcacccacgacgatgcctggctaatttttagtagagctggggtttctccatgttggctgggttggtctcaaactcctgacctcaggtgatctgcctgcctcagcctcccaaagtgctgagattccaggcgtgagccagcgctcctggcagaagttgattttcttaaaaaagagagataataggaaaacaagctcaaaaatctatttggggccttatgcaggatgttggccttagcctgaagaaataaaaactgatgaagcgcattgttagcagagggatgacttgatcaggtttttgaaaacgaatgttcagcattgaggtaactgaggcatctggatatgccggtctgggcccctgggagccgcaggagataatggagatagagattctatgggctgagaccattggtaggttttatggtgttgaggaatacttaacactgattttttttttgagcgctgttaattaaatgttaaaatataatcggtttgctttagagaaaggcacgaatggattctggggctctggtatggaagttattttcgcagtgtaggtgcaaggtgagggaaccagctagggaggggagatgggcgagggtctgtggagaggggctggagtgaaatggtttgagagccatcatgtttataaaagcaatagaaggtacggtggggtaatactttctatttaatgcatttttcattttatttctttataactaatataaggcacattttacatttcagatgaatttacaaccaattttctggattggactgatcagttcagtttgctgtgtgtttgctcaaacaggtaaaaacaaaaaattttcttagttgtcttttcatttccgtatcttgtattgcgctttgaccagttaggttcatatgagaacctaagtcataatcatgctgctccttctggaagccctgcaattgttcctcttactcagagaaaggtcaagttccttcatggtcaggctcccctcacccctgccacctgggatgatgggaggcaagttggctggtgaagtactaaaatgctagggattgaacacactgcaagaagatcttttgagaacatgagagtgtgtaagtgaacagaaggcaaaagcaagtatatttagaagcaaatgaaataaatgtgtagaatggaggattatgaactgtccattattatctgcaaagactttctagaagacattctcactctttgataaaaaagtctcacaaaatgttggcatcatctaggaaagcagtgaaaataaagctgaaaatgtatttaacccttctataaagatgtggctccacatctggaataatggatacgcagttctgtcctctgaatcttgaaaaactacactgcatagagcagttcgatatcaggattggaaggacttactacaagtagtaaaaatgaagcaggagaccgtaaaagaaagtattgataagttagttacataaaatcaataataacaaaaacattctgtgtcagaacaccgtaaacaagatgagaaactaaacaaaggttccacttcattaatgtgtatagaaatccaataaaaactgaggaacataacaaaaaaatttgcaaaagacataacaaaattataaaagaaatggttagtaaaaatatgaaacaatgtaaaacctgaaattgataggcttcaccaatgaattgatattctaatttacacttatgaaatgagcaacagttttttaacattaaagcacttcggttggaaatgtggtaaaatggtatttgtacactgccgttttgtgggagcttatattagtagtgttgccctatggtatccatggggaattggttccaggacctccttcagataccaaaatccacaaatactcaagtccctgatataaaatggcatgatatttgcatataacctacacatatcctcctgtatactttaaatcttctctagattacctgtaatacttaatacaatgtaaatgctaggtaaatagcttttacactgtattgtttagggaataatgacaggaagaaaagtatgtacatgttcagtacagacacttttttcccccatttttgatccgtggttgcttgaatccactgatttggaaaccacagacacagagggtcaactgtatattacttttggatagaaattagtgtgtatagagaattttagaaatgttaatatgctcttcaacttagtagttaattattcttttgggttttattataaggaaataatcagatgtgtactaaggtttatatataagatcatcagcatgtgtatgtgcatgtagtacagtatgtgtatatgtgtacttggggtgtttatatgtgcatgtgagcaagcatgtgtgaactgtgcacacatacatttggaaacaatctaaatttgtccagcattaaatagagtacacttatattgaaatacataatcattaaaagctttttaattctttttaaaaagaatttgtgatgataagaataaaacacttaggataaggtataaaaaacagtatacaaaactgtacaactgtatatataaagtgcatcctcagtttcatgtaaataatacatgtattaatatatatatgcttgcttccccttgctatttatctgcataggaaaaagactggaaagaaataggcaaaaatgttagcaacagtcctctctcagttaacagattcagtgagttggttctttatgctcttgtgtgttttccagattttctataagaagcatatgctggttttataatctcagaaaagatacgttggagacagtctgtattagcgcttaccatgtagaaggcatactcttccttaggtagatgcaaagaaacctaaaacatactttgaacatagagcctgagaaattctgggattatggattagatgaatatggacttttcagttatttaacatactgaaagcaaagggaaagccttgaagattcttgtgagtatggtaggagttaaatgacaagaaataatactttgcccagttttaagagaactcatgacatttatgacagtcaagaatgataaattctgaattatgtcttgtctttgatacagaagacaaggaagataacttatgtctctctgtggctttcagtgtcaaggtgatccaaaatcacaggtcccaaattttgcattgttctcaccggtttgtgggagctaaaaattaaaacaattgaactcatgaagatagtagaaggatggttaccagaggctgggaagggtagtgagaaggtggggaggaagtcgggagtgttaatgggtacaaaaaaatagaaagaataagtatgacctagtatttggtagcacaacagggtgactgtagtcaataataatatagttgcatattttaaaataactaaaagagtataattggattctttgtaacacaaaggataaaggcctgaggggatgaataccccatttaccattatatgactgttatgcattgtatgcctgtatcaaaatatctcatgtaccccatacatgtatacacctatttacccacaaaaattaaaaattaaattaaaaaatcctgctctctttggggaaggtctagtttagatggtaactaggtcatagtattaatatttaacatatgtattgcattgtcattgtgattctgatttttcattattttctctctgacacttcacataaaatgttctgttctttcttctttctgacagatgaaaatagatgtttaaaagcaaatgccaaatcatgtggagaatgtatacaagcagggccaaattgtgggtggtgcacaaattcagtaagtaaggttgctcaagtcctttccatttgttctctggtcatttagtgtggctcagtgctgtatccttcagaagcacatattaatttttatgtaaatcataaaatgaataacctaatggtttggagctatgtggttcaacacagtagccactaggcagatgtggctattgagcacttttgtacaaattagaattgctctaagtttcaaagatatacaagatttcaaagacttagtattaaataaataataatggtgaaatgataatttttgtatatttaaaaataatgttataacagtgttaaaattttctctttttctttttttagtgtggctactaaacaattttaaaatacatatatttgtagctcatctttgtggcacatattagatttttatgggagaaccttcaaaaaaatcctagtcatttagtttgactgtttcagatttccccttttttgatggggaggtataaattaaccttcttaattatatttgagttaaactactggaattgatttgcatcccaatataagcttattgaggttaattagggtttggattttattcacttttgtcatctctatacttttgctaatatggtaccttccacaaagcctactaaatgttcagtgagtcaatgaatgaatgaatgaatatatcaaaagagaaggtaaggagaagtcattttgaggttgtatagtttattcacagaatgaataactaatatcagaagatcaaggggttactgattttgttttcatgcaggcatttgggcccaagtttcaagtgcctatttttgtatgcctaagtggtcaagtgtcagatatgtcgtatggtttgaccacatgaaagaaaaaatgagaggttttgttgtttttcaaaaattttctaatggtgttttctaaaagtggtgtgttgggattacattggcaacagtggaggaaatatggagtgttgtgagtttgtctcaggcaaggcttatgtaactgaagctcttggttttcatatctgaaaatgaggatgataatatccgctttatctattgttacaataattagaattgatgaacttaaagcagtttcacttaaaaacttctaaataagtggtagctgctattattgttaacatatccattttatggggactacagtttatctgtagttaaggattatcttagcctttgagctttggagcataatccttaaaattttaaaggctttctgaatatattcagtgaaattgtatttgggtgtcatgattgtaaatttcgtggattgattagtatttagaaatgtgtaattcactaggatcttgtgctttggtaggtagtagtttaggtttaataaatagtgcagctttgaattatctgattcttggtattcccttccagttgttgattacataaatactctcattagtatgatgtttctcttaaaaaatcttatgtaaaaactattgtgtattctttaaatttaaatatcttcacttactgttactttatacagcaccgttaaattgatatttgataaataaataccatatataatgtcactgtttcccccacattttcacatttcttgaaacacctttattcacagtctttatatagatctttaacagcagtgtttttgaattcactaaggcacttttcagttatatgattaaatttttatttctaagttgtttgatgtataccacatttaaaatctctgtcattactagaaattttactactgcaaatatccattcacctgccattaggaactttttttccttttttgaaatttacctgccattaggaccttttacccttgtcatatacttactccttttacccttgtcatatacttactattttgctttttaaaagttttttaaaaacttatttacaataatagctaatacttaaagttttttcaaacctgtgggaatacttatttaatcggtgctaaatttcgtgttgtccttttaaaaaatgcaataattaattgagatgtttttaagctcgtctgttttccctaaacatcgggttgttcagcatattgcgatggggagagtgccacataatatgagacgctttgtaaggacttttcaaagggaaattttggagaaatgatctgatatttgggtgtatgtatacattattagtagccattaaccatgctcaattagtgatttcactaaagaaattgcttttgattagatactctgaattacaagatagagcatttactgtgtacacttgggtcagttctgggaaaggtattactttcttggaaatgattgttttttaacaagaacacttaccacagtttggatgaagggagcatattgtttaaaagccagaattggggtacattagatgtgatttgatgttttgcaatttaattgcttatttgcaattattatgtaaaaaggtttgaccattacaattttcatttatacctatattttatatgtcatttagacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggtatggaagcccaactctgtgaatacctgcgtgtttacttgaggcattcgacaccagctttatgcaaactctgaccagtttctgttgaaggctcgtttttacatgtggactggcactcaaaaatgtggaattgtttaaattttagaaaatttttgcagatataacaattgtaagacatatttacttggaataatattaaatgttgcctaatattcaaagtaaattttgttaaagattcagaaagtattaattagctttagtgagttttaaaaatgaaagtgttcatcctctggtctaattacataatatattataaaagcaacattttaacctgttcttttcctttgtatttgtttagtattattaaactgttaaggtttttgtaattatgtctgttagtcccacatctaaacatgaaggaaaaaacaagccctcatcctcgcttttctggtttccgacctttcttgtcaggagaatggtagagtggccctgtcccctgacttccctcccggcccctcctcaaccaggtcagccctctcctcctcatcctgctctagcaaagctccaccatcgccttcagcccgcagacccaggggacccttgtcaggattttttttttttaactcttctgtaccaagtaacactttgtactttttgaaatgctctgtccttgatcaatgataccactcctcggtttttctttgtgtctcttaccattgccttccaggcctctttttgtgtcttttttcttcctccctttttgcagtccacctaaatgtcagttttcctctcgtggctttaaaacccaattgtatgctgcagcaacacagacttttcttgagctccaaacccatttctccaattgcctattagaaatctatatagagaaaactacaagttaaaattttaattacattttcatccaaacctctctcctgtatttcctaagtaaattacattaacgtctcttgtatctctctcttctcctccttcatcatctctctctgggtttcttttgtagattagctagtctctttgcctcataatgataataaaaataaaataataaataataaataataataaataaataattatttttaaagctgtctgccaggctttctaaagtaaagatcggatcatgttattcacttgcagggagtggcatcccactacacacagaacagagttcacaacttcagtgtctaaaaagtcagttgtaccctatcacgtgttctgccttgccctctccagactaatttatggtgttctatttgttttcttctcttataaactgactttttgtctgttttgtccactgtggattgggaatatcttttttatctttgcatcctgaaggcctggtgttttaagtatttgttgaatgaaactgaatacatacccattgagttacttatggaattcccaggtttttgtaaaaattatgacaacatgttttattttattgtgtttaccgtgtaaaccacatttatttggtttttctcgtttgcgtttgattgccaacaggcaagtttcattttctaatctcttgtctaattaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggtaggaatgttgggaacattgaccattttcattataaagtcttggcaattctcaaatgttgttttatattttattcctttgttactcacaacatacttgtgagataaacaagccagttttttagccttttctgagtggaagttgatattccagtcacacgtttaataatcttttctgccaccttgttcctctgtcactggatgctactgtttgacacagattgtacctcatagataatgacttgcatgcttattttcatactaacttgatcatttatcttatgacttactttattttatttttaagagtttcactcttgtcgcccagactggagtgcagtggtgtgatctcggctcactgcaacctccgcttcccgggttcaagtgattttcctgccacagcctcccgagtagctgggattacaggcatctgccaccacccccaactaattttttgtatttttagtagagatgggggtttcaccatgttggccaggctggtctcgaactcctgacctcaggtaatccagctgccttggcctcccagagtattgggactacaggcgtgagccaccatgcctggcccttatgacttattttataaacatgtgttgaatacccagattttatctaattgctaattagtatgtctgcacctgcccgtacagcctgatctcatcttagacctggatttttcatatgatgatgatctgctttccaaaccttatttttcccatttcatgcatccccagcttaacctcttttttgcctgcttctctccactcctgttgctctagaggtttagcaacagaatattagaaagatttgacagttatgaggcctaagagctgcctttcaaaaattagccctattttagtggaaacatttaaaaatagcacttgcttaaaatgttcttttattctgtaagcataattcaaggaccatggcattagggagctcctatcaaattagtgttttttaaaatggccagaattctagaatatttgtttattcatttgttcagcatgtcattattgagagctggtgtgccaagaaaatgaatgtgagttatttttaaagtagggaggcaaaataaaaagattgtcttaggtcttagtccatttgtgctgctttaagaaaatactataaactgggtggcttatgaacaacagaaatttatttctcacagctctggaggtgagaagtccaagatccaggcagattgagcatctggtgaggtccctcttctgggttcatagatgataccttcttgcgatgtactcacatagcagcagggagacagcagctctctggggcttctttgatgaggtcactgtaggagtctattcttacgttgctataaagacatatctgacactgggtaatttatgaagaaaagaggtttaattggtttacggtcctgcaagctctacaggaagcatggcgctagcatcagcaaggcctctggggaggcctcaggaagcttccaatcgtggcagaaggcaaagtggggagcaggcttctcacatggtgggagcaggagcaagagttggggagagatgccacacaattttaaataacagatctcatgagaactcactcactgtggtcagaatagcaccaagccatgagggattgatctgcccccatgatcgaaataccttccaccaggccgtaccttcaacattggggatcacattttaacatgagacttgggcggggacagatacccaaactgtatcagttactaatcccattcatgagggctctgccctcatgatctaatcaccttccaaaggaaccacttcctaataccatcatgttgggaattaggttttcaatgtaggaattttggggtaacacagacattcagtccatagtaacctacatttggtaacatagatgaattttttaaacaatgcaaatctctgtctttccatctatccatccattcattcatttatgtaccatttttttcttggcaggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggagtaagcgcattcatttcctatcaggggatattgtttctattatgtgtgtgaattttaagtgtgattttactatgataatagaaaaattgaccttaattttcatagatttgattatcttagagaagtaattttaagtaaacccttaaattgcctgtatacataaagtgcctttataaaagcatatttaatctttatgcaaaccacacagttagtttattcatgcgggcttttaaaagacagaatgctaaccatttgaaacagcggggcaacctctctgtactgtagctggtggtctggattttagaaaagcccatgtgtcctaactttctggctttgtactagagatagaattgatgttattatctgaggcatcaccaggaaccttgaaattgctcaaagggagagtgtcttgtatcattttcctttggtcagttttcttctcactgtctttgaaagacacatctttctcctgtgtcttagtaattcaaaaagagagaactttttaagctctagtttttaacctatatgaatagatgtattttgagaagtgatacaatatttgtaattttaattgtaagattttcagtagcaagcccatccctattggttcaataatttgtattttatgatccatgtagcagctatgtattttgagatgacactttaatgatgtggctgaggctgaaactagaagacattgtcatgtcaagtttgtcctgcgtacctactcttgtctcatttttgttccctccagtgcccccattctctagatgaccttctttgattttagaggcctcttagtggttatttttcagtcaatttttgctaaggtgctaattgatgcccaaaataataagtgaaggaatatggatagtaattaagaatttttctatcaccactgatgctgggcaatttactcagcctctccagggctgttttcttctctttaagaagggatcatgatagtatctacctcatagggctcttgtgaagttaaaatgcatcaatctctataaagtaccaatgagcattcagcaaatactaattcctatattgttattactttcgacttttcactagagtgtttgcaatttaaggttagtccctgctgttatagccgaagcaagtagcattccaggtagtacctagccttacacctcttttcttactagccattgatgtgtgagcctgttagcagctcgttgtggggagggcattctctgggctgcctctaactaggccttaacctgtggtattaaacaagccataacacccttgattgtggctgtttttctgtgttggtcatgctgatccactcctctagatgcaaaagaatcagacattccacttttgaaagattgccagtattaataaatgtgattcccaccttaaagtattttactgtcttatgaagatctaaacagacgtattaaataaattaacgaaagcaggtaaattcctatagtcctatgattttataattataaattaccatagtgacaagaagattttacagttactttagattctttattggaaagggcaagaataaagtaaatgagtgcataaacagtactgattgaggagttagaatgggtgaaattatccttaaacaagatacttatttctgttataaaaaaaggaagcctcatatggtgggctgataaagaaggtgcatggcatagaacatagagcagagatgggtggatggggacaagacagcagcagtggggtaaagtaaggataggctcagacactttcatttattcagcaaatgctcatcaagggcttactgcttgccaagcagtgtgctggcttgctagctgctggagatatgatgataagcagaactaaaccaaaccaaacaaaacaaaaaaacagtttttaaaaagaactgagagattgagagatacggatggtcaggcaagatatcgttgtacatgggatggaagagcttcattcagtgggctttgtgtgtttctcagcaagataattaccattgtataaagagaagacacagaaaatacagaattaggttaaaaatacaatggtggcctatatgaaaattaaaggatttttgttgaattactgtgaatagtgttttaaaattgaaatccttttcttttcaagtcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgtaagtgcctggttccttacatagtgaatgtgtttatgttggattttaatgtttaatactaagagcttgtgggtgactggcttggggtttctcagggtttgaggttttgctgttttggtaagtaggggtcctgattgaaagtgcaggaaagctagtgttgctgtttgtgaagatgcagctttgtatttgcttccttctgctcagacaagggcctcactggggtgggaaagggatgcccagatgccactttcactctttgcctcaactccccgcccacagcatttggtagcacagtcagtactctttctaaataaataatttatctagtctcatactctttgttttatacgatttttaaaagcagtcactctgcctttattgaaaataaatattggcaaagcattcaagttctagaagaaatccaaatggtaaatcttggtctttttcttaagttgtagataatagaatatttaattactgactattctttaatttcattgtccttatatttaatatacatagataaacttactatttaaaaccttttgaatatggaattttttattcatacatgaaagtaaagagaagaggattagcaattcatgtatacacacgactcacttcagcagtttatatttgatactgttatttgaaagcagtcttgtaatctagttatatgtatgcaactagatgtaatctagctatatatggattatatatgtaatctagttatctaaagcagtcttgtaatcgagttatgtgtaatcttgcatgtataactagattgaaaaattagaagagattataagggtgtatttaaatactaaattatattacttgatttcttaggattatccttctattgctcaccttgtccagaaactgagtgaaaataatattcagacaatttttgcagttactgaagaatttcagcctgtttacaaggtaaatgtgtgagataaaaagaacaagattctaaacatttttgattgttagaggcaaatcatgtctgaattgaaatgtgggaaaatgccaccagataggcaaaccgaattttacaaaagtggtttatattaatttttaatcacatattataaaactggtttctaggtttgactcctaaagttagttaggaggaaacatgggaactggcatttaaagataaaagttgctcagtggatcctaattggttgaatgaatagcagttgtattttacgtgttttatcttttaattgcaggagctgaaaaacttgatccctaagtcagcagtaggaacattatctgcaaattctagcaatgtaattcagttgatcattgatgcatacaatgtgagtacatcttaaataagatcagttttggacaataccctgttgagaatactttgtacaaagaaagtaaaacttccttcatacacactttagcgagcccaaagtactacagaaaaacttaaattctgtatgtatctagaggaaaaactttatacatattgtcttacaaaagcaagattcatggcctaaacaaagtgaaaatgtgataaaggcatgtggggagtatttccaaataactgtttgtttatcattaaggaatagatctccttgttagaaagcaattgtaaaacataacttacatttaaacttacaggatttctccaatctttttcctccccaaaatatcctttatagagtcatctattctgatgaattgtgctagaaaagtttttttttttgccaattcttctcttcccatatattcagaggatatgggtttctatttcaggaggtacacactcatatatacgtataccataaaatatataaaaatgtaaatatacatgtgatttgcctatttcaaaaagatttatagtgttgttttcccctcacagatgggaggaagttgaattgaaattaaagaggaattggcttatcctttttgagcataattcagtgtactttaatcacaccgagttagccttcattaataatcatttaaataatctgaaggcggttgtaatttggtaggtaacccttgtgtgtctcgtgcaccactttcagcccccatccccctaaccctttggcagcttgaattttagacatttttacttcatgtcatgggggtaccataacgctttggaaaggccagcctaccatatgaggcttcccttttttatggggtaccataatggtttggaaaggcctgacttggaggggtttttataaaggtttttaatattttacttgttccacagcttttcccattctcccctgtcttagataattttcctaactcttgttctttcaggggtgtgaacaagagatagcttgccattgtacccttctccatttgtcctgaatagtctcatatgttaaacaagccctggcttgaatccttccttcttgggggattttgtttttttttttttttggctgggctacaatggttccttaagcaaatttgttcctagactgcatagttgattgtttaccctagtccatagttagctggagaggtaggactacagaaatgccattttgccgatggggaagacagcatttatttcgtttttttttggggggtttttgtttttgtttttgtttttgttttttagatggagtcgcactctgttgctcaggctggagtgcagtggtgtgatcttggctcactgcaacccctgcctcccgggttcaggcgattcttctgtctcagcctcccgagtagctgggattacaggtgcacactgccatgcttggataaattttttttttttttttgtattttagcggagatggggtttcactgtgttggccaggctggtctccaactcctgagctcaggcagtccacctaccttggcctcccaaagtgctgggattacaggtgtgagctaccacacccggcctattccacatttttaagactcctcctaattagtaacagccctctgcactgtgtgatcctgagtattttaactcagtgattaaaacaggaatactcttttcaattgtgtattttattttaaagatttgatccttattaattaaaacctgtttctctggcctctgtgttttctagttactcaattggatttggcttgtagatactttattgaaatatatttttttctgagcagtttatccattggttttatgcattcaagtagcattttgtttgacttttcctgtgtataattaggcattcttttagtccctttcctcagaagtcattttggaaaacggcaaattgtcagaaggagtaacaataagttacaaatcttactgcaagaacggggtgaatggaacaggggaaaatggaagaaaatgttccaatatttccattggagatgaggtatgttgtataaagcattttctgtagaaaacattggttatttataagcaaatttagtttatagtttgagaaacattaaaataagtgagcaactttttgaaatattttttagtagatttaaattgtttagttggttgttaatcttttttttcccttcaaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtaagctgggtgttgtcagacagtgacagagctacattggtttagagagtataggcaggtcatattttgggacatccagagaatatctctctatttggagcaaattattttttccaaccacggttgctcaccacaagatcagtttgatgatcttgtgtgtgatatttatagaaagttccttcctgcctttttttcttaaagtgattactctttaaaataaaagattttatagccatgaaagaagtatattcaacaaattgttaaggtagcgtttctctcatgtgagagcaatcaattttctagaacaaaataagcttgtgtaaaataacgtttataggaaaatgttttggaaaaacatcaaaccgatgatggcgatttcgtctgggaaatggaattatgaagcagtagaagatgtttgtcttgtactacatgtacttctgcattgttggaataatttttaaaaaataaatgtgtgttgtaaaatacaaaagagaaaatggtattttcagtatgtagaatctagtactaagaaaactaacaaaattacttcagattttattttcacactgtggttactttttgtaattgaaaatgaaaaactgagtatacattgaataccgctttctctgtaaaagaataggaagagggaagagtgtttaatccagtgtcagccccaaaagactaggcttagaaggctattgactatgaaagaaatatatggctttagctcactatcaatttttaattgtctgtgctaagtaacaatttaaatgttagagtttctttatcttccatgttgtacatatcctgttttaatcatgcaggtccatttttagtaaaatgtcatttaaccaaaaagattatcttgaaaatactttgcctttctttcctttatatttttaccagatacagaatcagtgcagtcagtgtccatgagcattatgtgttctaaaaatacacagggaacctgaaaagtctgcacatgtaggatatatttatttttaaatagtatactagttatattttaagtggtatacacagtatgttttttttcaacttccatacacttttttgcatgtgtttattgtatttttttaggttaacagaccattgctttaaatttagacagttcacctggaatagtaaatgtaatagcataccatttgaaaatgtaactaacgtgctctttaaaattaagtttattctgcctttccacatgtgtcattcactattcattgctagattacatttttgtcttgaccaaaatggttactttcctgaagaaatttttttcctagactcttgcatatattccgtatgaacttgagtggctggaatgtacatgtgcgcctgtgtatgtttgtccctgcttgcacatgtgtgtacactttactacacgactgtgacttgtggcatggacactcccacctaacagattaggagcttgaagagattttttatagttttattttctttcccagtttttcccttttaaattattattattattattccctccaagatgattcttcttcttttttattatactttaatttctagggtacatgtgcaaaacgtgcaggtttgttccatatgtatacatgtgacatgttggtgtgctgcacccattaactcgtcatttacattaggtatatctcctaatgctatccctgccccctacccccaccttatgacaggccccagtgtgtgatgttccccaccctgtgtccaagtgttctcattgttcagttcccacctatgagtgagaaggtgcagtgtttggttttctgtccttgcgatagttttctcagaatgatggtttccagcttcatccatgtccctacaaaggacgtgaactcatcattttttatggctgcatagtattccatgttgtatatgtgccacattttcttaatccagtctatcattgatggacatttgggttggttccaagtctttgctattgtgaatagtgccgcagtaaacatacgtgtgcacgtgtctttatagcagcatgatttataattctttgggtatatacccagtaatgggatggctgggtcaaatggtatttctagtcctagatccttgaggaatcgctacactgtcttccacaatggttgaactagtttacagtcccaccagcagtgtaaaagtgtacctatttctccacatcctctccagcacctgttgttttcctgactttttaatgatcgccattctaactggtgtgagatggtatctcattgtggttttgatttgcatttctctgatggccagtgatgatgagcattttttcatgtgtctgttggctgcataaatgtctccttttgagaagtgtctgttcatatccttctcccactttttggtggggttgtttgattttttcttgtaaatttgttggagttctttgtagattctggatattagccctttgtcagatgggtagattgtaaaaattgtgtcccattctgtaggttgcctgttcactctgatggcagtttcttttgctgtgcagaagctctttagtttaattagatcccatttgtcaattttggcttttgttgccattgcttttggtgttttagtcatgaagtccttgcctatgcctatgtcctgaatggtattgcctagattttcttctgaggtttttatggttttaggtctgacatctaagtctttaatccatcttgaattaatttttgtataaggtgtaaggaagggatccagtttcagctttctccatatggctagccagttttcccagcaccatttattaaatagggaatcctttccccatttcttgtttttgtcaggtttgtcaaagatcagatggttgtagatgtgtggtattatttctgagggctctgttctgttccataggtctatatctctgttttggtaccagtaccatgctgttttggttactgtagccttgtagtatagtttgaagtcaggtagcgtgatgcctccagctttgttcttttggcttaggattgtcttggcaatgcaggctcttttttggttccatatgaactttaaagtagttttttccaattctatgaagaaagtcattggtagcttgatggggatggcattgaatctctaaattaccttgggcagtatggccattttcacgatattgattcttcctatccatgagcatggaatgttcttccatttgtttgagtcctcttttatttcgttgagcagtggtttgtagttcttcttgaagaggtccttcacatcccttgtaggttgtattcctaggtattttattctctttgaagcagttatgaatgggagttcacccataatttggctctctgtttgtctgttattggtgtacaggaatgcctgtgatttttgcacattgatttttgtatcctgagactttgctgaagttgcttatcagcttaaggagattttgggctgagacgatggggttttctaaatatacaatcatgtcatctgcaaacagggacaatttgatttcctcttttcctaattaactgatgggcttccctttgtgggaatattgttatgtgttatttctttctcctgcctgattgccctggccagaacttccaacactgtgttgaataggagtggtgagagagggcatccctgtcttgtgccagttttcaaagggaatgcttccagtttttgcccattcagtatgatattggctgtgggttgatcataaatagctcttattattttgagacacatcccatcaatacctagtttattgagagtttttagcatgaagggctgttgaattttgtcgaacaccttttctgcatttattgagataatcatgtgttttttgtcttaggttctgtttatatgatggattacgtttattgattgcctgtgttgaaccagtcttgcccagggatgaagccaacttgattgtggtggataagctttttgatgtgctgctggatttggtttgccagtattttactgaggatttttgcatcgatgttcatcagggatattggtctaaaattctctttctttgttgtgtctctgccaggctttggtatcaggatgatgctggcctcataacgtgagttagggaggattccctctttttctattgattggaatagtttcagaaggaatggtaccagcttctgtttgtacctctggtagaattcggctgtgaatccgtctggtcttggactttttttggttggtaggctattaattattgcctccatttgagagcctgttattggtctattcagtgattcaacttcttcctggtttagtcttgggagggtgtatttgtccaggaatttatccatttcttctagattttccagttaatttgcatagtggtgtttatagtattctctgatggtagtttgtatttctgttggatcggtggtgatatcccctttatcattttttattgcatctatttgattcttctcttttcttctttattagtcttgctagcggtctgtcaattttgttgatcatttcaaaaaaccagctcctggattcattgattttttgaagggctttttatgtctctatctccttcagttctgctctgatcttagttatttcttgccttctgctagcttttgaatgtgtttgctcttgcttctctagttcttttaattgtgatgttagggtgtccattttagatctttcctgctttctcttgtgggcatttagtgctataaatttccctctacacactgctttaaatgtgtcccagagattctggtatgttgtgtctttgttctcactggtttcaaagaacatctttatttctgccttcattttgttatgtatccagtagtcattcaggagcaggtcatttagtttccatgcagttgagcagttttgagtgagtttcttaatcttgagttctagcttgattgcactgtggtctgagagacagtttgttataatttctgttattttacatttgctgaggagtgctttgcttccaattatgtagtcagttttgcaataagtgcggtgtggggctgagaagaatgtatattctgttgttttgggatggagagttctgtagatgtctattaggtccacttggtgcagagctgagttcagttcctggatatccttgttaactttctgtctcgttggtctgtctaatgttgacaatgtggtgttaaagtctcccattattattgtgtgggagtctaagtctctttctaggtctctcaggacctgctttatgaatctgggtgctcctgcattgggtgcatatatatttaggatagtcagctcttcctgttgaattgatccctttaccattatgtaatggcgttctttgtcccttttgatctttgttggtttaaagtctgttttttcagagactaggtttgcaaccactgcctttttttgttttccatttgcttggtagatcttccttcatccctttattttgagcctgtgtttgtctctgcacgtgagatgggtctcctgaatacagcacactgatgggtcttgactctttatccaatttgccagtctgtgtcttttaattggagcattttgcccatttacatttaaggttaatattgttatgtgtgaatttgatcctgtcattatgatgttagctggttattttgctcattagctgatgcagtttcttcctagcatcgatggtctttacaatttggcatgtttttgcagtggctggtaccagttgttcctttccatgtttagtgcttccttcaggagctcttgtaaggcaggcctggtggtgacacaatctctcagcatttgcttgtctgtaaaggattttatttctctttcacttaaagcttagtttggcttaatatgaaattctgggttgaaaattcttttctttaagaatgttaaatattggcccccactctcttctggcttgtagagtttctgccgagagatctgctgctagtctgatgggcttccctttgtgggtaacccaacctttctctctggctgcccttaacattttttccttcatttcaactttggtgaatctgacaatcatgtgtcttggagttgctcttctcaaggagtatctttgtggctttctctgtatttcctgaatttgaatgttggcctgccttgctaggttggggaagttctcctggataatatcctgaaaaatgttttccaacttggttccattctccctgtcactttctggtacaccaatcagacatcgatttggtcttttcacatagtcccatatttcttggaggctttgttcgtttctttttactcttttttttctctaaacttctcacttcatttcattcatttgatcttcaatcactgatatcctttcttccactggatcgaatcggctactgaagcttgtgcatgcatcacatggttctcatgccatggttttccgctccatcaggtcatttaaggtcttctctacgctctttattctaattagccattcgtctagtcttttttcaaggtttttagcttctttgcgatgggtttgaatatcctcctttagctcggacaagtttgttattaccgattatctgaagccttcttctctcaacttgtcaaagtcattctccgtccagctttgttccgttgctggtgaggaggtgcatttctttggaggagaagaggtgctcaaattttagaattttcagcttttctgctctggtttctccccatctttgtggttttatctacctttggtcttcgatgatggtgatgtacagatggggttttggtgtggatgtcctttctgtttgttagttttccttctaacagtcaggaccctcagctgcaggtctgttgggagtttgctggaggtccactccagaccctgtttgcctgagtatcaccagcggaggctgcagaacagcaaatattgcagaatggcaaatgttgctgcctgatccttcctctggaagcttcgtctcagaggggcaccgggctgtatgaggtgtcagtcagcccctactaggaggtgtctcccagttaggctactcgggctcagggacccacttgaggaggcagtctgtccattctcagatgtcaaactccgtgctgggagaaccactactctcttcaaagctgtcagacacggatgtttaagtctgcagaagtttctgctggattttgttcagctatgccctgcccccagaggtgttgtctacagaggcaggcaggcctccttgagctgcgatgggcttcacccagttttagcttttttttgctttgtttacctactcaagcctcagcaatgggggatgcccctccctcggcctccctgctgccttgcagttcaatctcagactgctgtgctagcagtgagcgaggctccatgggtgtgggaccctctgagctgggcatgggaccctctgagccaggcgcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttcggctcacactccatgggctgcacctactgtccagcaagccccagtgagatgaacccagtacctcagttggaaatgcagaaaccacctgtcttctgtgtcgctcacgctgggagctgtagactagagctgttcctgtttggccatcttggaacctcttaaattatttttgttttgtgtgattgcaattttggcatgtttcttcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggtaagtaaagggcctgaagtggttgtaagatgtgatcccatctaatgccacgaaaaatcttgagtttagttggtgcataagtagaaaaggggtagcttgagggtcagtctcgcccctaggtatactttctcacatgttgttgcttattttacttttcagtcaatactgtgattgtatatttttaccattttgagaaatgatatgcttaattgcaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataagtaagtatttcctaattgcttgaaatagttgatacttcctcttggctctcctaagcctgtattgtttctagaaccagaacagtgccaatattaaaatatactgtaaataaaatgcctgccatgtggaagcctactctttaattcttaaaagttctttctcaacagctagtatatattacatggtatgaagtgtgtcatgtgagagttgtactattattttgatctgaatgtgctagataattgaatttacatggtaacctttattttggcaattaagatttaatttaatttaatttgtcattaccaatttcttaattactgtcttttgacaaaactaagccaaattaaagatttttcctcttgaaggattattatactagtaacatattatttaaattattatgattttggccgagcacagtggctcacacctgtaatcccagcactttggaaggccgagacaggtggatcacttaaggtcaggagtttgagaccagtctggccaatgtggtgaaaccccatctctactaaaaatacaaaaattagccagatatggtggtgtgtgcctgtaatctcaactacttgggaggttgaggcttgcttgaacccgagaggcagaggttacagtgagccaaggtcacaccactgcactgcctggatgacagaacaagactccatcgcaaaaaaaaaattattatgattttatgttacatatttaatatgtgatagggctaatttattttactatcttttatttcttaatagggttttaatttgaactgtaataaatctttaattttattatggaaattagcatctttttacataatttttctatccacaaatgtaatgttcctcttcatttattgaaatcttccttcatagctgtttgttcaatttggtcacaagagtttagcatgggaaatatgtttaagcaaatatttactgaaataataaaatgtaaatatcataatttgtgttttttgtaacagagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccaggtagaaatgcgatgattgcagacattcttttcatatcttgtatgtcttgtttctgcttatttaggcctaacatccagaaacagcctccagctggaatattttaggtcaagttgggaaatttttcatctctcaaagcttaaaatattatctaattaactgtataagaaataaggaaaagagagttccacttttaagttttctgagtggagagtttgaagattaaatacagtgatttatataagacgcttagtgatttatataagacacttagaacgatgcctgacaccaagtgcatattaagagttttttgatgattgatgattttaaaattagagcttgatttaagcttgaatactgggaaagataatttgttaaaggatattaatataaagtgttgaatttgttcaacttctccggaggtgaaactttttttttttaatcttagttttcctagtagcctttttgtagattctttggaattttctaccatagtgtacatgtttttgtgtgaacataagccttcatttctcttgggtaaatactaaaaatggcattttggagcatatggtaagcatatgtttaactttgttaagaagctgccagactcttagactcccatactgttttgaattatcagctaggtgttttgcaaatattgtctcccagcctgtgtctccttatcatttcatttttttaagtgtcttctgaacaccacaggttttaattttgattaagtacagtttaccaagtttttcttctgtggctcttgcttttacattgtctttaagaactctgcctaacccaagattataaggatttttctcctctgttttttggtagaagttttatagtttctggggtttcacatttagatctgtaactcattttgagttagtgtgtgacaaaaggctcagtttttttcatgtcagtgtccacttgttctaggggcatttgttgaaaaaagactgtcttttctccacctttgttgaacatcaggtgaccttacatgtgtaggcctgtttctgactctgtattctgttccatgtatctgagtgttagctataccacatggtcttgtagctttctttatagctaggcctgaaagcagggtcttccaactttattcttttacaaaagtgtttttgagacacttccttagttccctgccttccatgtaaattttagaagtggcttactgattgctacagaagttctgccaggagtttgagtgggataccattgagtttatagatcaaattgggaagaattgacgtcttaacggtattaggttttgtaactcctgcacatggaatatctctccatttattcagtctgaaagatttctttttatcagtatttagtaattcttaacatgcaaatcttgcatatattttgttagacttatatgtaagtttttcatgctttttcattctgtagtaaatattactgtttaaaaacttatattttcaatatgtagaaataaattatatatatagaaaaatacatgatttttgttcattgatcatgtatcctgcaaccttgtaaactcacttgttagttctaagagctattttatagattctttgggatagtgtgcgttcactctcttgggtgtttattcctgtatgttttttataagacactgcacagctctttgtggtgctcattattaccttcttattttccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggcttttctttttgtatgttaacttcgcgtttagaaagaccgtaaaataagtaatgtgatatagaaacagcagccatgttgtagtgaaaagagaatgtgctttgcaatcagttagacctcaggtcaaatcccacctcttccacttagtaagtagaacagcattgagtcacttcacttctctcaactgtcacagggagtcagtactctgttttgtatggggtggttgtatttggcaaatgcactccagtatatgaaatcagcctgtcagctctaatcctcataacagtcctgtgcctagaatgatattatcctattatcttttgttctttttctgtttatttatttatttattttgagacagtctctctctgtcgcccagcctggagtgcagtggtgtgatatcagctcactgcaacctctgacttccagattccagcaattctcctgcctcagcctcccgagtacctgggattacaggtgcctgccaccatgctaggctaatttttttgtttttagtagagatggggtttcaccacattggctgggctggccttgaactcctgacctccagtgctctgcccacctcggtctcccaaagtgctgggattacaggcgtgagccactgtgccccaccagtattatccttaaataacgaatttgttatgagtaaattttagggttggatagtgaaaattgatcatgaaatccaaattgcaaaatagaaaaatataacctactatgatatttgtatggtatgcaactacaatatcattattggttctcaaaagatttgagatcagtttcttgaatataacttgaaatttcattaaaagccagaagaccatatatatgtatgtatattatatatatatgtgtgtgtgtctgtgtgtgtatgtgagaatgattctaattttcaaatgtaagtttgtaactgttcatatctgaattttcatgaaatgcttccagcatattctaataaaatcatgcaagcccctaaaactctgataacaaaggttaattgtgattagaactaaattctcctgactggtggttgagaactcttcttctctttcccaactgactgactgtaatagggcctggaagatttctgcttttctcactgcctaccttattgtgcagataaagatggtattgggaacacttacataaaaatcactgtgtctcaggcatgattctgaccacttaatctgtgtttaatcttcatagtgaaagttgtaggaatgttttacatatgagaaaactgagacacataagggttatgtaacttgaccgagttcccacggctggttagtcagagagctgagatttgaacccaggcagttgggctccagagtccatgttcttgtctatgacattgtacttggtagcagttatgtatcttcagaagtcccgttacctggttaggaagaggtagatcactctttatagagatttacagcccttttacaatttgttgttactctgtcagagttaacactgctgctgttggcaaacatcatgttagggaaatcactttaatacatggaacccagtgctgttgttgtgttttttgactattgagagtgtgcttacaaactgatcatgaataagagcctacagtacaggaatgtttaatagttacaagtgatataggaagtgctgataacattagaaatcattaacttgtcagatttttatttctaagtagaccgtaagatttttaaagttaaatttgatggcagaaaattatattcaaattcacatatgggcaggttggtacatatttgtattagtctgagacaatatatttttctcgttctcacttagtactttacagaaagtcatttttagaggaaaactgattagccaatgacattgccaggctttttttttttttaatacatatttttttctttagttgtaggtcaaaaatagtcaaatgttgacaatttcatgtggttatttctcacaagagaaaaaatttctgtcctactgaggtgaaattttcacccttgctgtacctttcattgtattttgaaggaaattatcagtaaatgttatttaaacttaatgtttataatgtatatatggctaaaatgttgctaaaataagcattttatgtaattcaggaagcagaagtttggtaaaaatttctctatgcattattgaagtccaggcaatttgatggctacagattattttaagagatgtttttctcaagaaaaagtagaaattaacaattgaaataaatgaatgagcatcaagaaattacatcatggattgtaagaaacttttctgatatggaccaaggtttgccagtcaattatgtcattgaaatttttgaaataatgggcaggcgctaattactttggcagaagactaccatgtaggaacattaagaagaacatgtcacattatcagcttctaactgttggagtgggttaaaaaaatggtctgtcctcatctgctgctatgcgggtttaaatgtggctcccaaatctcccacacttctgcattatgtatttaatacattgtagagatggttctgcagctaccactgtcagccattccagagtgagcacaaagatgacattttactgagcttgagggcttcctttcataatataaccctgttctcttgctgcgggtttttttggggtggggtggtgttgcactctgaatgatggaaactaatttgaattattttagtttaccttcatttaaaatgatgcctaatacagatagtgagcttaattttacctctaaccttgcatgttaaacttttgtttgagtggactttgaaataataaatacaaatgtttgtgtatacgacaagacagatttttctccaaaggtaagttcttccatataaattacactttggactcatctatatagggctttttttctttattttttgttttcttttttttttttgtccttcccttataattcttgagtattaaatactagatttagcaaatatattgtattaaagaaatttaattagatgctaatttattttcccaacatatttgaaggaatgtgtagcacttagcctcaaatcagataggatataaatgtggagtgtaatttatttgcactctggctttttaagatagtagttgccaaaatccagtttcctgacccccattttgaaatgtctgctctcacagctgtataatgtattagcttcagttgggactagagctgagagtttgatgtacacagttttgtcatccacattatatgctgtttgtctctgagggatcctgagtttgtccatgtttctgaaacaaccagtcaaggtgtattttgaggagaggggagtgagggctgaggtatgttgtctggttctgattggtatcacatgagctgctgagctgaaatcacagtggtttatttggtgtcttgcaggacccagcctttatatgttaatgtttttccctcattggtatgggatacctacaggatgaagttcagacttcatagcaaggcctctaggactgttcttcctttgtctcctcacctccaatcatatgcccccttaattcttttttttcctcttttttttttttttttttttttgagatggagtcttgctctttcgcccagtctggagtgcagtggtgcgatctcagctcactacaatctccgcttcccgggttcaagtgattcccctatcccagcttcatgagtagctgggattacaggcacccgccaccacacccagctaatttttgtatttttagtagagacggggttttaccgtgttggccaggctgatctcaaactcctaaccaaaagtgatccacccacctcggcctctcaaagttctgggattacaggcatgagccaccgcgcctgccctcccctaactctagaaacttctgaactgtatgtatttctacttaaatgtcccattcttttccctacaccttgactttgcatagattgctatttaccaaccaataatttttctagtcaatttcacaatgaaaatctccttaatcttcttaaagttaataacttttttcttatactattcccagattatgttcataactctattgtaaacttcatcagagtgccttattttcatgtctctcacccaccaaactataccttccttgagggcagaaattgtgccaccaaaaggcagatccaaatacagtctgcaatgaagtgtgaataaaatttaaaaacaaaaattacttttagatcaaaaaatgttttagatgctttctataaatatttttttaaaaatcacctgcagttggttctatagtgagatataaaactgaacaacattccaaaatcttaattttttcttaaaaaaaatttccctggtagttaacaagtattttttatttgtactcactgtaattttctctgattaagtgttatttggtcacacttctcacttggctttcaagcctgctttcaatttataagaacaggagaaaaaagaatgctatagcaagtatttaaatgtagcagttatagtataagagaatttttaaggaaaagggtgatacagtgatatgtttttttctgcttaaaacatcactgtcagtatatttttggatcttgaaagatctcttgtgtttatggcttggggcctgcttgctaggcttgacttcagtactgtttactaaattatagcactgcaataagacatttcaccaatatgatattgaagcataacaagttatttcataaggaatggtaattatctaacattctaagcaaatttggcagtgtgacttggtggggcgcagtgctgtccctgacacaatgacagccttactctctaaattagtaacttccgtaggagaccccagaagcacacctccctcccagcagtgaaagccgaggattcccgttttgattagcaggcgccttctgttcacgataaagggataagaatcaggcagtgatggcagcggagttcatgcttcattaaggcaggcattgcaaactagttcagaggagagaatccacgatgacagcacattctgtgccatggagaacattcttaaatcaagcctccagtggaggaaggactcaagaatgaaatagcaccagataacggggcatcattagacttgtaaagcaaagcttccattttctatttttatataaaccattattaatgcctttaaaacaactgtgatatctggacaaataaaatagaaatgacttcttaagatgattgcaacttttagtcttgatttataaaaattattctacataattttagtagggtaactgataatttttctcactttttttttgttttagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcatttctggttggtgggtagttcacttatgaagctaaaacataattctttaaaaaaatgtactagggacataaggagagtggtatggtgaaatacagacttgaagactgtccttgggctctctgaatcatggtggatagatccttacttatcctgctatgctgggagagaggtttcatcccaatattaagcagaattaactttatgaacatcttagagccattagtaggtgctggaaattgtatcattttatttaagatatagataggggattgttaacttttctgataagaaaaattaggaaaaattttacttttatttggctttggtttctgtttgaaaggatatatccataagaactacttgtgtaaagcttattagaagaaatatatgctgctttcttaagcatacaacaaatgtcagaaatatttggaggagaaaaagtttcagccttactagcctttcacatttatacaatcccttcacatcctgttaatcttcttttacttactccatttaaatgtgtttcatagcttagactaaagcatatttgaggtgagaattacacatttttagtagtttgtaagatccatgaaaaaaattatctgtatttattactctctgtcaccctgtttcatcttgttttccaccatccataattccacttagcttaattcatttccctgtgccttaggcataatcaatagttgaattgcatatttctgctccagaactctgctcttataatgatattttaaaaatatattagaacaaagtaacaaagtctatcttctatatgtacataatttttttttccaaacacgtgtttgaggctggaatgtggtgaatttttagattttatattacaatttatagcagacaaaaagattttctataggaatccctttgttggaagttggaggaattgtatacaagtttatttctcatgctgattataagagcctaaaatacttaaatcggaagactcaatttgacatttgagtaattctaggcttgaaactggcaatttcaaaatatagtctgagaaattgataatagtatatctatctctatgtagatacacacaccacacattgagatgctttgactgaagccacatagaacttggtcactaaaatacttattttcccagcagcagtacattttgatctccagtgagacactttccaaaaagcaagagtccaggaagcaaaacaacaattagaacttttttttccatttaaactatactatagaaatttacaaaatattaagtatcatgagtacattgtttggctaatgccaaatagtggcatattttacagtgattccatgacattttaaaagttttcttactcttttccagtcttactttatgaatttccttaaaacaggcacccaggtaagaccttgagccacaagaacagttcataataccacttaaaaagtcacctgtgatcagctttttgtttgaacctggaatttttcctttctgtttttcactacagtttgagagataaccttgagtagaggccatttgtctttagtttattccttggaggcttaatgtttacatttttaaatgttcatttttgtagattccaggggtacatgtgcaggtgtgttacacggacatgttgcataatggcttctagtgtacccatcaccttagtagtggccattatagtcaataggtaattttccacctttcaccctcctactaccctctcccttttggagtcccgggagtctgttctttccctttgtatgtccatgtttacccattgtttagctttcacttatgagtgaacatgtgatatttgattttctgtttctgaattgtttcacttagggtgatccatccatgt
